United States Patent 11,001,841 (CCCTC-BINDING FACTOR (CTCF) RNA INTERACTOME) - sequence listing, part 20

SEQ ID NO: 50651 - DNA, 1029 bp, Homo sapiens
attaaaacttatacatcaattccctagcagcactatttataatagccaaaaagtgggaacagcccaaatgtccatcaaccaatgaataggtaacaaaatttggtgtatccatacaatgaaatattattaggcaatgaaaagaatgaagtactgatacatgctacaacatggatgaaatctcaaaaatatgctaagtgaaagaagccagacgctaaaggcaatatattgtatgatttcatttatacagaatgtccagaataggcaaatccatagaaacaaagtagattaatggtttccaggagctgggagtggtgccaatatgcagtgactgctattgggtacgtagtttcttttaaggatgatgaaaatgttctaatattgcataatggtgatggttgcacaactgtgaatatactaaaagccattgaattatatactttaaaagggtgaattttgtggtatgtgaattatatctcaataaaagtgttatggattaaaaacattagtgactgtattactataactatttgaaattataaaagtatatttaaattacattttatgccaggactaggggcgggggggaatggggagttagtatttaatgggtgcagagtttcagtttggaaagatgaaaaagttctggagatggaagatagtgatagatacccaacaaatatatttaattttacagaactatatacttaacaatggctaaaatagtaattttatgttatgtatattttaccacagtaaaaaaatccataaccccctaagattatattttatattattctaatgaatgatgtgtcttttactctttttcttcttttaacagtaaaactgaaaatgtgattggccttttgttttttatgcatataattcttctggtctgtattttagaacttctttcctgtgtggcgttgggggatgcgggtggttacacacacacgtctttatcttggctttgaatgagaacttggaagtattttttaaaacttttatttgtcagtaggaaaataaaagaag

SEQ ID NO: 50652 - DNA, 1361 bp, Homo sapiens
tccatctcttaaaaaaaaaaaaaaaagaaaaagaaagtttccttaaaattttggctaataaatttcccagcaaaatgcagatctatttctttatgtaaattcaagttggcagtaatttttctagaacacattaagtaattaatagatgtattcttattcagcaaaacaggattgtggtctgtcaccacacttaaaagactatctttttttctcctttgttgtacttagacctctcggcagtgaaataattatgcaggtgctggcagttctagaacttgattgtgaactatgccacttttgttgaactacttaattctaagaaattagcaatgaaagtttagccctttctagggaacagtatgaccacataaaaggtgatgtgctgtgttttgttttggagttttattttgttctgtgtgggttagtggggttgtgtgtcaggggagtttgaggggggattgattgcttgcatggtacaaatattcactttccattagattttttgagatactgaaaatagctaacaaacctactttattactttcaaaggtcctagctagattgggtacttatgggattcattgtaaactgaatttgcttttatattttggtgttgtaatctggcatttttctaaagcagtatgagtttaaagccattataagcagcataatattttccctgtcatagtagaccatcgtgtgatcatttttattcttgattatttgggtaaccactctaggctcattgtgaacacttagattaaacaagttcctcctccctctcatttaatattagtctttatggtagcatcacccagattgatttttcttatgaaaagaaaagctgtatgaatcacctctgactgtacattattgttatggaagctcattctggagatgttaaggccaaacaatttttggcaagtggttgtggcaagacttctggctaaagtatgcattttggggaaataaattagatgtatcacaaacaatgcaaaattaattagtttaatttacaacctacattttttgcctttttataaaagagatgatggcctgagtcctaaaacttatacctaatttgatagtttcagtttattaattacaaaatgagaaacatttgtcagattttataggcacttaatttaaggtacagtttggaacctaggttgttgtacgctctttactcaaaattatccacatgaagcatggtgaactatctgctcaaactggaatcctcattttagccatgaggttaatgcactccttcgttatcccaaggttgtgctaatgtgcagagatgtagccacaaaattcccagcagaatgtggaaactaagcagcaggaaccatttgcagaat

SEQ ID NO: 50653 - DNA, 1057 bp, Homo sapiens
cattatgtatcaactgtgagactccctcatctgtaaataggaatgttagtatcagcctcctagaattgttgatgaagactaacataattagtttgtttaaaacatttattgagatagcaaacatataggatacactcaatataatgtagtagtagtataatataacttttgctaaatgtagtcctattgggctggcctgtgagccccttgaaggcctgtcttttggtctttatatctcaggcacctaacctagcagacagtcaatactcaataaatacttgcttgaattgaattgatttatttaccctatttttatcttccattacagcccactgtttgtaacatggaagattggtcgagacaaaagattacgtggatgcataggtactttttctgccatgaatttgcattcaggactcagggagtacacacttaccaggtgaagaccaatttttgttacctctgcttttacattaaaaaaaaaaacttatgaaacttgaatctgatactttaactccttttactgaattgtcaacgttcttgtcttccttcatgtcaggtttttcctttgtctttaaccatttaccttttctctggtaaaatgttattgatatatattaccataatataaaatactgtgattaatgtattctgccatcgatgttttgaagtgttttttttttcttccagtggccagcttattttgtataacttgaaaaccaatgaccaaatgtccacgggttaccaaaatatgtgatttctatagtaacagtcattatttcttccctcttgtgttttttaaaaatagttgttgtctctttcatcttacacattttgttacacttttaaggacttttgaaattgaaaggagagcctaggaagaaagtgatgccacagcctagcagtataatcattcacattcacacttcacccagaattaattgtagcttgcttattttcttttatctaataaaaggacaaagtaattcctcattacagttgtttaaaactttgttcttaatttctgaattcacaaaaagctatctagcacacaatg

SEQ ID NO: 50654 - DNA, 1027 bp, Homo sapiens
atgcagccattaaaaaaagaatggaattgtgtcctttgcaacaacatggatagagctggaggtcattgtcctaagtaaattaagaaacagccaaataccatatattctcacttgtaaatgggagctaaacagtgagtacacatggacataaagatggaaagaataatagacactggagactccaaaagtgggaagggtgagaggggagtgagagttgaaaaattacctatccagttcaatgttcactatttggttaatgggtacactagaaaccaagtccccaccagtacacagtatacccatgtaacaacaagcacatgtaaaccctaaacctaaaagaaaataaagacaaataaaaaacgcttaactgttttcattgttttgtttgaagtgttacgaattccctgaccatcctgcatacacagtcaaatggaaataccaaaacaaagttccatacaagtttttaatggcataaaaaataggagttgactgtatcaattaatattcattctaaaatttctggacctagttcttctgttattcttagttttgcttaacatttagcttaggaatcggaagacttcaatagaagctcttttttgcctgatttgttttatattaaaataattaattattattatttttttgagatggagtcttgctctgctgcccaggctggagtgcagtggcccgatcttggctcactgcaagctctgccttctgggttcacgccattctcctgcctcagcctcccgagtagctgggactacaggcgcccaccactacgccctgctaatttttttgtatttttagtagagacggggtttcaccatgttagccaggatggtctcgatctcctgacctcgtgatcagcccgctttggcctcccaaagtacaagcgtgagccactgcgcccagcctaaaataactaattttttttaatagtaaagactaagtctcaaaccttaaagccctttgaacaaatgggttcagaataggacttccaaatagaaattacttcattttt

SEQ ID NO: 50655 - DNA, 1258 bp, Homo sapiens
tcactgagagaaagggaacaaacgaagtgagctctaccatcaccctgactttttgtcagcaggcagtttctagaccacagcattgtgagggggaacccaagcagaactgcaatcttgctgaattggtgagacagagataggaactcagggaggcctaggtggcagaaatttatggagcagagtactggaggaggaaagctactcagagacatagctccagaaatctgcatagatgttccccttatctctggctgaatatgaatctgtgcatgtatcaagggcaacactgtgaggctgggcagaaaacaactgctcaggagctataagctgaaaacttaccagagctcatacagacctgagagatatatgagttcctacagcaagagttgtgagcccttgttgaacacccagggcattccagagagactccagaagggtcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaagcagattaacctacttgcaactggagtcccataaggaaaggagagagagaaataggcagaaaaaaaattgaagaaataatggctagaaattttccaaatatgatgaaaatgtaaatccataaatctaagaagctcaatgtatccaaaacagaaaaaccacactaaagcaattataattttttaattatttatttatttatttatttttgagacggagtttcactcttgttgcccaggctggaatgcaatggcaccatgtcagctcaccacaac

SEQ ID NO: 50656 - DNA, 1070 bp, Homo sapiens
gtgtaccccatcagcaccataatcttacattttccagatatggaatccgtttaagaactacctgcttaattatatttattataaaaatgataatctcagagtatccctacttcttcaaggtatccaagaaaggaaattaacaattttgggcgtctacctagtagaggtctcattgacccaaaatgatgatagcattaataattatacctttattgacagaattataatacttagcagtttccaggaactttttaatggatagcgtccttggattcctgtagcagttcatcaagtaggcagtccccatcttgcatatctgtgtccaaggatgaagggaataggatgattccttcatggtcttttgactgatggatagtggagctgagctttgggcctaagtcttctgacacccctcctttccctgccctattccagcacttttatccaactatgccacatttttttttttaatctgaggttctggtacatgatttctcaaattactagaattctaagacaaaatgtttcttaggtttcacctcattttatctctgagatgtttatgttcctaagagatagttcttacgtgtgggagttttaaactctacctagaggtcagagaaagctgtttatgcctttgatgtaaattttgtgcaccatacttagactatactacacattccaaaacagtatttcttgggcctagacttgtaacaaaactctctagtgtgatgtattctcattcactcttttatattaacctattttattctttcagcaaacatatttagcccttactatgtgtcaggggataggaataggaccgtgcaaaaagacaacctctgttttcttggagcttacgctgtagtggataggaaataagcaaatgggtagtgatgtgtactgtgaagaaaaataaagcacttttaaattttcgcccaagccatgagattactaaattgtggtatctatcagtgaccccttgtagaccttatagaccttctaaaaagttagttattgagaagatggcccaggaaaggaacattgtctctgacatccctgtgcagttt

SEQ ID NO: 50657 - DNA, 1089 bp, Homo sapiens
gtctagagaaattcagataagttcttacagaagaggagtgctttagtctttaaggtttctttcactttcattaagttatattcaccatctcataataacccttcattaactcttaactaatttaaatagtttgtaccagtccagcacggcctcaggtccattcattttctcagaattgttatatttaaacactttttacttcaatctctcccaccccaaatttgaagtataaatttaggaaaatcagtcaatctctctctctcttttttttttgttttttgatttgtttatttatttttttggagaccaagtcttgctctgtcgcctagactggagtgcaatggcgtgatctcggctcactgcaacctctgccttctgggttcaagcaattctcctgcctcagcctcccaagtagctggggattacaggtgactgctaccacgcctggctaatttttgtatttttagtagagatggggtttcaccatgttggacaggctggtcttgaactcttgacctcaggtgatccacccacttcggcctcccaaagtgctgggattacagtcgtgagtcaccgcgcctggcctaggaaaattctcctcttaccccttcttcaatatagtttctctctggagctttgccattttcaagagcagtaatcttgaatatttgaaagcttggtagcaccttcattatagaatttttactgtgtaaattctagcaatgtttatcactagcaaagttctttactggtcctgctggttttccatttttgggagatggtagaatgatgggaatggggaggtgtaaatttatgacttccaagtttttttttcaatcattggatttgagtgtctacagcagtgtataaacactgtctaactgggtgaattttggaatcagggcagtacaaatctaaaaagtttctagaattttttccagggtgattttaaagcagagaataaatgagatgtcccattgtaccccttcctcctgtgctttacctgaaagaaggtatctttttctcttatgcatataactgaaaccataagatcattgtggatttatttgatattattgttagttagag

SEQ ID NO: 50658 - DNA, 1023 bp, Homo sapiens
gtttgtgctatactcaggtttcagttagcgggtggcagccaagtaggaatctctgctgaaatctctcagtccaatgggaagaaagaccactactgaaaaagtaaaaaatggtctgttaacccatgcatgagttgtttttctaagtatgtatttctcaggcacatgctaacatgtgtgttgttgtctttttaaaaactgtatgctttttgaaaccaaatttgtgttataaatactaaaaccttagctgtagtggattatatttttgaagtgaattgcatttcctatttatagacagttttactttttgagaatttatgtgtgaaacactaaaacttgtgtaatgagattagtcagttcccaagttttcctgatttcaataggcattattatgtactctcgatgtcacacatgcttggctcttataaagcagcacaatgaccagggcttttacatttaaattttgttaaatagtctctttttcaaacttgtgtaataatgtctctttttgatactgttctgaatcaattaagctaagtaagtgaggaccagcagtaaaacccagcatctgccaagaatggaccctcaatgtgtaagctgtctttccacaatcagtaattgggcagttgctcacaggacactggagacagtgtgggaaaccagtggttgtgtaggtggaaagagtagattcccaacagtaagcttatttagagtttagcttctgtagttagtgttgctaagagcaaaaatgacccacagtttatgtagtataaagaaaataacccaaaggaagaagtacagtgtaatagtatagttggttgggtggagcatgttttatgttcagtccaactataagtggcatcttttgtatcaagtgtgggtgtattttctacagctcttaatgtttcagacattgaaacttgctcaaagttaaaaatgttagtgttgaatagctgagtggaaattatatgtcattggaaaaaaaaaccctgtttttgtaaaaaatatacattatcctgagtttca

SEQ ID NO: 50659 - DNA, 1142 bp, Homo sapiens
aatatttattagcttgagtcacttatttgtgacttttatgccttctcttggatgtctgtgatgtattaaagctagtcctgggatgatacttaggttggctctgcaaagtcatgggactgcaaaaattcactcctgtttagttcttgagctgttaacatgagtttggcaaaggctgctttagtattcacgctccattgctccaaagcatatgagaacacactttcaggaggtgctattttcacacattttacagtgagtttgggttaactcaatgactataacaagaattttaaaaggaaagtgagcttgaccagttcatacagaaaatgcttttgaaaatatcattttaacagtagccactttgcacacgtatttagatattattctattcaaacaccccagcccctggatttctttttcatggaattaagcagatgataggacacactttgaccactgtggatatgttgaaacggtggtggaagaataataactattatcatctagcagaccttgaatgtgtcatgtattctataaaacaactaatgtagagtagacactaaacatgaccaagtggagaatgaaagttcacttaagtggaaaatggactgtcttatttccatttatcttcaactcatttttgaggtgtactgtggaaaattcaggaaaacttcctgattatgggagggacataactaagcatttcaacagtgccttagtaactaccacacatttgtctttctgttttacatatttaacagcattgtgtacttattagtgttgctttatcctaagtgccataagacataaacagacatattgggatttttttttctcatagttattatcatgtcatgagcagtgtgtttcaggtcatgtctctgcccaccagatgttgtgcttttgacagttttaacttctcatacgtaaacgcacactcttttcatcctttcccaggacttttctctcagaatgtctgtaactggtgaaatcctcgttttatgggtttagaagctgtagatccatcagttagttatccttccactcagtattgaggggatgtcaatatatgaacaagctgtatggatacaaattcttcactgttgcccccatgttttgattacctacccaattgcagaaag

SEQ ID NO: 50660 - DNA, 1069 bp, Homo sapiens
tattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctct

SEQ ID NO: 50661 - DNA, 2010 bp, Homo sapiens
gtagaggccattatcttagcagaagtaaatgagggaggtggcaggcaagtctcactttgccattggcttcatgagggctctgatggtgtctggttctagaaatatgggttttttcttcatccctaagtgttttctaacccttatttccatttagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgt

SEQ ID NO: 50662 - DNA, 1032 bp, Homo sapiens
tgcctggagttctcttgcagatccccattctcttaggaagtataatgaagcagtgccagttcattgttttctcggtctattgtctgatttccttgaagaccaatataattgcatcagtattctccctaatcctaataacctccctcacccgcccaccacacacacacacacacacacacacacacatgtttttccttattaattggtctttgagttaatggcctgagacactttcaaatggaacatgatggtcctttatgcagttagaactctggcaagagaacagtcactttgttggggtagacccattgatttggtgctagaatgtttcagatgtagattagataggaatcgagtgggactgactcaaaggcactatttattagctcacatgccctacctaatcttagctgatgtgtctgttgtttgcttctagtactcaggtgtatttaccaatgttcatctgtagccataagttacttagtataccctctgactttcttgaaagtctgacctttccccctctatgacttctaggagaataaaatggaaatatatacatattccttttttttttttttttgagacagagtctccctctgttgcctaggctggagtgtagtggctcgatctcacctcacaacaaccttcacctcccgggttcaagtgattctcctgcctcaacctcccagatagcggggattacaggcgtgcaccaccatgcctggctaatttttgtatttttagtagagacagggtttctccatgttggccaggctggtctcaaactcctgacctcagatgatccacctgcctcagccttccaaagcgttaggattacaggcatgagccaccatgcctggcccaatatatacatattcctgttgcttggccatgatctaaaaacttgaaggggctatctgccagaaggttttgggatgatatctgttcagttctgaaggcaagtctgtgcatatctcatccctcactgacttttgcagccacttctatactaataacgttgccttctac

SEQ ID NO: 50663 - DNA, 1028 bp, Homo sapiens
tctctaaaaaagaacaaaccacctggagtactttctgtactatacactctactaagcacttaatgcatcatctcatttgatccatataaagatacatcatgatttgtcatgactaaggtaaaagtgaagcacataatgttcaagatagtagtggagttaataaagcgtataggtctttgttcctttttacacgtagataagatctagaaaatgtagagagtgtaacttagaagatggttggctttgttgattgcatctctaggatcttggactggtcacatgcaagagttgtctttttctaccctatctagagagtaggcatttactaggtgattatgatgtttatgggtgagttgcactttttctccttttaaatgaggtgggaaaactatgccagccacagtggtcttgctaccttgtggaaaatcatcccagtggcaaatcaaaatgagatattttttggcttgctttgtggaatttatctgacctgcatgcctatctttagccaactcggagaactccccaggcctttattgcatttcccttccagagagttggctcagtgacttctattgcgggatgcttttgctaggatatttaggtttcctttctgaagaaatccacgtggccctggattgcttatttttcagttttgtgagcttgcattgcagtagtttaccaccaaggcaagaactgcatgctatctaagtttaattgcctttaagtataactgctgcaagccttagtaattatagttcacattctctgcgttaacattgccttgctcccttaggactttcagagcgattcacaaataaatgcattcagctttaaattgctcataaggattataagacccaaaaggtgaaggatagaggttgtttccttctctccaattattcaaagcttagcaaataggaaggcagaggcaaaagttttggttgccctagtcagtgttgttataaacagccacaaatcccggggaagaaaggtttaaacttactgaggtaaagagtttgatggtgttt

SEQ ID NO: 50664 - DNA, 1024 bp, Homo sapiens
ctacatccagccagttgctttttttcttaaatgactatttcaggaagtctgttatagcagctgtctataggatggactcatgggtgggtgtgtgtgtgtctgtgtgtctgtgtgtgtatgtgcatgcatgtgtgtatagatcgggagagcaactgaaagtaagatctgttaggtgttattatagcttaaactgtgttggctatgaacatacaaagaaatgaaagaatatgagagatgttagaattaagacatagtagtagattggatatgatagacaaaggaaagagggaagaatgataattccaagattctgagactggaaaaattaggtaagtgatgatgatgatgactgaactatcaaaaggatgacattttgaggaaagatgaaagccatctggggcatgctaagtttcagagtgagaaatcttatagtcacctagaggtctgtgactgaggataacatgataacattaaaatattagtgtggcacaaaggagatctccagtagtgctgcaatgttgagcaaagtttctgaacctcagcgttcctgacatttggagctggataactctttagtggcggtggtaggatgctgtcctgtgtattgtgggctatttagcagcacccctggcttttagtcaccaaatgccagtagcaccccacctccagttgtgacaaccaaagatgtctccacacattgctaaaatgtcccctggatagttgggcatggtagggggtggggggattgcccccagttgagaaccattgatataaaggcaaaaaaggaaactaccatagattggaccttggagtactgtaggaggcgggagtcagggtagggttagggagaaagtggatctaaagatcaagccagggagtaaaagcagtttagggatctacattaagaaaacacagaattggagaaagcaaggaaaggatttgacaacttcttgaaagttggcatttggtaagaaaactttaatagatgaaggatttactccattcactgaatgttcaagaggga

SEQ ID NO: 50665 - DNA, 1070 bp, Homo sapiens
gtgtggaatgtgagagggctggcagagagagccagtgagccttgttctttggctttaggctagaatgaaagccatggagattcaacaagaaggggcccaaatgttaaccttttctgaactgcagtggctagtgatgatgtagatgtcacattgatagctcgtattggagtagccagtgcattttctggagtcccattgcaattctactcaattctctaaggctaaattcataccgttttactccatttccaccattgttcttaagggctaatattttcccttctttctggatctcttactaatttgatttgtctttttggttttaaagatacataattttctgctatgacacctatccacaaagcatcataaccaatttcctgcttccctgatattagaggaagatgtcataggcatagatatttatatgtctaatactccaaaataattttcaaacagcaataggatttcattggtgaaggtaaatcttacccagtgttttgatggattatagatttggatggaagatccaaggatgtgaattatgtgtgcatttagagtattgataggatacagataaaatacatatccacccaggaatcttccaaagtgttctgctggtgcattattgatttatttgaagggcatttcatctaaggatgacattctccatatttatctcagtctattttatctctttctttcttttcttttctttctttcttttgttctctttttattttttatttatttatttatttattcattgagatgcagtctcgctttgtcacccaggctggacagcagtggcctgatcttggctcactgcaacctctgcctcccgggttcaagctattctcctgcctcagcctcccaagtagctgggactacaggcatgtgccaccacgtccagctaattttttgtatttagtaagacggagtttcaccatgttggccaggctgttctcgaactcctgacttcaagtgatccacccgcctcggcctcccaaagtgctgggattacaggagtgagccaccgtgcctggccgtatttacttttaggtaggtgt

SEQ ID NO: 50666 - DNA, 1034 bp, Homo sapiens
ctggagaaggagtaggataaaagcataacatggcttccagttttagtgtattatcttttaaaagacattggattcccaagagaagcagatgctgagataaagtgggttgggttagggggtggtgttgggttaggttttccgtggagaggacatgttgtcgagtagacttgatctcagttacaaagtgatgttagtgtgtgaagggtgggcatgagcttttatccagtttatgaaatgtcatttttagcactatttaatgtactgtcatgaggaaacaattggaaaaatgttttgagctcaattgctttttgccaatgtaagacaatttggaagaaataaaattgaggagatgagcctaccttttcttctgagggctctgtgtgtgtgtgtgtgtgtgtgtgtgtgtgtgtgtgtgtgtgtgtgtattctttgtataatgcctaataatttttggaacacgttacaactattttctcattgcttctgctcaacaaccattaagttgttaagtgacttttctgaatttctacaacaagttagtgagagagccagtgatagagtccagatcttgggtatactggttcttcagctgtgcactagagcagtaggctatctagtaaagggtatgatgtgtcaattttgctcaggtaaggctttgagctagctccaggctggcagtgttgatgtttaatgtcctgacagataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagaggtatggtttcctcaggtagcatatgagcctgggggtgggagggctgggaaatcggggacactgggctccacattgtggtgaattggcagctgcataatccccagaagggaggtgccatctgctgctcctagtttccactgtgctgatgtgagtggactttgctttcttttctcttcttggtaaatt

SEQ ID NO: 50667 - DNA, 2471 bp, Homo sapiens
tcctgaccaccttgtaatgttgattttctgggacttgtcttgggaaacattaatgtgttttggctcaacctcacaggtgtattgggagaggccaatgactgcaaatggagtaagaatttagcttggccttgcttccctgttgttgttacagaagagttgattatatagattcaaattgcatttttaaagacagaaccgcaattattctttttttcctatcaaatattctcagagacagtctgtgtgcccaggacaaacaaggttattttattgattgaagatgatgtcagacccctggcagtggcatgattaaagctacagggagattaaaggttatagtgttcatactgttttagttcttgtgcatgaaacaaggagtcttttcctttcctttctcaaataaatggagtagtgttttcctcattatgtgactcttgacatgtagatgaacataagttctttaagaaaaaaatagtaaactggagaggactctgcaaagcttttttcttaggctgatttcttttttaaacaagagacaaagatggcaggaggagggtgagagggtaggggaacgatctgtgtccagttaacataaagtgatttgggttttgaaaaggatatggaggggcctagcgtggtggctcacgcctgtaatcccaacaccttgggagaccgaggcaggcagatccctgaggtcaggagttcaagaccagcctggccaacatggcaaaaccctgtctctactaaaaatatgaaaatcagccaggcatggtgacacgtgcctgtaatcctggctacatgggaggctgaggcaggagaatcacttgaacctgggaggcagaggttgcagtgagccgagatcccaccactgcactccagcctgggtgacagagcaagactccatctcaaaaatagataaataaataagaaaaggatacagaggacagaattgagagaagagagtaagaccttgcacgagaaaagttttctcaatgaagagctgagtatcaggagaaagtcagtaatatcagcatgaagaatctaagtagtactggaaaaaaatcatatggtagtttctctccagggactcgcgtttaaaagccttgggctgttttctggtgtttcagttggaaaaaaaaggatgagtgttttgttcagaattggacaatagaagcacggtggttatgtaccatagctctgttaacagtccagctttgattccaattagaagttgttcctctgcttcaaaattaggggagataccctaaaataattaccttgcagatttgagatgattttgcttttgatcatgattatatgttgtgccaaaacaagatggaaagacacatttccgtgtttgttcactctatatctgttcactttatttttggcaacattgcaaggaaataatgttaaattaatcactttgtggttttgtggagtttttaaaaacttgaatgttttgaacatgctctcaaaatacagagatgtttgtgtacttcttttgcattgctttcctcctctcatggagtcactggtgtggattaagcctttcctttaagtgatatgaatgaatcatacataggccaggatagaagataggaatgtggttcatgtgcatgtcacttaaactcctgagtcttagaatcattttgattaggctgacaaggctttgcagagagtccaggcagaaattagacataaggactatctcaaatccaggtctattattcatttgcatccagtctatataatgtaagtctatgagttttttttactgagacactggggcagtggaagtgccaagaaagcaagtggaggcatcttctgcttggagaagggttgcgctctgtgttgggaagggcagtctactttcctactccaagaatggatggaccattgatcagatgatcagagtgtaagctccatgagggcaggaattatattttatgtgtctttgtagcccttattgtgtctagtatgaggctgacaaatgtgtggaatagttgatacacaataaatacttaatgacttggttgaaaagaaggttcttcccctcccctccacctatctgagcttgaggcactcaaattgggagcctcactgagtgttctttttttgaccaaaaacctaccttatgatgactgccctcccttctgggatgtgggacagtgagcctcactaacctcccctgctactaatagcagtttaaagtttgcaccctaaaggtgacagtggttttggcttttgtcatcatccaccattccaacttggaatggaagtggtagctttctagggctgtgaggtcagaacagagcaagtctcagacctgaacatttccatcactggagactggcctggccttccggacacagctactggacactgaggtttcttttctgccctagtggagatggactctgctactcatttaaaagccaagcaccataggaggacaagtcattctcttg

SEQ ID NO: 50668 - DNA, 1035 bp, Homo sapiens
tattttgtttctcaaatgccaggagaggctaatggatataataagtaatccctaaacactctctgtgattcaggagttgttcatgtatctagcaaggctgttaatttaattcctttgacctcctgttatccctcccccattcttgttaacaacaacaacaacaaaactagggtccactgtttactttgtgtaaatcattggcaatgatttttaagtcactgtatggtgaaatcccatcaagtgagtataaatttgagtggaatatgaaatctccagaatgagaaaggagaagcaggaaagcacaaatatacttgttttgtagcatggaaaataatatgtttaaattagactaaaagatagcaaagaaactaaggattttagacagttaaataaaagacaagaagtgcagcagcagaatggcccacacataatgggttcttcatctgaggtcttcaccatgtagtcaaatttcatagttctttaattttcctttgataacaaaggtgtggtatacatgtgatctctaagatttgatggattagccaggcatggtagctcacacctgtaatcccagcgatttgggaggcagaggcgggcggatcacctaaggtcaggagttcaagaccagcctgaccaacatggtgaaacccctgtctctactaaaaatacagaattacctgggtatggtggcgcatgcctgtaatcccagctactcaggaaactgaggaataaattgcttgaacctgggaggcggaggttgcagtaagccaagatcacgccattgcactccagcctgggcaacaagagcaaaactccgtctcaaaaaaaaaaaaaaaagatttgatggattcattcctggaaaccagtggctcatcataaattagattaaatttctctaactggaatagaaagtgtggtatgggtttttagtatttagaaagtagcaaatgaggaacaggaacttttttttttttgtaatatatgatcctggagaaaatgcaaatgggtgtatttgccaatgtttcctaaggcaat

SEQ ID NO: 50669 - DNA, 1050 bp, Homo sapiens
ctaggattccgagcctttgccacatcaaagaatgtttgttctaccacatcgcctgtgggaaataaagttctgtgtcccttctaaggaattaattatgcctgcttagtttgtggattaagttatatttgtttttgaaaagtgttatatctgttttctgtttttatatctttcaggaattgccacactgtcttccacaatggttgaactaatttacattcccaccaacagtgtataagtgttccttgtttgctgaaaccacaccagcatctgtttttttttttttttactttttattaatagccattctgactggcataagatggcatctcattgtggttttgttttgcatttttctagtgatctgtgatgttgagctttttttcatgattgttgaccacatgtatgtcttatcttgaaaaatgtctgttcatgtcctttgcctacgttttaatgttttattttcttgtaaatttgttcaagttccttatagatgctggatattagacctttgtgacatgcatagtttgcaaatattttctccattctgtaggttgtctgtttactctgctgatagtttcctttgctgtgaagaagctccttagtttaattatatcccatttgtcaagttttgcttttattgcagttgcttttggcatcttcgtcataaaatctttgtccattcctatgtccacaatgatattgcttacattgtcttctagcgtttttatagttttgtgttttatatttaaatctttaatccatcttgagttaatttttatatacggtggaaggaaggagtccagtttcagttttctgcatgtggctagccagttatcccagcaatagcaaagacatggaataaacttaatgcccatcagtgatagactagataaagaaaatgtggtacatatacaccatggaatactatgtagccctaaaaaagaacgagatcatgtcctttgtagagatatggatagaggccattatccttagtaaactaatgagaaacagaaaatcaaatactgtgtattctcatttaaaagtgggaga

SEQ ID NO: 50670 - DNA, 1019 bp, Homo sapiens
atttcctgcttccatgacaatggaaggcaggtaatcctttatggagtctgagctcgctcccaacagggaagatgggattgagttttttcgtgcttttaggatggtagagaacattgttcagcctgagacccatccctaggtaagtaactgaattgaggttttgatttgactaaaattaacaaccagctggttttaatttctccttaccattagagcactcagtgatcatattgttgggttttttgttgttgtttgttctggtctttctcccatcagatttgaccatctctacctgatttcgtcaaatctgagtgaggattccaaattatgggtaagaaagcctctctaatttgtctaaaattccttgcagctgcaaaagaggaaaaaaaaaaaccgtgcacttggtttctgtgttgcttcctgtcttgaaaaacaaacattctttcatttacttttcttccaccctattttttgccatttgcagtaccaaaaaaaaaaaaaaaaaaaaaaaaaaaaaaaatctagaggaggcttctaatgacttgaaccactttaaaaaattcagaacaaaggcatcactcaccccttttggggtgttctgtgttgtcaaccttggcaaaataaactgtctaaattaactgagagctgtctcagatatttggggttcacaatatgtcattttcagtaggtagtattttctttaaataacaataatttttatgatatcctcaccaaataatattgcctttatgttagataaactatataacataaatataagagaacttttttttttttttttttttttttcgacagtcttgccctgtcgcggaggctggggtgtaatggtgcaatctcagctcactgcaacctccacctccccagctcaagcgattctcatgcctcagcctcttgagtagctgggactataggcacgcaccaccacacccagctaatttttgtatttttagttgagatgtggttttgccgtgttggccaggctggtcttgaacacctgg

SEQ ID NO: 50671 - DNA, 1573 bp, Homo sapiens
tctgcaaaaaagccacttgggattttgctgggattaccgaatctaaaatgatttggggaatattgtcatcttcacaatgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataattatttctttaattccactgtcaattttttattgctacttcatagaaatagaagtgattttcttttattgatcttgtattctgcaaccttgcagaactcatttattagttctataatagtttttttgtgtgtgtttctgtgccttaggagtttctctttacagaatcatttaattattctttcaaagaattcatccatttcatctaacttgtcaaactattattatgaagttatttataatgtctccttattatcattttggtatttgtagaatatcttgtggtgtcacttcccttatttatgatattggtaatttgtgtattctctctttccttcctgattagcctagcttgaggtttatgaatttttaaaaatcttctaaatgaactaactttgggttgcattgattttttttatctattgttttttgtttttttactttattgttttcctctctcattctcattatttgcaccattcttttgccattggtttaatttgctcttctttttttagtttctagggtggaagctgaagtcattgatttgaagccttccttcttttctagcatacacttcagtggttatttgaataaataagcaaaatattaagagggcaacaaatatagcagtgaagatggagatgaggcaataattttgagaactctttatgggataccatcattagtatttggagaatgggttatgggagtaaggaagaaagaggaagactattatatttcacaggtttgtcaatggagattgaatagtgtattactaagacatggatcgcagaagggcaaattaatttggtaaagtagttctgttgtggacacattgattttgatatgtctgttagatgtccatttggctgtgtccagttgatattgtatttggagatcaatagagagatcttgggaggaaataaaaacttggaagccatcggtatggaaggggtagttaaaactagaaatagatgagaataccaaaagagagggtatagtgtaaaagagaagagagtgaagacagaacccttggaaacatttggaatgttggaagaggatcggtgagggctaattaatgaaagctactgcacaattgctgtcagaaaagttgaagtagaaaagaatggtgtcacacaagacaggggaggagtaaggttcccagaaaggcattaatcaaaggcataatatgactgagcagtcaactagacatgtgcaacatttgacatttaagatggcattggtgatttttactaaaatagttttagtgggcatatgctttagggttagatgtaagatagcagtggttgagtagtgagtgggaaatcca

SEQ ID NO: 50672 - DNA, 1031 bp, Homo sapiens
aagaaaagaagttttattatttatttatttttaactttttaatttttttttaggaatatgacagaactgatggtttttcacacagtccctttggcttgaagcctagatcaggtaaatagatattctgtaaataaaatttattagttatatatgaaactagtttcccagcttaaatgggattgattccatagtcttaagtacacatagattctttcccctctcctaaaagcaattttctcttaacgatatttgtctttccaattcccattcccatttctttcttcctctttaccttcaagctcctgaaacctcagctttttgccttagatatactgcagtcttatttctactctactgtgactgctgttagaatgaccactctgccagcagaccaaacactgtttgaaattatagcactccattatattgtggttttataaagggatcttttcgcatttggcaagcccaaaagaaaatggatccatgttacttgtcaaggtattgaactatagtttttattcctgaataactgtattgaccttcaagaataatttccttttttaaaagataaaaggctgacatatgttcagtaatcatttttaacctgggccataagtttctaataacgtatgtttgaataagaacatgtataggtggtagaaatcattacacttatcttccctgttgctttcaattatgcacataaatagagttcaaatatattctctaaaaatatttggaatgtattagtgagtaataatattttatgtaattttgtattgattcatcatgcctctttccccatcaatagttgctccttcccattaactttgtaacaagttaggaaatttctgtttttatagcttttagccgctcatctcgccaagaatatggggcagcagatccaggatttacaatgagaagaaagatggaacatttacgggaagagcgagagcaaatacgacaacttcgcaacgtaagtcagattgctctttcagatctgctttgtggaaatgggtttaacttggaaa

SEQ ID NO: 50673 - DNA, 1078 bp, Homo sapiens
ttctgttccctaaatctgtgtttctaattgtttggatgccctcattcccatcacctaattggttatcagccctaatatatgcatcgtttctgcaattcatgtctatctctattgcccttgccctttttggaaccctcatactttcttgcccaggcaattgtgataactgattaatggtcctcctttctcagccgttggataattctctggctttaaatttctttattctagtgttcagtagcaccataggttgactatagttaataataatttattatatattttaaaatagctagaagaaaagattgataatgttcccagcacaaagaaatgataaatgtctttgaggtgattaccctgatttgatgattacacattgtatgcatgtatcacaatatcacaagtacctgataaatatgtacaattatgtatcaataaaaaataattatcagacaatgtgagaaaatgcccttaaataaaactgtaaatctgtaaattttctcttaaatctgtaaaactgtaaatcatccaaaaaacttcttactggcttcccattaccaataagataaagtttggatttgttaaaatcttcgtggaccattccttctttccttttctatatttcattacctgccaaaattcactttcctcactagcctcattaaactgctctttgttttctacacaggctgtgctttcttagttctttttgcttttcttcttctgagaatgcccattagcccttttatctctggcaaattcctattaattagtgtttagaaatgggagtatagttgtccctctgtatctgcaggttccacatgcattcagccaaccttgattgaaaatatgtggggaaaaaaggcaaaaaaaaaaggtaaaaataatacaaataaaaaatatagtgtaacaactgtttagatatcatttacattgtattcagtattataagtaatctggagatgatttaaactatacaggaagatgtgagtagcttatatgcaaatactgtgccattttatgtaagggaagggacttgaatatctgtgaattttggcatgggtgaggcgggggtagg

SEQ ID NO: 50674 - DNA, 1042 bp, Homo sapiens
ttcacttgactagcctcaaaaaatatgtatatgtatatgtatatgtacataaaagcttctgagatggactgacctttctgtttttctggtttttaaactaggcctttattgtaacatttgaatttagatgtaataaaacttcagtaattcagaattcagattaatactagttggggatagccgagttgaattagtaaaaacttggaattagagagtattttcaaatctatgtatatattaggtttggagtttcaagacatttaaatatgtgcagtaatgcaaacttagcatctttctaagttttcatgtataatgagtattttaaattagaattatagttgagtaacagtaatacatttcccattttctaagttcttaagtatatcatcttgtatttctttgcatttcagttatcctcttattcttctatgtctttcctgcctctttacctttcaccttataaatatgctcaaacctctgttatagggaagaaaaagtagtatcttttccctactcgttgcaagaatgatagctgacaccccataacaaaagatggattaacaagagaaaagcataaaaatttactcaagtttttatgtgacacaggatccttcagaaatgaagacccaaagacccagggaaaaccgtatgttcatgctaagtctgatgaaagaaatgaatagttgtggagacacgtgattgaacaaaaaagggtatgatctaatggtaacaaactgggcctgtttgttgagaatcttttctgtgtctctctatgacattccttctccttcggtatgctgcaggaaacctgtcacatgcatcttaaagggagaagggaggaggtcagagagtgacctttctagattgtatggcttgctttgtgagacggggaattctagtttctattacctgccttagggagaggaaggggggcgaagaaaggggggcctggagaaggtcagagagtgaccttgaaggtgccatatcttggggtagtattttctgagccctgacactaccattatccctgactgccctttta

SEQ ID NO: 50675 - DNA, 1050 bp, Homo sapiens
cactgctagttgtagcaatatgtagtatgttttaaaagaattgtccaggaaaagtctttcattggatttgtttcaataaatatttgacacatatttacaattagcatttaactgttcctatgtaaataagtgttgtttatatagttctgaaaatgcttgagggcagatttttccatttttttcttcttgttaccttagtagattgcttgagtgtcttttatcttagctaaaagaaaagctcagatcatccaaattatcccacatttctagttagcagggttttaatgaaattttactgtgtacacatttgtaaatattgtattattgtctatttgtgattggggtctgctgtatttgtagaagccaatcattagaattcagaataatattcaatactagccagaattcattactggatttgactcaaatgaatagtacaaacaagcttctgctccatgaatagcaaattttgttgtctttgtacacgttttatgtttcccaaagcctaattattattagatgataatagtaatttcatctgaaacatagtactagtctacattgtaggttcaagtttatatcactaataaataggattatattctctgtttttctctggtagaaataggtctgtatgcacatttgtttgtttctatatatgggtgtgtaacatacatttggaaatagtatcatgactaaaacaaaactgttatatgtcttagtggatctgtggtaaatttaagccttcaacaaataaatactgagtccttttaatgagtcttacatttcctggtcaatataagagataacaaagaaacagaagacatgaggaaaaagggaaggacattctaagtagaaccctggtcaataatagtgaaagtttatttatcctaaccctttatacatctgtaattgtgtttacattccagcattattttaaagtttccctttttagttcattggaccttgaacaaagcactgaataaaatttgcttgtagataaaacttagtgaatgactgatggtatgggggaaattttagtagtatttc

SEQ ID NO: 50676 - DNA, 1546 bp, Homo sapiens
aatctatttaatctttgccattctaaaaagaacaaattatatcaaaatgttttatttttcatttcagtgattaaattagtgatgatgagtattatttcaagtttttattgcctatctatattgcttcttttgtaatttgtttgtttgcatctgttgtggtcagaagcactttctattgttgaaatatattgagtatttttatggcccagaatatggcctatcatggtaaaagttctttaggaacttggaaaaaaatgtattctgtggttattggttagagtcttatataatgtcaactatgttaagttggttgatagtattgtttaaatcttcaataccttacctattttctgttttcttgttctatcagttagtaagagaaggttattgaaatctccaacactaattgtagatttatctttctccttgcagttctataatttttccttcatacattctgaagctctattattagatatataaatgtttaggattgtattgtcctcttggtgaatttgtactgtcattctgaaatgacttttctttatattcttgataatattctctgctctgaagtccacttttctgatattaatattgtcagtccagctctcttttgtttagtattagcatgatgcgtgtttctccatccttttatttttaactgatttgtgtctttgtagagaaagcgcatttcttatagttagcatatggtagtatcttcctgctttttattgaatctgacaatctacgttctaattgcaatgttaaaaatcatttatgtttttgtaattaatgatattttgaggtttgctgtatgttttctttctgttctatcctttttattcatttttcctccttctctgttgtcttttgaattatatttaaaaatttttgtttatttcctttgtgggcttatttgctgtaactttttgttatgttaatggtttttttaggggttagagtatgatatttagcttatcacagtctatcttcaagggctattatgccatttcgtgtgtcatgtgagaaccttagaacagtatacttattttttttcctttttagccttggtgtgttgtcatacattttactttttatgtatctgttatgtgtaccataacaagttgttatttatgctttaaacagttatttgttcttaagaacatttagataatcagaataatgtcttttatgtgttcaatcccttagttactatctccagtgccctttattttttgtgtagattcatatttacatgtgcatcactttctttctgcctaaaagagagattttaacataattttactactggtctgctgattgaatgcttttagcttttctatgtctgaaaaagtctttttttaaattttttttttttaaacaggatcttgctctgtcaccgaggctggagtgcagtggcgccatcacagctcactgcagctttgacctcctgcactccagtgatcctcccacctctcagcctcccaagtaactgggaccacaggcatgtgtcatcccacccagccaacttaaacattttttt

SEQ ID NO: 50677 - DNA, 1035 bp, Homo sapiens
caagccaccacctgttctgtggagcttaaaaagtttctgtctcctctacctagcaggtgaaagaattgtatttatcattatgggacgataatattgtttttttaagaacccacagctagctgggtgccatggtttatgcctgtaatcccagtactttgggaggccgaggtgggtggatcgcttgagctcaggagtgcaagaccagcctgggcaacatggcgaaaccccgtctctaccaaaaatacaaaaaattagccgggcatggtggtgtgcacctgtggtcctagccacttgggaggctgaggtgggaagatcgcttgagcctgagaggcagaggttgcagtgagccaagatcatgccactgcactccagcctgggtgacagatctcaaaaaaaaaaaaaaaaaaccgacaggcctatccatttttctcgtggtattaggaatagcatttgagtgcataattatagatttttacattgtcatatacgatatttctgtatttccattttcttattagcatattagtttttcatctatccatgtgacttaaattattctttctagcctaggtacaacattgactgaatagttaatctttcattggttttatttttgtgatagttttgtaatcagtacaaaatagcatctagcactgtgccttatacatagtaaatacataatatttttgattgactgcttgaaaattaaatcaatacatttaaaactagtaggagaaattagttaaaaaattatatgttctccctaaaaaaaacttctgctgttcttcaagatgtatgcaaaagtaatttctttttctaattctcttctttatcatcctttttagatgttagtacatactaatataagaactttttagattaaatattaatatacagtgacattgttgtgataagtatgtctaattttttcagacattaaaatatttataatatgatcataaagtaaagagcacttttttttttgagacagagtcttgctctgttgcccagtctagagtgcagtggtacagtctt

SEQ ID NO: 50678 - DNA, 1037 bp, Homo sapiens
cttgcctaaaatatttaaagatttgtcattgcatatatataaattttatattgctttgaatggcaatatagtaagtactattgttaacagcacaagtttgtgaattcccaaataggactttttcttgaatatttttattttgtaagtagaattaagtatctaaacattagattcagtttttaaagattattttgtttaatattatgaacagtattagaccaaacaaggctccaaaaattggaattaaggcattctaatctctattaatctgctttatatttattttaacatgaatttacttttagtaatggcatttactgttttagtcatttattttacaaatatcagttgaatgcctactggtagattcagttatgttttgttgaatgtcatatatgttggtcttggcctcttggtgctcacaatgtagtggagcaggagtcagtgaataaacaaagcaaggaaatacacacacatataaaatttcaaattgtattctgtgctatgaaggaatgtatttcaagagtgtcgtcagggaatgaataaaagccagctctgtgaagagcaaagtaagagcatcttaggcagaaagaatgacattgccatggccttaagttaggaaggaactttgtgtgttcaaacaactgaaaggagaccagcgtggttggagcagagtagctgaagggaaacgtggtacatgttgattttagagaggtagtcagagttcaagtcatgtgggtgctttgtaggatgtggtaagaagtttgaattttacttaaagtacagtgggaagtcattggacagttttaagtgggggaataacatgatttgactcatttttttaaaaaaaactattttggcttataggagaatagattggaagtaagcaaaaatagaagcacagggaccagttggattgttgtagtattgccaagagatcagggggtctagaataaagtaattgcaatacagatgaaaagaaatgggcagaattaagatatattttggagatattctctagcaggaccatccagtaa

SEQ ID NO: 50679 - DNA, 1035 bp, Homo sapiens
agtgatccacttgcttcggcctcccaaagtgctggcattacaggtgtcagccactgtgcatggactaaagtcctaaaatattcttatgtatgactttattatgtccggggaggtcaaaagttttcttgaggaacttacctacaatttcataatgagaaattaatattaacagaatgtaatgagcagaaatttcaggaataccttttattcattaaggaatacctgcatgtccaattataatacaaggaaacttccttgaatttcaccttatgttttagaaccatataattttgaagttataaaagatcttagaagtgatcagatacaaccactttctaatgtaggaatccctgatacatctactgtatattttcaatggtggacaactctgtgtgtgtgtgtgtgtgcgtgtgcgtgcgtgtgcatgcgtgactgtcctaattcttctttgcaaaactctatttgttattaatctttcttattttgaaccaaaatacatgcttctatcatttttttccattgggcctgggactaccatgtgaagaaatatagataatgacaacttctctccccttcagatatttgtaatctgttgtgtgtttacactccattttaccaaactctttttttttttttttttttttttgagacgaagttcactctgtcgcccagggtggagtgcagtggtgcgatcttggctcactgcaacctccaccctctgagttcaagcaattctcctgcctcagcctcccgagtagctgggattacaggcacctgccaccgcgcccggctaattttttgtatttttagtagagatggggcttcaccatcttggccaggctgatcttgaactcctgacctcgtgatccacctgcctcggtctcccaaagtgctgggattacaggcgtcagccaccgcgcccagcgtaccaaactcttaagatgtgtttttctatagcttaaacatccttattacctttattcctttttatgactttttacttttagctaattcgatttagaaaatgttcctttt

SEQ ID NO: 50680 - DNA, 1033 bp, Homo sapiens
ctggagactttccctagcatggaagtattgaatataccagaattatatcaaggagcaaagttctgacattattgagctcggaggaatcattctgggtttttgagaactgatggtgtgtggagtagtatcataggtctgcctgcatagggtttgctatgctatggatctctgctgtagttgggcaaatcacttaaccagttttaactttcattttctgatttgtataatggagataataactacttaatcttgtatcattaacatgaggattaaatgagacagtgcatataagaaatttaacactgtgcctgatacaaagtgagcactcagcaagtacttattaagttattacttagtgatagaatattatttacttacaaagtgatttcttcgtttttaatatgtcacattacatacatattctcgtaatgaaactttctcattcttttcagccgaaatcttttatcaacattgccaaaatacctatttgatcttccccttaaagttttggtcgtcagtaataataaactggtatccattccagaagaaattgggaagttaaaagatttaatggaattggtgagtaacttagttgtattaattaatgcaatatgcgtaatatatctacattttggaagattacctatttttaatggaatttaattgtaatttttaaaaaaagtactaacttggtatatgtctaaattcagtaagatttagtaaaatcttgagatactatatgtctgagtttttccagtcacaaaatagcatggttcttccttagtccttgtgacgtcagaaggcttgcttacaaactttaagaaatacttttcaaatgaataagcatttgtttactcattttgtggacagtaaaggtcttagaggaaagctaagggaatttttaaaataaaacttttataggactatgatatatccttaaacaaaggagataaaagaagagagtgtctgcaaacagaattagcaacataactcttcctcactgtttgcttatgtgacgttatgacacttttta

SEQ ID NO: 50681 - DNA, 1022 bp, Homo sapiens
tggtaatctatattattaaacagcacttaaacttaagtttaacaatttgtgcaaaaaactctctctacccgtttatacactgaataagataagactaagactataattagtatagtataatagtataatttctgaaagtcattttgtatatttggcagaaatggtagccagtgggccaggaatttcaatgggccgcagatagaccaatctgtggctctgtgggtgcagcttgggagacagcagatttccattccatctgactcctctccttcttctctagcttccttgacctctgaagctcaagagtgatacagaacataatttagattgggttacttaagattattgaccaagatctctaatagactgccagcagttttacaaggaatgtcttgaaggaaggcaggaaacaggacacagcaatctgtctactgttgatttactgccaatactggattttatgattaaaaatgagacaagaaaaacagcttagtggttataaaggtgcttatccctttggatgctaattaactgagatatcgatactgcacaagaaaaaaatacacagctatgtaattaaaaaatatttacaatcattctcttattaattccaataaactatcattatggtatatattagtttcttgtgcctgccataacaaattatcacaaacttaatagtttaaaaaaaagaaaattagtctctcacaggtttggagactgaaagttagaaacaaatttaattgagctaaaatcaaggttttggcagggccgcactccctatggggaggctctaggggagaatccattccttgcttcttccagcttctgatggctactggcattgtgtggcacaattattccagtggctgcctccttctccacatggccccctcttcagtctgtctggtttaccctctgctttcctcttataaggatacctgtgatggcatttagggtccacatggatgatgcaggctaatctcatcacaagactcttaattacatctgtaaaaccttta

SEQ ID NO: 50682 - DNA, 1030 bp, Homo sapiens
atcatggcagaaggtgaaaggcacttgtcacatggtggcagacaagagaagagagcttgtgcagggaacctcccctttttaaaaccagcagatctaatgagacttactcactatcatgagaacagcacgggaaatacctgcccctatgattcaattatttcccaccagttccctcccacaacacatgggaattcaagatgagatttgagtgagaacacggccaaaccatataattctgcccttgactcctcccaaatctcatgtcctcacatttcaaaaccaatcataccttcccaacagtcacacaaagtcttaactcatttcagcattaactcaaaagtccacagtccaaagtctcacctgagacaaggcaagaccctttcggctatgagcctgtaaaatgaaaagcaagttagttacttcctagatacaatggggatacaggcatcgggtaaatacagccattccaaatgggagaatttggccaaaactaaggggttacaggccttgtgcaagtttgaaatccagtgggggagtcaaatcttaaagctccagaatgatctcctttgactccatgtctcacatccaggtcacgctgatgcaagaggtaggttcctatggtcttgagcagctccgcctttgtggcttagcagggtacagcctccctcctggctgctttcataagctggcactgagtgtctgtggcctttccaggtgcatggtgcaagctgtcggtggatctaccattgtggggtctggaggatggtggccctcttctcacatctccactaggccgtgccccagtggggactttgtgtggggcctctgaccccacatttcctttctgcactgccctagcacaggttgtccatgaggtccctgcccctgcagcaaagttctgcctggacatacaggcatttccatacattctctaaaatctagccagaggttcccaaacctcaattcttgacttctgtgcacctgcaggctcagcaccacatggaagctgccaaggcttggggcttgcacc

SEQ ID NO: 50683 - DNA, 1068 bp, Homo sapiens
gcagacaggccttgctaggtttccccactcagtctgtcagctttagaatatattctttttggccaatcatatttctgcacagctgggctgtccatactttgttgaacctaagcataaaataggcaattcctcctttgggtcttaattctgaaggctcccatatatatactttaagtaaacttgtatgccttttctgcttttaatcaatctgcctcatttcagtgatttttcagtgaaattgtgaaactttagggaccaagggccttggcttctgtatctacttcttttctccctttcttttttctttttttttttttttgacagagtctcgctgtattgccaaggctggagtacagtggcacaatcacggctcactgcagcctcaacctcccaggctcaagtgatcctcctacctcagcctcccgagtagctgggaccacaggggtgtgctaccatgcacagctaatttttgtatttttttgtagagacagggtttcatcatgttgcccaggctggtcttgaacttctggactcaggtgacccacctgccttggcctcccaaagtgctgggattacaggggtgagccactgcacctggcctacttcttttctttttaacattttattgagagttcacagaccaaaagtggaccaatttaaagtatattgttgattggttgttagctgtgcacccatcactataatttagttttggaatattttcatctccccctgaaagaaatcctgtacaaataaatccctttccattctccctgcctcctccccaaccaatcaaaccctaggcaaccattcatctattttctgtctctatagatttaccccatctgtacattttatgtaaatgacttaattcaggatgtgaccttttatgattggcttctttaacttactatgttttcaaagttcatttatgttgtagcatgtaccagtattatgagaattccaattttttttgcattctcagcagcagttgtttttatctttttgtttatagccatcctagtgggtatgaggcagtatttctttccttcttcttcttcttttttt

SEQ ID NO: 50684 - DNA, 1046 bp, Homo sapiens
ggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcaggtgacaggacggggggaggggaagctggctgtgaaggaggaggtgcggggagtgggtggctgcgtggctgcgttgttggactctgcgggtctgggcgggtgcgcggggaccgccagactaacaaagtcggggcagcccgttctcctgaacgtgaggggcgaatcaagcaataggggaggggaggaatgctgcctgaaggatgtatagaaactggtaggatgttaggggtgaaagagcatcattgttaaagcaagtttccccagtttgggtgggagggagtcattgacaccttccttaatgcacttctttcaactctcctggatcttcccgtctttcccggaaaaccaaacccaaccaaactaaacgaaacacaaaaatcataatctctacatattccttaaaggcatacgtgcctgaaagaatggcatatcctttttcagagtacagcagcaggattgccatggtttttctgtgtggtttaatcatcctacgatattcttggcttctttcttgtcacgtatgcctttaaagactgagatttttcattttcctggtgttgagaaggtagtggtggttaaattagtatttgctgcagtggtaaattaaatcatcaatcacttacatgtctgcttactagaagaaagctaatccttgttttgagttatcttagagtcttaatttttatagtagaaagccaacaattttaagggtatttttgagaaaaaattatctccattctttatggagttgt

SEQ ID NO: 50685 - DNA, 1065 bp, Homo sapiens
tcagcagtctgacctaccttaaaggcttaggaaagggaatgatacctgattgagggatagcaggaattagcaggggtcacatcaggagaaaagactgggataattatgcctttgctctcctccatttgtctcaagtttcgttaggtagaatgaagtggctgtgaagcacgccttgcttgttattttttttaccaccacactctctgctgcagtaactgcctgggcctagcacccgacataatcttcttcgccatattggacactatgatccaatcaacatagctagggaatttcttatttttaaatttatagtgatgaaggatgatgccgttttgtatccctgtccacttgccgaaggagatgttcaaactcccaggggatcgattaggcatacaagtcatatcaaaaaggatattcctcgccatttacagactccttagcccgcacgactttctttgggatatcaaccacatggtttctgctccctctcacactctatcgctccctctcttgccacattcggacccaacactctctcgcccacttctactttgcgcgattcctgtcttattctgtctcaacgtcatagggtttcctagactatccaggaattcctgccgacgtaggcaggtaccagaggcaactgaacgcgtgagacatagagcagatgagctgagaggcagcaagagaactacgcaagaatccgatcacaccctccgcttctacgacgaccaccaacaccacccagaagccaacttccgagatgccccaagccaagatcaggcaacactcagctgaatgtcatcccgtacctcttcgtcacagcggaccgcggtcacgcttaaatgtgcattgaagtggaaggtgaatgtctctttgcatggcagtgtctctgcacacgggagaggaggggcacacgtatccacctggctcaatatctagctgtattcaggtggaatagagaaccatgaaccctctggaccttttctgctttggtcctgtgcttttaacgtctcaggcctaagaggcccaccgaatccttctgccttgcttcagtacatttaa

SEQ ID NO: 50686 - DNA, 1049 bp, Homo sapiens
acaccagaaaatggatagtctatgtttatgaattggaagagtcaatattgtgtaaaattccatactacccaaagcaatctacagattcagtgcaatccctatcaaaataccaatgttatttttcaatgaaatagataaaacaatcttaaaatttctatgtaaccacaaaagacccagaatagccaaagctatcctaggcaaaaagaacaaacctggagaattcatattacctgacttcaaattatactacagagctatactaaccaaaccagcttaatgctggtataaaaacagacacagaccaatggaacagaatagagaatctagaaacattcacactcctatagtgaactcattttcaatagaagtgccaagaacatacgctgaggaaaagacagtctcttctttgataaatggtgctgtaaaaactggatatccatatgcacaagaatgaaactagatccctatctctcattgtatacaaaaatcaaaatggattaaaaacgtaaagatctcaaactatgaaactactaccagaagtcattggggaaaatctccaggacattgttctcagcaaaaatttcttaagtaattctccacaacgacaggcaaccaaagcacaaatggacaaatgggatctcatcaagttaaaaagcttctgcacagccaaggaaacaaacaaaaaattgaagagagaacccacagaatgagagaaaatatttacaagctacccatttgacaaaggattaataaccagaatatatgaaaagctccaacaactctataggaaaaaaatccaataacctgaccaaaaaatgggcaaaatatctgaataaacatttcttcgaagaagacatgcaaatgaaaaacatgaaaaggtgttcaacatcattgatcattagagaaatgcaaatcaaaactttagtgagttatctcaccccagttaaaatggcttatattcaaaagacaggtaataacaagtgctggtgtagatctggagaaaatggaaccatgtatactgttggtgagaaattaatacaaccactatg

SEQ ID NO: 50687 - DNA, 1023 bp, Homo sapiens
atgtcaagggaaaccaaacaagagcaaaagttgctgcactgatatcagacaaaatatatttctagacaaaaactgtaacaagagacaaggtcgctatataatgataaaagggtcaatttagcaagaatatataacaattttaagtatatgtgcagtcaaccctggagcacccagatatatgaagcaaatattattagaggtaaagaaagagatagaccctaatacaataatagctggagacttcaccccactttcagcattaggcaaatcttttagacagatattaacaaaaaaactcaatctgcactatagaccaaatggatctaatagatatttacaaaacttttcacccaatggctatggaatataaactcttcagcacatagatcgttctcaaggatagaccatatgttaggtcataaatcaagttttaaaatattcaaaaaatggaaataatatcaaacatctactctgaccacaatgggataaaactagaaatcaataacaaggaattctgaaaaccatacaaatacattaaaattaaacaatatgcttctgaagaatcagtgggtcaatgaagaaaccgaaaaaaagttgaagaattccttgaaacagatgataatgaagacaccatctaccaaaacctatgaaatacagcaaaagcagtattatgaaagaagtttgtagctaaaaaaaaaaaaatctaacagtgtgcttgaactagaaaagcaagagtaaaccaaaaccaaaatcagtaaataaaggaaatactaaagatgacagcagaaataaatttgaaatgaagaaaacaatgcaaaagattaatgaaataaaaagtttgcagtttgagaagttaaacaaaattgacctttagctggactaagaaaaagagaagatccaaataaataaaatcagagatgaaaagggagacattatgactactacagacattaaaaggattactagtggctactatgagtaactatacgccaataaattggaaaatctagaagaaatggacaa

SEQ ID NO: 50688 - DNA, 1049 bp, Homo sapiens
ttggagttgttgcttctcttctgtcctcatggagccagggcaatcttacccaaggcagtccagcagcctcttgtagcttaagatgtcagcagcaggccctagagggaatggcaggctattgcggggcctgcaggaattgacaggtgctatatcaggtgagaagactttttcaaagtgaaaataaaaatctagagatgaatatctaaatttaacattttattacaggaggaaaaattgcagtttggtgcatacatacagattcggtggcctttagtatttctgaagaagaaagaggaggttgcaggttttataaaaggagaaatgtcacatacagtttttctagaaagttcattggtactagtaacgtattgtggagctagcagtctctgatgggtgagtgatagtcttgggtaaaagtggtcttagagttttgagcaggttgtttcagtagctgttagataaaagtgttttcaggatataacaggcagttttatcatccaggctggtagagaattacattcttagagcaatgtaataatgccctgagtgcttcttccccctgaactcttgactgttttagttttatattgtaagaatgacccaatgtgtgtgatcaactttcacacgcccctctttgatcaagatccttctatgaatgcatgactgatcaaccattgtgaagttaggcttaattgtctctcggtgctgggatggagctgtcctgttgtcttcctcattgagggtaagtcataggggtgtatatcagtgacctgggtcatattggagtaacaaggaggccagaaggaaaaattttctcatggtaggttcatctggagtccagcatcaagtttcatcttacagttccatagtcatcagcagtcaccttgaaacaatgggctaattttatccccttcagagagctggctttacaaagattagacaggtaataagagcaacacttaaaaatcataatacaaaaataaaaaacaatataataaaattagtttgcacaatggttttgctctaagagcacaaacttaagggcaaca

SEQ ID NO: 50689 - DNA, 1028 bp, Homo sapiens
tatgccctatgtaaatgaaaaggatgaagtaacattacagagttatttactcggcttatgccctgtgtaaatagaaaggatattacctgtcatagctgaagtgtttccatttcatttagttctaggaagtcagcatgaaatggccttatgtttcctgcctccagaccctgttctcctaccacatttccccccgagaggtgtgatctcataaatctttatggcaggtggagggactgatggtctttctcctctaactgctttctgctggcttagggggtagtccctacctgtcgggaattatggaactctcaccctgctctgtctagtggaggcagggtagctccttagtggccaggggtgatgtcttcacctggaactgcctggaacctttgttgcatgattatctgaagcttgatggtctctatgtgagaagaaatgaatttggttaaaagatttaatgggaacttcagggggtgtctacatatgctgtcaggaatgtttgttctagagatttgccggagaaaaacaaaacctggtctgttctaggacctgtgtttccttaaagttttaacacaagcgactccagtttggtttggtttggtcttttgaggcctagtgcataagctcaatccaaaacaatggcctcccacaattttgttttttaaaaaattccctttttggtcagtttctcacttagatgagagtatgaccaaaacttagggccttagcgacgctctcagttaccatcattttgggtttctggtctcagcctgtcattcatcagtggccttatagtcacacatttctttcagctcttgtcattccagttgaagagaaaccatttgacattctagagatggctgcatgcaagcatttaaaacctctgagagggccgggcacggtggcttacgcctgtaatcccagcactttgaggctgaggtgggcggatcacgaggtcaggagatcgagaccatcctggctaacatggtgaaaccccgtctctactgaaaatacaaaaaaaactagcc

SEQ ID NO: 50690 - DNA, 1045 bp, Homo sapiens
ctgcaggtaaagtcggaaacctctcctgcaaactgaccttcggcttctccagtcggggtgtgctcaggagaagggggaagggggtctccctttcccacttctacagttggggcactcatagtatttggggtgtctcctgggtcctgcaggtgcagtctgtttcctttagagggtctgtgaatcctctcaggattgctggtttgttcttgcagttgatctggagctaaaattcacaatgcaagacgctgcatgctgctctgtccggagctataatctagtcctgccttctgtctgtcatgatgctgtctctctcctgatttcaattttttaaaaaaaattctgtcttaatttcatcaatgacccaaagatctctttttaggagattgtaagctctttttaggagtgctctaagaaaggaagtttaaatattatcaagtatgtgttagctagaaaaaaaaactacatttttttctcaactgtgagaattctgtggtaaacatgataagtagggctgggccatcccagggacactgctagaagacattctagattttggtaagtcctttagtgcagaggtttgaatagagttttcaagtgccaagtattctgagatcttatatctaactgacctaaaagtaggaccatcgtagcctgaagacaagaggacagcattgtgagaagagctgggtcctcaggccctgttgtcttgggatggcagttttgcatcatacttcatgccagtcctgatgcctcagggctgcctctctttgtgtctagctgcctgagacctcaaggttaaattatattatagtaaaaatgcccaagacagaatgttcccactggtccaaagtagatttgacttcaactctgtgcccagactaaagacatttcctatagtcttgaccagatccagtgttaaagatagaaccatgggtagatatgtttggatccattcctagagttacatggtggggacaaatttatttttctctgagaggaagctaaagaccattctaccagaaagatgccctgcacactggaggac

SEQ ID NO: 50691 - DNA, 1059 bp, Homo sapiens
aatttcatttagttctgctctgatcttggttatttcctttcttctgctgagtttgggtttggtttgtcattatttctcgagttccttgaagtgtgaccttagattgtctatttgtgctctttcagacttttggatgtaggtgtttatagctatgaactttccttttagcaccacctttgctgtattccagaggttttgatagattgtgtcattattgtcatttaattcaaagaatttttaaatttccatctttatttcatttttgacccaatgctcattcaggagcaggttatttaatttccatgtaattgcatggctttgaaggtttattttggagttgatttccagttttattccactatggtctgagagtgcttggtataatttcaattttttttaagtttattgaggcttgttttgaagcctatcttatggcctatctgaggagaaagttccatgtgctgttgaataaaatgtgtattctgtggttgttggagaaaatgttctgtatgtagctcttaagtccatttgtttcaaggtatagtttaaatccattgtttctttgttgactttctgtcttgatgacctgtctagtgctgtcagtgaagtattgaagtcccccactattattgtgttgctgtctatctcatttcttaggtctattagtaattgttttataaatttgggagctccagtgttaggtgtatatatgtttaggattgtgatattttcctgttgcacaaggccttttaccattatatgctgtccctctttgtctcttttaaccgctgttgcttgaaagtttgttttgcctgttataaggatagctacccctgctcacttttggtgtccatttgcatgaaatgcctttttccaccactttaagttaatgtgagtccttatatgttaggtgagtctccagaaggcagcagatggttggtgagttcttatccgttttgtgattctgtatcttttaagtggagcatttaggccatttgcattcaatgttagtattgaaatgtgaggtaccattactttcattgtgctttttgttgtctg

SEQ ID NO: 50692 - DNA, 1030 bp, Homo sapiens
tgtagtttgtaagtaaatttggattttcgtttgttctgttgtcattaaacaaacatttattgtgaataatttgctggactgtgcaattagttaaggagggtgaggccaggaagccttgacttcaagagtgtaggatttggcttctgttcggcaagcagtgactcactgaatacctttgagcaagggagtgcttttctgagctataaatacaatcacagtatgtataaagaccattatgtatgtgaaaattataattaaatccaggtaagaggtaatacagacaagaactgtggtagaggcagtgagagtggatgggggttgaaggataggagcattctagagagagattcagttgaacttagcagttgattggacatgggaaatggggaagaagcaagggtcaaaggtggtcaaataattttggtgagagcaattgccttttagaatccaaatattttatctatagttcttttgaatgtataatatcaggatacatcggagatttctgaaatttcttctgactgaccaacattttaggaatggtcattaagaaatatgtatgtagtcaaattcattaccattaagcatatctttgacatatgaaaagattggattttgaagatgtaaaaatgatgattgcttcaacaagtatctcatggagatggagtgagtgagggtagtagcattttccgactagctagggaaacttttaacaccttgactccctgctactctcatctacatggtgactcttctccccttttgtctgcttctcatctacactgagagtcagaaattatagtttggggtgtgaaacactggtttaaaggactgtataaaaggaaggaaaggaatacttctcttttttcatttatctcacacagattaaggtaagtacttcattactacttcataattcatagattgcttctgcaaaacacatgtacacacaatctgaaaacgctccagttatcttcaatttaaaattcccatttaaatgaccaggagatttgaatgcttgatgcctact

SEQ ID NO: 50693 - DNA, 1061 bp, Homo sapiens
ggtgggaattgaacaatgagaacacttggacacaggaaggcgaacatcacactctggggactgttatggggtgggggaaggggggatggatagcattaggagatatgcctaatgttaaatgacgagttaatgggtgcagcacaccaacatggcacatgtatacatatgtaacaaagctgcacgttgtgcacatgtaccctaaaactttaataaaaaaaagaaagtgctcagttctttttcaatcaccttgtatattaagtttataacattcagcagttactcaactgtctattatgtgccaggcataactctgctgaggattaggggcatagtccttgtgatcattcaaagtgattattttttatcttccatactatcttcattcataagcaattaaatagcttaatttattctcctgctgtgaaaatttggaaccaagacaaacaggttaaataaattcttgcttactgtactttcaatattgataatggatttaagggcaatggaaacacctcagaagaaaaatttgtctggactaaatgaggagacttgaactggaggtagataacacatgttaaagtgcatattgcacaggatggaaaatgaagcaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtaatgctcatcatcactggccatcagagaaatgcaaatcaaaaccactatgagatatcatctcacaccagttagaatg

SEQ ID NO: 50694 - DNA, 1232 bp, Homo sapiens
tgaactagttatgtgaatttggataaaacacctattctaatcaaaatataatataaaatggttgttgagatttttctaccaggccctaaggaaataatctgtcaatttgtctgtttttcacaaaactaaatgaggaaatggtctggcttattttctctttgttttaaaatctatggtgccattgatacccagtttaaaaacattcttctgaaggtgctgttgattaaatcattttaatgtcccccaagtactgcctgtttttgaagattatttggaaaatgtggcacattcaccaactcacattctcctcttattctgtacttgctttttttccttataagttagtggaaaggcaactggtcagttttttcactcaataaaaaagaaggaaggtgtagacagcttttatctgggaatgctttaagtcattgagagaatatttttaagtgttaactactttttgaaattattggcagaatcttttaatccattttaacataaaacagttgactaagatggaaagatttttattgtttacataaaagaaatcaccatggtttttgcatcattgcataaatctaagagattgtgcatacataaaaaggatgagacaaagctgaatgttaagtgccaaaatcaacgaaagcttgcgtacttactgggtatttgacactgagcataatggaatgtggttccacagagagagaatactaaatatttagacccaaggacatgtttctctgatagcttcttatcctaatctcctagctaacattattaaccctttttgaaacacctctttcttacacttagatttcctcctattaaagctcacccttggagattctaaaccttctatacccaagcacctacactcacccactcatctctttctgagatcttcatgaattccttttgtttattatatggatctttgggtgaattatcttggtttactatgagtagtaaagcacaatcacaatttctctccacttacagctctatttttccaaaggtcacagctccatcattcagctcttctgtcggtatccctttctcatcgattccctggaatttttgaaccagggctgtgaggtatacagccagcaatgttgcatagtactttagagttgctgcccaacacaggtccatctctcttcacaattcatgtttgttccttttcaggctcagagtggtgaaggaagttactaagattagcgtgcactatgaag

SEQ ID NO: 50695 - DNA, 1051 bp, Homo sapiens
attatgttttattttaagagctttgtgggtgccttcaggggtacttacaaactagtaaaatagatacatcaatacatagaattattagacaagactgaatgtgctgggtgctaaaataggggaacaaatgaggaaacaggagccctgaaaattagaatttaattgtggtctgaggattcatggattatttccaaggagaatcatctgaccttgaaggaccttacctgcaatttattaaatgtttgtggcacaaatgagccttgcaatacgtactttacatatattctcatattgaatctttacattcatccttatattcttaaattattttatgtcttagactgatttcaaaatattttgcttgaagacagatttttgttcatttgttttatttttaattgaaacttacctccagttatgtgtgaaaactcagtggcagtaaaatctacaagatagaacattatgttgcttttcaggtattttctattttcatattcattcatggatacctacattttaaaagatggttgaacacttttcacctgagaactagagtaaatatatgataatctctatatttaaaaagggaaacgttttgtttaaaaattgatgactcagtctctttttttttttccataagagagtgtgtcagtaggcttctaggagatggcatactttatgaaaaaatgtagcatactatttaaattagaggtggttacgctttgaatgcaaagtatcctgtcaaatcacaggatgagtgcatctcccagtggaagatgttgcaaagtgcaagtgagtatgagtcttcccgaaagcatttgtctttatagcttggattctatgagatgcccaccaaagacacttaattttttatcttagaaagtcaagatggatgagtcttcagatttattaggaacccttctttagttttgaatattttgtgatgaatccatactttatctttttgcagatgagatggaaatgtcctgtttctttggcaaataatatgtgagcatagcacatgtagctttttttttttttttaaataggc

SEQ ID NO: 50696 - DNA, 1065 bp, Homo sapiens
agcaaccatctatagacctaccctcaggaatgcatttcttccccagggtcccaattattaatattccttgctgggaaaagaattcagtgatatttctcctactcacacttccatctataggctctctgcaagaagaaaaatatggctctgttctgcccaaccctgtaggcagtcaggcctcatggttatcttcccttgttccctgaaaatcactgttattctgttctttcttagggtgcactgatttaatattgttcaaacacacatattttacaatcaatttgtacaatagtggtcctcaggtgacatacattctccgcttacgaagataacaggattaagagattaaagtaaagacaggcataagaaattataagagtattgattgaggaagtcacaaatgtccatgaaatcttcacaatttatgttcagagattgcagtaaagacaggtgtaagaaattataaaagtattaattttgggaattgataaatgtccatgaaatcttcacaatttatgttctgcctcggctccagccggtctctccgttcggggtctctgacttcctgcaacatgggggtattagttgtagtagtgccttccatatctgttataatttatcttttttccttctatttattgatttttgctctatactgtgtcaaatcctctctttactccctttaatgtacattttgtttgtcacattggtttagtttcctttagtttcctcgaccaacgtaatttatatctttcctcatcttatcttacttggctttctcttcctggctcattgaagtcatgtttccttattcaataaatagtgtttttcaatatatttccattgctgctttccatgctagttgtttttgtttttgtctgttcattctcaaaggaagaaagattccctgaaaggcctttgtactgttgtttaaaatgttttttgttcatggtctttatgtggctgactcttgttgtctagatctttacttaaatatcctctcctctgagaggtttcctttgaccatccaatctaaagtggccacctgtatactgtctattgtca

SEQ ID NO: 50697 - DNA, 1033 bp, Homo sapiens
aactactttaccactgcaatgaattttatcatgtttggttctgcattgaagtaatttgagcctttatttgcttatgcctaagggagccctttcagagagtgactggctgtatctaatgtatttttatatcctgtattgtacataatgcaagattttgcacatagtaagctttcagtaaatacctgtagaagttgtaccatttattaacaattactggatggtgattttattcagtaaaatggtttagagtagttttcttttgtttcccacagttaactcttacttatagttaagtaatttaatattaagtgacagtctttaagactgtaaagtaggctaactgaatttagtatagattctaggaataagcccagacttttgtactgacgtaatgtataatcatgtcttcatggtgtagaatgtcaagggaatacagggctgggaatcaggtcattccatgtttaaaaatatttagcctttactatttgtcaagtggtgtcctcatctgtcacatgtaagaattggaagatggaaatctttcttttcattttaaaagtctaaaattatatttttaagacgaagcacatagtacatgctaaagaaacacatatgtgattaacttcatataaaacaaatttaacaaggtgatcagccattggagataagtccttttattaatttatcataatttggttttctcactttcaatgaaggtatcttttctgtgttttttgaagattaaaaacttgtgagggtctggttttatcatgggtgaagtaagcgtggcaataattgtaagccaaatctttggctagaagatctagccaataaaaataataagagggtaacacatgaaattctgagaccagttactttttatacattggaattattttggtttaaaaattctgtaggttttggttatccactattattgtcataagatcttatggtagacgcacatgaaatttatcaccatatttgttcctataactgaagagttgcatgttttcatacaaaggatatgggcttg

SEQ ID NO: 50698 - DNA, 1057 bp, Homo sapiens
aaaagcatgatgaaaagtgatgagttcttctactcattgaccttcttctgggggtgtggtgtggtcagataataaatatatatcacgaagaaaattgttatgaaaaattaataaggtaggtggaaatataaagagttaagagtgagcggaggtcagtgtagaagggcattaacttcttattagccttgcatgtgtttagtcttgtaatctaccatccatcatatattttaccctatatgaagttttattctagtgctttatgagctatagggagaagtcagccacatgtggtttgctttgatggaaacagtatacttatctgaacatcctcatgcatgcattatggtaatgtctaggaggacacgttgtggtgagagtcaccagtttgttgttgtggcggtattttctgattgcattcctggagctaatagcatttctgtaatgctctgacagagtttcagtcttccaaatgtagtctttcatagatgaaacacagtataaaatatcgtctggtatttccaacacaggagaaagagtgccaaacactgtacaatcatatttttaccattttaacaaatattattcaccacttactgggtagggtgctagggatatagcagtgaatgttaatacatggttttctgtgtagtgggaaatacacacaaataattgtgtttcttaagtgctgttgaaaggacatatggggtgctactgactgtgtataacacatatatacaccgggtcttgggagggtcaggacaggctttatgagtgaagtcatgtttcttctacttctctccatttccactctactaccaccatcttagttcaagctactctcatcttttgcctgacgtcctgcaataaccaattggttagttcatttttctctaggttctaattagagttctcttttcagaattcaaatctagccatgttgccttttcgctttcaaattattctatagctgtatcttaattttaggataacatccaatgttaatctcacattgcactactatgcatgaaggcatgaaaaagcatgatgcattcacaga

SEQ ID NO: 50699 - DNA, 1060 bp, Homo sapiens
ttggttccaagtctttgctattgtgaatagtgccgcaataaacatacgtgtgcatgtgtctttatagcagcatgatttatagtcctttgggtatatacccagtaatgggatggctgggtcgaatggtatttctagttctagatccctgaggaatcgccacactgacttccacaatggttgaactagtttacagtcccaccaacagtgtaaaagtgttcctatttctccacatcctctccagcacctgtggtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttttaggtttcctgttcactctgatggtagtttcttttgctgtgcagaagttctttagttgaattagatcccatttgtcaattttggcttttgttgccattgcttttggtgttttagacatgaagtccttgcccatgcctatgtcctgaatggtaatgcctatgttttcttctagggtttttatggttttgggtctaacatttaagtctttaatccattttgaattgatttttgtataaggtataaggaagggatccagtttcagctttctacatatggctagccagttttcccagcatcatttattaaatagggaatcctttccccatttcttgtttttctccggttagtcaaagatcagatagttgtagatatgcggcgttgtttctgagggctctgttctgttcattgatctatatctctgttttggtaccagcaccatgctgttttggtgactgtagccttgtagtatagtttgaagtcaggtagcatgatgcctccagctttgttcttttggcttgggattgccttgg

SEQ ID NO: 50700 - DNA, 1023 bp, Homo sapiens
tatctcttcctaggcctggtctaaatgctccctccatggtcgttggctgagtttttccccttgttgctctctactctgacagggtagcactgagttccaatggaaagtccccattactgcaatctctctcctctagtgcacagattctccctctgcacaatgtggccactgccaggggatggaggggtggtgatgtaggcgattaagggctgtatatcctacaatcttcagggcctttttccttaatttgatgttaaaacaaggtattgtgatcattcacctgatttttggttgttatgaaagttcttttttgtgtaaatagttgttcaatttcgtcttcctacaggagagatgatcacttgaggcttctattcagccatcttgctctgattgccttcacttgagtaacatttcccaatctcatcacttcacttgttacttaattggctaaatattcctacattgacacttctagttccaatctaaatctagatgtaatcttttcaattttctgttagacactgtttggtgtgtcctatggtacataaatgtgtgtacatcaaacaattgttctccttttttcaatatttttccttattctctacatgctacctcacttgatatcttcatcctcatcccagttatttaaacagattttgtgattttgtttgtgatctccttatccctgtaatacctattcatgatcttttagtcaatcagtcctagttcactctggctatcctcatagacattgtctgggctcttatctcagttcttgactgtagaagaactttcttaactgatctctagatatctagtctatctctcttccatccccatattggagctgtgctaattttcttttcttttttttaattactattatactttaagtttcagggtacatgtgcacaatgtgcaggttagttacatatgtatacatgtgccatgctggtgcactgcacccactaactcgtcatctagcattaggtgtatctcccaatgctatccctccccccttcc

SEQ ID NO: 50701 - DNA, 1088 bp, Homo sapiens
agttttaatttttttctatgatcagattgaatagtctgttatgatttctgatatttgggtgctgcttgccttcttcactgcatgattataaataatttcacttaggttttcttttggtactctttcagcttcattttgttacctttaaattttgatccttctggaatgtatttcagggcaacaagtgaaatagtggataacctctgctttttaaaaaaaataaacacaaccaaatggctacccagttgtcctgaaatcacttattcaatcatccccccttctcttacttgtttgaaaggccatctttaccccagagtaactccctgctgtatttgcattcctcacaagatcttgaaataatttatttatttttgttttgtttttcaagccactgcagtaaagttctccccactgatattgaaactgctcttggtaaaggtcaccactcatattataattgttaaatcaagtagatgtatcttacttggtcttgaatttgttgaatgctgttgaactactcttcctttttagcttttatctcacaattctcatagtttccctcctaccgttctctctgttttccttactaatttgtcttcttccatttctttgggattccaccttctcatggggaatatattctttttctgctttttatttatttataatttttgtgggcacatagtaggtgtatatatttatgggatacatgagctgtttagatacagacatgtaattggaaataagcacatcatggagaatggggtgtccatcccctcaagcatttatcctttgagttacaagcaatctaattatactctttaagttattttaaaatgtacaactaagttgttattaactatagttgctcctgttgtgctatcaaataatagatcttatttattctatctaactgtagttttgtactcattaaccatccccacttctccctacccagctacccttcccagcctctggtagccatcattctaccatctgtctccatgagttcaatcattttaatttttagctcccacaaataagtgagaacatgtgaagtttatctttctgtgcctggcttatttcac

SEQ ID NO: 50702 - DNA, 1026 bp, Homo sapiens
atacctatagccaacatgaagtacaatgatagtgaccacatggtggtgacatgggcagattgcttcagtgactatagaagggaagctgaaattgttgagaagagtgtgtcagccactctggcacttggccaggaaaagggagaaacctaagaaacatgggaatccagtctttttggtaggagtttagacctaaaagtagctgtgaacatacctctctggaccccctagttgtagcataagatgctggtcaaggggaaaccaggcaggctgatcatgtacttaaaatgagcgttctgaaataggctttagctgcaacctttagtatagtgcaactgttattttgttagggtgcgtgtgtgggagcataccagatagacctatcaatttttagatttactgtagtgaagaatcaccactcaatgcaacagttagtgctcaggtattttaggataagacctctttagtgccacaggtgggagaggagaataagctaaatgattctatgatctaacactctgggacatttaaaaaaatcaacttttgtctaacaaactattttttaaagaacacaattctgttaaacttcagattttgcattttcaagatgattttgaatttttgtaatgctgctatatataatttaatttagaggagtgcaattatgtgcagtttttctagattttgcggttttttgattttgtcgtgtttagcatttttcactaatcctttctgtcagttttcttttcttaccacagtacttatcaaaattttatttgaagacagagtactagagaaactcctaaaatttcttttatatagcatcagtttaattcataagtgagacttaccttatgtagtgtgaaattggctaaggatatctcaaatctgattattttaaagctattagtttttggacagagtaggaaagagtgatacagtgggttttaattaaacgctaggtcataaactggaatctttatttgaaatattatctaagataggtgcttgagaaatattagatttgtg

SEQ ID NO: 50703 - DNA, 1031 bp, Homo sapiens
gtgttggccaggctggtctcaaactcctgggctcaagtaatcctcctgcctcagcctcctgagttgctgggatttcagatatgagccactatgcctagcatattcatctttattactgaattttttttgcaaccccttaaatttctgtggttgaggtgagaccctcacttactttacatcagttttggccctgtggttatagaagatttgggggaaattgtaaaaagtcctaaagattctgaattcagattgttttgcaagtgtctttatattctatatctgttttaaagaaaccaaatctgtaactgacagttcatgcattcatcatggtagtgaggttaattttaagatgccatgccaagatttaattaacaggcatttgtgcaaatcaacagccttagttctatatcaaatgataaagtaaaccatatcctactttaacttttttgatctattgttgaactgtgggtctgaatgtgttccataagatggtttctactgtggctatgaagattgtagaaaagatagagctacctacacttctctttatgtcttctgtcattttcttaaatttgctaaaaatatttgttatagatccagaaaaactgttacctttattcagacctgcatgctgtactcccttgaatcccttgcacagtaaaagtagagtgacctaatttagtaacatggtgatttctgctggaaagatttgtatctgaaatactgctttctaaggagttctgactggtgatttgccagttttttttttttttaccatatttgaaaatcacttactaaaaagagttaaaactctagtacattgactatatgaattttatcagaacaggttttaattgttttacatttaattgacttgtggcttttgatcgaataggatgttaaacagtatttcatctatttagagggaaatactttgtctttttaatgtaatattgaggaatatgataaactcctaaggaggcagtttataatttaatacagtactcacaatatttctaagactgattgtg

SEQ ID NO: 50704 - DNA, 1066 bp, Homo sapiens
gcacaaggattaccctcattgtgcctcaggagatattattgtaacctttgttttgcttacataacttcctttaagacacagtatacctgtcccctgggaatatgctgagataagtattcttcctctgtattgcatagtgccttagcacacataccttcattcatagcatttatatgctctgttatgtctgttttctccatgagactgaactctttgaatgtaggtactgttcctcgttcatatttatattcctaatgttctgcacagtgcctgattctttgtagatgtgctataaattacatattaccaacatttatgagtaatgctaagtgctagatgctgtctctgtctctgttttacagacggtagttaagtgctcacggtaacacagttcagtggtagagctagaattgaacaccatgatagcttatttgcagggcccatgctcttaaccattataatataatgtctcttccctgagaatggaagggtcatcatctggtatattgtaggtcagtgtagcccagagagggagtttggaacatttaattggtaggaccaagaacctgaagcacgccttacctgaaagcaagttgggggtgtgtgtgcatgtcctgatgcttggaaaagaagttatattttaatgcacatagtctgctatattatttgtactactggtattgaaggtttagataaaatttgtatctctgaaatgcactttcttcattaaaaatgaatttctatagtgatatagagtgaaatttcctagtaagcccccaaatcgcttaaaatggatgtcatcattgactgtgctcccttatacgttgatagcagggttaagatgattgatatagctttagggaatttgctatatttgtagtggaaacagcgtgagaagaaaagtgaagatgctgcttgtaacagttaaaacttcagatttcttaaatgcttaggagatgaactgttccagaattttgttttattgtatttttatttacaactgattttatctccttaatatcaatgtatttttcattttcaatactttggttaaattttttcctgc

SEQ ID NO: 50705 - DNA, 1026 bp, Homo sapiens
tacgtaacatctttccttaatcataatgcaccccctacgtccctggtcccaggccttttctcaccatgttccctcgtttttgaatatacttttatactcccacaccctccacaaggcagtaatttaaacctcatccatccttaaggaccagccccaaacgtcctcattcacccaagcagaagtaattactttttgtagattcccactgcatactgcttaactttctcttatagaattgatcacatttggcattgcctcatatagatgtttgattgcttccagttgtaaactcattaagtacctagcctagttcattggagacccaccacaccagctagcagtgtgccttgctatactgtaaggtcttagcactttcactgaagttcaggcataatcaagtgtgccacatgattccagaaagcaccaagccaagaggaaacacagaggtggatgtggaaagcaaaatacaataataaagcaaaagtatgtttctccctgtgttagtcggggttgttcagagagaaacggaaccattaggagattatctatcaaggggtgggggttgagagaaggggagagagggagagagagagagagaagaagaagagaagaggagaagagaagaaaggagagaggtgagagaaagaaagaaaagaaaagaaagagaaaaaagattttaaggaactgtggaagcctacaggctggagacccagggaagagttaatattgaagccccagccaaaggcagtcttcttgtttgggggtgggggacagaaaaggagcagtcatttttctattaaggccttcaaatgattggatgagactcatcaacattaggaaggataacctactttatgcaaagtaacctgctttactcagaaacgtctagaataatggttcaccaaataaccatgttgacacataaattaaccatgagacctttttttctctacaagatgctccacaagtctcttcttcccagtccttctcccaatgcaacgactgcagtgggagccacctccttaa

SEQ ID NO: 50706 - DNA, 1052 bp, Homo sapiens
aggtatatgatgatagatacatatatatacttggaattgtgattgctagatcatatggtagttttatttttagttttttgaggaacctccatacagttgtctatattggctacccaaggtgatccacagagtcaatgcaatcctaccaaaataccaatgatagtttttataaaaacaagagaaaaacaatcttacaatttgtatggaacaacaaatgacctagaatagccaaagctatccttagcaaaaagaacaaaactggaggaatcacattgcctgagtaaggaaaacagcacggtactggcataaaaacagacacatagaccactagaacagaatatagaacctagaaacaaatacacatatatacagccaactgattttaacagaggtgttaggaacattcagtgagggaaaggaaagtctcttcaataagtggtgctgggggaaataggatatccatatgcagaaaaatgaaaagtagacccttatctctcaccatatacaaaaaaatcaaatcaaaatggattacagaattaaatctaagacctgaaactactacaagaaaacataggggaagtgctttatgaaattctttggggaaagaaatttttggctaagcttcaaaagcatagacaacataagcaaaaatagacagatgggattacatcaaactagaaagcttctacacagctaggaaacaatcaagagtgaagtggcaacctacagaatgtgagagaatattttcaaactgtgcatctgacaaggagataatatccagaatatgtaaggaactcaactcaatagcaaaaaagaaaataatatgattaaaaaattggcaaaagagcggaagagctgtttctcaaaataagatataaaaatggctgacagatatattaaaaaaatgctcaacatcactagtcatcagagaaatgcaaatcagaaccacagtgcaatatcatctcacccctgttagaattgctattatcaaaaagacatgaaataaatgctggggatgatgtggagaaaagggaacttacatattgttggtg

SEQ ID NO: 50707 - DNA, 1027 bp, Homo sapiens
aaaagtttgattatgatgtggtttagagtcaattttcttattttatttatgtattttttaatttcaatatgtttttgaggaacaggtggtgtttgattacacgaataagttcttcagtgatgatttctgaggttctgttgcacccatcactcaagcagtgtacactgtacccagtgtgaagtcttttatcccttgccacccccatccctttctcctgagtgtccaaagtctaatgtatcattcttatgcctttgcatcctcatagcttagctcccgcatatgagtgagaatacatgatgtttggtggttttccattcctgagttacttcacttagaatattctgatatgtatataatgatgctacctttatccaggttgctgtgaatgccattatttcattccattttatgtctgagtagtattccatggtgtgtgtgtgttgtgtatctccacattttctttatcctagagtggattttcttgggtatattcaatttgggatttgcatggcttctcgattctgtaggtttcttatctctttgagtactttttcagccccaccctctttctctctccttcttatctctcatattgcaaatgttagatcgtttgttatagtccctaaagtccctaattctgtattcatatttttttcagtttattttatctttgtttttaaggttggataattagtgttcttctgttttacagttcactgatttttcctctgtcttttccattctgctgttgagcctatctgttgggtattttattacaattattgtattttttgcttttaaaagatccatttggttcttctttatatcttctatttctttactgagactttatttttttgctgaggctcttggtttcaaatgttttcataattgctcaatgaagcatttttatgatggctactttaaaatctttgtcagataattctaacatcgctgtcatcttgctgtcaacatctattgatactttttttattatactttaagttttagggtacatgtgcaccat

SEQ ID NO: 50708 - DNA, 1063 bp, Homo sapiens
aggagctgcgttcctcagttggaaatgcagaaattacccgtcttctgtgtcgctcacgttgggagctgtagactggagctgttcctattcggccatcttgtctccacccccgagagaaaaagtataatttttctgtgattccttttcctactctgttggaacatctgctaaactttagcccatcatacttcttatgcttgtataacaacatgaaaacctgtaataaccagtttttggcatcatacattattataagactttgtcataatatttcaggaaggtaatgctgttgaatgtactaataagttacaaaattaatttagatgatttcctagctataacctattgaaaatcatttgttttggtttccaatctgattgaaatcctaaaaatacttaaaataatttacagagtagcatgtaataggaatcgttcaatatacatcagcacacatcctgtgtattcattacatgaaatggtactcgaacattgtgaatataaagttatggtatagttttaattaagactgtggactctaaacctgacctaaaatctgattctgtcatttgctacttgtgttacttcattttattgcgtcatggtttcctcatctctaatggaggaacaagagattttatagaaattagataaagtagtgtatgtgagtgttaagcatagtacctagaatatgataagatttaataaatgttagttattattttatataactagtattatctggttatgaaaggaactttggcttttagtttcaaatttatctttctagccattttatttaagacgtttatacaagaagaaatacataaagaatgaggtaaatgacaaattagcaatgtaattgttatcaactagtggaggcacttttagcaggcaaattactcattattatggtcaattattttggcaaataattaaagaaaatgaaaaagaagaccaccagactatgaatgactttgcctttaactgatgctgatagaatttgttttaaaattttttcactattaggaagtagcctggttttgactaaactttttaaaaagaa

SEQ ID NO: 50709 - DNA, 1033 bp, Homo sapiens
attctaccagagaatacagacaataaacgagcaaacaaatgaagaagatccttatagactgtagtaagagcaatgaaaataagtaggggaatatgatacagatagctaggaagggcctactttagtgtgggaagtcagaaaaggcctttcagagaagatgattgagcagagacctgaaagagaagagagaataggcctaccttgtcaggatctgggagaacattcccgagataacattcttgcagagagaagagtaagagccaaggccttgaggggggaaaaagagacttggcgtttttgaagagcagaaagcaagccagcatggcggattaaagaagatgttacagagcctagaagcagctcaataaccgataaataggacttggaggtcctgagaaagaatttgggtttgattctcagaacaataggaagccactgaagagtctttcctggggaaggtcattggcttaaaaaaattatccagggaaatttaaaaaaaaatgttttgcagaggataaatagaatgtctactcattcagtcatttatattaatacctgagaataaaaaaaactctatgatcagtatgctaaataatcatgtaattcggttcctctactctgtttaggtaaggggatgggggaatgggaaccctgaggtgagtatgttaaaaggcagtttactttccactgtcacattgtgacttgtgctacaaggtaagttgtcaccaactttattaaaaatcagatcattgttcaacttaagaatttatttttcaaagaatgatatcttattttctcatggaaatatgtttcctttggaaggttggaaattttattttgtataaaggaataacctaggttttagaaagggcctttggaattttaagaagggcttatcattttcttttacctgttgcctctccaacattttcaaatggccatacctttattccttgagagattagggttactgtgtttcctgaggcttaaatgaatttattgccctaagcccttccttgaaagcaatccagct

SEQ ID NO: 50710 - DNA, 1048 bp, Homo sapiens
tgtcttactttgaatgtcctctttctttggctaatttcatgttttctttctctttctctctcctttccagctttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaa

SEQ ID NO: 50711 - DNA, 1074 bp, Homo sapiens
aaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgttt

SEQ ID NO: 50712 - DNA, 1050 bp, Homo sapiens
tggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatg

SEQ ID NO: 50713 - DNA, 1055 bp, Homo sapiens
aatactttgggaggccaaggcgaaggattgcttgagtccaggagtttgagatcagcctgggcaacatagtgagacctttgtctctacaaaaaaaataaataaataaacattagctgggcctggtggcacttgcctataatcccagctactcaggagactgaggtgggagaactgcttgaacccgggaggttgaggctgcagtgagccatgattgcgccactgcactccagtctgggcaacagagagagaccctgactcaaaaaaaaaaaaaaaagagtatcagtgtttcaggggttcctaccagtccacccttcccacttccccttcctgctactcctaatcacctttgacctctaacccttcattgtttgtgtcaagtcataatatttgatttcccctcatgctcactccatcttcatcagctcttactgttttacagttaactctgctgtttgctgcatgctgcatgagacccagggtcctggtaagcttgattaactctaaatagaactggcagtggcttctagaacatatctcccccaatcccgcacccccaacacaagcatctaatcgtagaagaagctgcttcattggtctagctggttttctctcgtgacttataatatgcagaaatagtctggtgtggtttcaggtgtacatgtggaatgcctgcctgcctgcctgattaaagtgaggggtcgttttcagacttttgctgctagaacagctgggtaacacaggtggatcctgtgatcagtatttgaggtttcagtgtgggaagtttttttcttaaagagccataatcgggccggacgcagtggctcacagacctgtaatcccagcactttggtaggccgaggagggcagatcacctgaggtcagaagattgagaccatcctggctaacacggtgaagctccatctctactaaaaatacaaaaaattagccggacatggtggcacaggcctgtaatcccagctactctggaggctgacacaggagaatcgcttgaacctgggaggcggaggttgcagtgagccgagattgcaccattg

SEQ ID NO: 50714 - DNA, 1063 bp, Homo sapiens
tacaaaaaattagccaggcgtggtggcgtgcgcctgtaatcccagctacttgggaggctgagcaggagaattgcctgaactgaggaggcagaggttgcagtgagctaagatagcaccattgcactccagcctgggcgacagattgagactctgtctcaaaaaaaaaaaaaaaaaaaaaaaaaagaagtgcagatacaggatagtggaagaaagagagagcctttagcagaaactcggtgcaccctctccccacccttgccctatatctgaggttgctcacctctccatggccgtagtcccaccctcaccctgcctcagttattactctctgcagccaacagaatttaactgctgccagtgaaggctgcagctcagccctgatttcccacccctttgtgatccctccctgctggcttagttctgcctagcctggggtgctgagaacttatgggggagccctcagatgccagtgtatgctgcatgtgccccatcctcaatctgtggaatgactgtaagaccttctgatctcccctggtattagaacagtggctcctggataccatgtgggtcaataatcctcacccaaccccagtctctgcttgctgaagttacccattcctcatcccagaactggagaaaaatatttcaacgggatctagaaaaactcctgtggtgcccttgtgccctgcagttgtttgtgcagtgtggcttgaggagttcccaggtggactgtttagctgtgtctttactgaagggtactgaggatccaaaaggtgtccatggtcattgccttctgttttcagccatttgttcctggacttaactatgggatatttttgccagaaggaagaaacaccttcctttcctctggcttatcacttaggaataacatggtaacttttgcataacagtaaaatatgttatatttgaaggcattcagctttgcaatccaattactctttatgcaaatgtgtaatttaaacatcttggccgggtacggtggctcacgcctgtaatcccagcactttgggaaactgacgcaggcagatcacctgaggtcagg

SEQ ID NO: 50715 - DNA, 1027 bp, Homo sapiens
agcaactgttccactccactcactttgccaaaagaagggtgtctttctagtatacatgggtcaggtctcaattccatgcagcaaacatttattgagctcctaccttgcgccaggtactgtcgagctctgaccatctaaaaaggaatggcttagtctctgcccttgagggactcataggcaaaaccggttttaagcaaataatttccatagagtataagatgttctgtaaaggacagggtacaaagagataaaggacaagttacaatgagaacacaaaggcgagaaccatcaattccacgtagggaggtcagggaagccttcacaaaggatgtgcctcctgagctgactcttgaaggacgaactgttttgccagacagacaagggaatggagagaggggcatctcaggcagaagtaactgcctgtataaaggcaaagtgatgtgtaggattctggtatgttctagggaagtgtagcttgctctctttggctagacagaggcagagtcactgtgaagctaatgaagattgcacaggccccttccaaagctctgtaactaatgttcaatcacaatgtcgtattattttcctcagagagtctttcagattgcataagcctaagggctggaaaaacctggttctgcccctgggctaacacttggagtaagcttggggaaaaaacggtgagatgaggctgaagaggtaagcaggtgccagatcacagaaggatttatgatcaaggcaagaggtaaaataggtgctgagatagggaagaggagacagatttgctaaatactgagtaggtaaatatcaacaggacttggtaggcacttggtgtggggttgtgaaggcaaaagaaaaatctagaatgaggcccaaatttccagctttggagagtggacacatggtgatggcattccgtaagagaaccagggttcaaaataatcagctctgttttggacatgtcaagtttgatctgtctgaggaatactgagatacgcgatgaccttcagcagtaggcagttgaaca

SEQ ID NO: 50716 - DNA, 1041 bp, Homo sapiens
ggccaacatggtgaaaccccgtctctactaaaaatacaaaaattagctgggcatggtggtaggcgcctgtaatcccagctactcgggaggctgaggcaggagaatcgcttgaacccgggagggggaggttgcagtgagccgagatcacgccactgcactccagcctgggtgacagtgcgagactctgtctcaaaaaaaaaaaaagaaaagaaaaaaaccctccagtaaccccacagctacctccagttctctcttgatttgcttatccacgtatccaactgtctattggatctcttcacctcgatgtcatatagccaatctcaaacttaatgtatccaaaacaagttttgatccccttcccctacccaccaaaaaaacctattcttctcatggcccttcctctcagtaaatgacaccaccatccaccctgttgctcaagtcagaaacctgagcatcacccttgccacctctgtcttcctcctcccctacattcagtcaatcacaagtcttgttgattccatgaaatctctcttatctgtccatctgactctacagaccatagcctcttaccagtccctctaatcctagcctactcctctccatcccgaatcagtgggttctcagcagcagtccacatgctaacgttgatgcttttttttttttttttgagacagagtctcactctgtcacccaggctgtagtgcagtggcgcgatcatggctcactgcagcctcgacttcccaggctcaggtgatcctcccatctcagcctcccaggtggctgggactataggcatgtgccaccatgcccagctaattgttttctattttgtagagatggggttttgccatgttgcccatgctgattgagaactcctgggctcaagtgatccacccgccttgattctgtaatctgtgggattacagaatcctagtactttgggaggctgagacaggcagatcacctgaggttgggagttcgagaccagcctggccagcatggtgaaaccccgtctctactaaaaatacaaaaaaattagcc

SEQ ID NO: 50717 - DNA, 1024 bp, Homo sapiens
atttctagatatggaggcgataagtactggtattttattacttgtcaagtaatttattacttgacaaaatttacaactgctactgtggatgggggacggggtgtaatctttgccttctttgtattggctcccattattatgcaagggtatgttcgtccaggttggccaggcattaaacctgcatccgtgccaattttgcaagattattctgtagatttgggggagtattggggttggccttagatgaaagccaaaagatgcaactagaaattgagacagtcatccttggaaaagtgacatttcatttatttttaaatttaaaagtttatttttttagccagtgaaatttagcagtagagatagagttaggattaataccgaaatggtgagtaggttagatcttctgaatgtcagggactttccctaagtcttaattaccctcccaataacacttgaaaagtacgtacccctgttttacaaagtagagcactgagattcgttgacttgcaaatggtaggtaggtggttctgtttgactcaaagctgtgttcttcccaggaagccagattccctagccattcccagtgtggtcgtctgagtccttgggggaccacagggtaaattgaaaggtagcctctggctgtggagcagaaaggacctgggtttgaatcctggttctgcacattgatgctctgattttgtgcatgtttcttaaccggattccacttattttatctgaacgatggaaactgtggtatctgcccccagagaagttgtgagggtcagagacttgcttggcttgatggcttagcattgagaagattttggggctggggtatgtgttaagcactcaaatgttggtttgaaggagttcttgactttgaatcattcgggcaggctctaatattgtctaaattgattgcattttcttcccagtcttctcacaagactttcaggattaagcgattcctggccaagaaacaaaagcaaaatcgtcccattccccagtggattcggatgaaaac

SEQ ID NO: 50718 - DNA, 1063 bp, Homo sapiens
ttccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagggatgatgagcattttttcatgtgttttttggctgcataaatgtcttcttttgagaagtgtctgttcatgtccttagcccactttttgatggggttgttttttcttgtaaatttatttgaggtcattgtagattctggatattagcccttcgtcagatgagtaggttgcgaaaattttctcccattttgtaggttgcctgttcaccctgatggtagtttcttttgctgtgcagaagctctttagtttaattagatcccattggtagtccttgtttgattcttgacaatccagtgtgtgttttatcttaggtctcatgatctgagtgtgtaccctctccaggaaggaaactgcatcaatgtctgttcctgttaaatagcaacttttagtctcagcttgttttgttttgatgtcaataaatagtaacaacattcaagtatgaagctaagtgtgtttattaacttcactaaatagctgttatatttgagaaattaaatttttgatactgaattaacctctggagaatttcaaaagtgcatgaatgatattagtttctgctttcactggcatgcctttgttttgtctaccagggaaaaatcagttcatggttcactcctatattaggcctgatgttttttggctgtgcccccacccacatctcatcttgaa

SEQ ID NO: 50719 - DNA, 1033 bp, Homo sapiens
cagggtttcaccacgtgggccaggttggtcagatgacccgcccgccttggcctcccagagtgctggaattacaggggtgagccaccacacccagccgatgcttttcagttaaagcacgaagaggatttttgttgttgttgttttttaagacggagtctcattctgttgcccaggttggagtgcagtggcatgatctcagctcaccacaacctccgcctcctgggttcaagcgattctcctgcctcggcctcctgagtagctgggaccacaggctcatgccaccatacccaactaatttttgtatttttagtagagacggggtttcactatgttggccaggctggtcttgaacccctgaccttgtgatccacccgcctcggcctcccaaagtgctgggattacaggtgtgagccactgcgcctggcctaattttttcccttgcatattgatgtggatgacctgctgctgcaggcttcatcttcaacatcattttgtcctttcttacaagttatccatttgtaaactgctgatctctttaggggcattgtccccataaacttttggtaaagcatcagtgattttaccgttcttccacccaagcttcatcttaaattttatgtttgttcttccttcaattttagcagaatccatttttcgctgataggagctcttttcacactgatgctttctcctttttaatgcctcaaactagatcctgtcgagatattttttaacgagttagtaccagtttattttgatgccaaaagattttgcaatccatgcatagtttcttgataatacacattttccatggactttttgaagacttctcatatgactgttgatatgattgagctctgttcccgcacccaaatctcatcttaaactgtaatcctcatgtgtcaagggaggagcttggtaggaggtgattggattattggggcagtctcacacatgctgatcttgtgatagtgagtaagcctcacaagatctgatggttttaaacaaggcagtttttcctatgctcgcactt

SEQ ID NO: 50720 - DNA, 1034 bp, Homo sapiens
cgtctcaaaaaaaggaatgaaatgggccaggtgtgatggctcatacaggtaatcctagcatttagaaggccaaggcaagaggatcacttaacttcaggaatttaagaccagcctgggcaacatagggagaccccatctctactaaaaatttaaaaacttagcccagtgtgggagagtgtgcctgcaatcccagctgctagggagctgagatgggaggatcgcctgtatctggaatgtcaaggctgcagtgagccgcaattgtgctacttgcacttcagcctgggtgacacagatcctgtaaaagaaatttacccaggcttataaaataataattacaaaatggttgcttttcgttggagatggagagaggaagtagagaagttgtcatttactgtgccctcatatttatggtcttaaatgactgggctttaggatatattaatatataacttatgataaagaaaatcccatgtaaaagcttagtagcattgttgtaacagtaacatatttcattgtacttcagggtcgtccagggatgcagtcttaccatccaggagttcaaagccactatcaacactattttcctgatgacagcaccaactatagatactcaccagtagaagaaaagcaggaaagtagtattagctgtagaaaagaaggaggaggccaggcgtggtggcgcacacctgtaatcccagcactttgggaggctgaggcgggcagatcgcatgaggtcaggacttcgagaccagcctggccaacatggtgaaactcagtctctactaaaaatacaaaaatctgtcgggtgtcggggcaggtgcctgtagtcccagctacttgggaggctgcagcagaattgcttgaacctaggaggcagaggttgcagtgagcagagattgtgccattgcactccagcctgagcaacaaagtgagactcaatctcaaaaaaaaaaaacaaaaaaaggaggaggagaggtgtgtgataagtcctgatggccttaggtgtcctgactgtctaggcagccaaagggcac

SEQ ID NO: 50721 - DNA, 1042 bp, Homo sapiens
cattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaagctaagtgtgtttattaactttactaaatagctatgagttttgagaaattaaatttttgacatctgacatcactcaccttctagtgaagcctaagggagctttaactcatggcagaaggtgaagtagaagcaggcatctcacccaaaactgtaaacaaaagtaagagctggttctaaataaaacaaataaaagtctattaatttaaacataaaataggctggatgcagtggctcacgcctgtaatcacagcattttgggaggccaaggtgggcggatcacttgaggtcaggagttcaagaccaccctggccaacatggtgaaaccccatctctactaaaaatacaaaattatctgggcgtggtggtgggcatctgtaatcccagctactcgggaggctgaggcacgagaattgcttgagcctgggaggtggagattgcagtga

SEQ ID NO: 50722 - DNA, 1050 bp, Homo sapiens
taaacattttatctttaaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagaggtcagtagtcaaggactctttgttatgtttgatttatacatgctagttttgctgctatgtcctggacatgtacctgaattaagataagctgttttatgcagggcagggggatgaggaggaacagtttcagaatattcttgtatcttaatctgggtgaatggttttggggttttgttccttcttaaaacactagtatttttcactctgctctaaaagtgcaacctcattgcaggggccaaatcagaatcacagtgttcctgcatttgtgattacaagatctttcagggttctgtctcagatttgtttttcatgcagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggtgctgcttgtcattaaacttgtttatgagggtttttttcccttttcctgcaagtgtaaagaaagtgtaaagggcactgttattatagaatttttaaaggggaactttaatcatctgcaacttttttttttttttttttttgagacagagtctgactatgttgcccaggctggagtgcagtggcacaatctcggctcactgcaagctccgcctcctgggttcacgccattcttctgcttcagcctcccaagtagctggg

SEQ ID NO: 50723 - DNA, 1979 bp, Homo sapiens
tagacagtggtaagcctttgaaggtcaattggtattttctagtaataagttcatattcctaaaaaaattttgacttgaaaatacgaaaaaatgaaattagttactgcaaaattgaaaactacttgaggaattctagcttggatcttggttctcagtaataggctgtcactactgtatcagtagctctaaacatgagcataatctttgacccaggatttctactcaggaatttatcctaaggaatatgtggggtttttttgtttgtttgtttgttttttttgcttgcttgctcgctcgctctctctctgtgtgtgtgtgtgtgtgtgtgtgtatgtgtgtgtgtgtgtgtgtgtgtgagagatggagtcttgctctgtcgcccaggctggagtgcagtgtcgcaatctcggctcactgcaacttccgcctcctgggttcaggcgattctgccgcagtctcccgagtagctggaagtacaggtgtccgccaccacgcccggccaattttgtatttttagtagagccggggtttcaccatgttggccaggctgatctcgaactcctgacctcaagtgatccgcctgccttggcctctgaaagtgctgggattacaggcatgagccactgtgcccggccaggaatatgtgttttaagatggctgtaaggccaatagcttattcagaatgttgaaaatgaaaaatattcttccaaaacttgacttttattaatagatggatagtacaagcctatttctggtaactttcttagaataaattcccagaagtggaattatggggtcaaaaggattagatatttttagccccttccccccaacttcttccagttgaacaagtttacactcctatcagtaaaacaagagaatgtcctaagtacttaattctcatcagttgggaatgactcttttaataaattattttgttgttttaatttgaatttctttactttttaaaaggtattttaatcccgtattgttgaaatcgaatgctgtaaaacttctttctgatattacaattgtgatctttctgcataaggggtgtacatgttttcccaccttgggtggttggcagggaatgtcagaaaatggaatcgtttctaggggttgataagtatgattaataatctgtttacatttatgtagctaaaaagacaaccccacttttgagcttcctgaaaaacaagcaggtaaatcttttgtctttatagttctctcaatactttaatttctttgctttgcattctataaacattttaagagcattgggtttctagaggagaaatagctgctttttccaccattactctttaaggatttgccttcttggtctcactctctagcctgctccttcactctggttgttggaccaggagttcactctacaaacgtggaatgttcttaggttgtcccagagacactcatttgatattctgaaagcctctggagagatagtaaggcagcagtggaagaataatattagcaggttctggtcttcattgtctttcgttttctgggtggagtggggataacggtggtagaatgccactttgtagaaagtaggaaggaaagattattcagttggggcctaccatgacttcaggatttattagggttttggtgatgattattttatttgaaggcttgtgttgatgtttctttctagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtataagaatgttgaaactgactgcatgttgctaaaaattgcacgtatctacttctttaaatatgcatgcgtcttgtgttggtgtaaatgaattttttgttttgtttttgttctcttt

SEQ ID NO: 50724 - DNA, 1031 bp, Homo sapiens
ggtgcccagcccaacgtgataattttatatatgtatacattatgaaatgtatacattatgaaatgtatacatattgtatacatatatacattatgaaatgtatacataatgtatacatatatacattatgaaatatatacaatcaagttaacacattcatcacctcacataacacatcacctcaaatagttacacttttaaaaaataacagctttattgagatataattcacatgcctgaaatagtcacccttttaaagtatacagttcagtgaattttagtatattcataggcttatgagcctatcaccacaatctaaatttagaacatgttcatcacccctaagagaaaccccacccattagttgtcactcctcattcttctcaccacttctaccccaaactccaggcagctactactctacgttctgtctctatagatttgcctattttggagatttctaacattttaaaatgaaaaatagtttgtagggtctttttcacattaaaatatcacattttataagttgaatttatatgaatattttactttcatgccgtgttgtttcactatgttatcagtgtgaatttgtggctccttttgtagtatgttgattatggttgtgccagtgtgctttatgcctttgggagaccctcttcagatgactgccatcaaaagagtcatagaaagcaatgggttgattcccttatatccacttttgacattttctttgttatagcaagtgtggtattttttttctaaacaggtcaggaatatcccgctatagtagaatttgcaccttttcaaaaagctgcaaaaaagaagactaagaaaagagataccaaagtcgggactatcgatgatggtacagtatagctctaattatataatgctattgctgtggggtttttaaaaataatatctttgtgagagttaattcgaccccaaaattttaaattagaaaatatacaaaataaagtaagtgagaaatgttatttgccgatggaagctttgcttaattgttagactag

SEQ ID NO: 50725 - DNA, 1144 bp, Homo sapiens
ctggtctcaaactcctggccacaggtgatccacctgcctcggccttccaaagtgttgggattacaggcatgagccaccgcacccagccagagcatgccttttttttcaactgttctatattactcaatatacttttctagccctaatgtttaatctgtcacacaatcacagactttataacattgaataggtcactagagataatctaatgcagcccttcactttgcagatgaggataccagggcctagaagtaggtagggacagtctaacacaataaactgggactggtacccaggactcctgagcagcccgctcagtgctttctccaccccactagaagcctcagttctaagagtttcttcttctcagcttggctcttagtggatttttcctcccttttgtgaatgaaggcagccttacacatgacattaaatttaactattttcatcaggcgaatctcctcccatttttatccgtgtgcaggcagcagacttttatgtatcagcagtgagtgtgttttgtgatttttacatgatactgcttcatatactcacttccaggaaacagtatctcactgtactacttgatcatggatggcttagccaactacatactactggacactcacaatcaacagacacatagaagtatatgcacaaggcaaaaaacaatgaaaaagtatatgcacaaaactgttatccatggttaagtgacctttggggtaatagaaacgggtattttgggtaatttcattttctaatttgtatctttttgctcactgggcattttttatagtgatgtcttttttttattataaaagtaattttaactgtctgaggtgatgggcattctctgatttttcttttataaggaacccatttgtatattcctgttgccagactgtgttcctgaagagaatgaaccaactttgccattggcaatgtgtaagtgttccctccccacaactataccatcctataccatccttcttttttttttttttttttgacagagtctcactctgttgcccaggctggagtgcagtggtgcgatctcagctcactgcaacctccgcctcccaggttcaagtgattctcctgcctcagcctcccaagcagctgggattacaggcacacactacca

SEQ ID NO: 50726 - DNA, 1046 bp, Homo sapiens
gagttcaagaccagcctggccaacatggtgaaaccctgtctttaccaaaaatacaaaaattagctgggcatggtggcggacacctgtagtcccagctcctcaggaggctgaggcaggagaatcacctgaatccaggaggaggttacagtgagccaagatcgtgccattgcactccagcctgggtgacaagagtgaaactccgtcttaaaaaaaaaatgtcatttttttgtgaatgacatggtgaatgatttgattgtttacatagaaaatcccaaagaatctccagataaattataaatgagaggagggtttaacaactggttggatataaggttagtacacaaaaatccattgcatttctatttaccagcaacagacaactagaaaatgtaactaaataagaagaaaacatttgtaatagtatcagagaatatgaaggacttcagaataaatcttaacaaaagatgcccagggctctgtgaggaaaactataaaacattattaagagattgtgtattcaatacagttccaataaaaatgaactgcatttctatttactaacaacagaaacctagaaccttgaacgtttataacagtgtcagaatatgagagacttaagaataaatcttaacaaaagatgcccaaggttctatggggaaaaatgtaagacattaagagtccatatcttcaatatagttccaatcaaaatcacaacacagttgtttatgagacttattaagctggttctaaaatttatatattacactaaaaggacaagaatagccaggtcacttctgaagaagaagagcaagaaggtaagattaaagaaaacttaaatagctggagagataccaggttcacggataggaaggcaatattgtaaagttgtcatttcttcccaaattgatctttatattcaatacagtcccaatcaaaatcagaacacagtttttcatgaaacttaataagccagttctaaaatttatatactagactaaaaggacaagaatagccaagtcactcctgaaaaagaagagcaggaaggt

SEQ ID NO: 50727 - DNA, 1040 bp, Homo sapiens
atcacacccagctacttttttttttttttaatagagacggggtcttgctctgtttcccaggttcagttagaagcagatttttttaagtaaaattatcttgtaagtttgaataagctgggaattcagatcattttattgtcacctttctttgccttgaaaaattaagatgtatagtcaccagttcaaaatttaaaaagaaaagaaaaattaagatgccctctaacataggaagattaagtgaatttgtatcaaattaaaatccctataggaagaaatataagaaaaagaggtctaagaagagcagaaaagagtccagtgattcaagctctaaagaatcccaagaagagtttctggaaaatccctggaaggatcgaacaagtaggttcttctgatagactaactcagaacagatgaaacattaaagtaaccaattagtcagaatgtgaatgtgtttcttaatatctttcatgcagaggctgaagaaccatcagatttaattggcccagaggctccaaaaacacttacctctcaagatgataaacctttgaagtaagcagcagtgtgtttataatatctaaagtacctaccaaaaagtctggttctaacttaccttgccaagcttatctgactctattcccttatttctactccaggttccagctgagctggactactaaatattccctgggcttaatgtgcactttgcaacttttatgccatgttcagcttatttcttcatccagtatgccttcccttcttttccctgccctctgttttcttccctatcgccagtttcttcctgttaaaatccttactatccttcgaagcccttttcaaaaggagatgcatatgctgattcccaatacttcccctccacaagtaggtgtgatttctgtttctctttgatcctcacagaattttttattcctttttttctcttttttctttttttaccagcagaatttttttttctttttgtgagacggagtctcgctctgttgcccaggctggagtttagtggcgtgatcttggctcactgc

SEQ ID NO: 50728 - DNA, 1048 bp, Homo sapiens
ggcacgacccaaaccttggtgtctcctgcaccccacaggccttagctccaatcaggggaatggcagaaagctttcgtgcagtttcctagtcacgtttttaacttgcctcctttcaataaactgaaaaaaatctgccctcagcgaagaaacgctgcattttctgttatccttaccaaccggaatagtctttcagcaatatatatttattatgaaatcagaagctatttttcaacaaatgtgaatattgaatatgtaccccccaaaaaaacacaccctgggggaagatctccctagaatcaatggtctggaatcttttcacctgtctcacactccatgcccccttccatttttcaccccctggcagtctcttgattatgcattcaccttggaactatgattctgggatcttgcccatttatgtctgcttgctagctgtgtggcagcaagtgaatcaccaaactactctgaactaaaaacaccaacctcatagactctattcatttattcactcactcaacgcacgttaactgagcacctactcctgttgaaccctaggctgggtgctggtaataacatcagtgaacaaggcagatgctttccttactctcatgaaattggtcacccaactggggagccagacaataaaccaatacatacaaaactggtggtatgcatgtcaatgtaaagaacatgctaaaactagaaagaatacaaagacttctaatttaggatgtaggtcatggaaggccactccaaagaagggacatgaaagctgaacctgaaggataaacaagaatgagccaggtgaaagataatgggcagtgattccaagctgggaagttttcatatattcccaaaggggccatgtgactagatggtgaggagtgaggagaagagaggctccagtagtttgaagagttaagcaggagatagattaggcaaagctttgaaggccatgctaagaattttaaatcacatcctagggtatagtggaaagccactgtattatttttaatatgaagataacagatgggagggaatcaggcgt

SEQ ID NO: 50729 - DNA, 1025 bp, Homo sapiens
aaaagagagtagtcaacagtgttaagagtacaaagaaataaagtggactaagatctggatttgatgttttataagtttctgatgaattaaaatagcattttaaaagcaggagtcatattcaaggaactgcagagaaaatgggaggaagaaaaatacttttgcaataaacttggggtgccatttaaaggagtttgacatcaaaaagaaagcgagggtaatagatgggttacttaagtgtcatatacaaatctcttcctttttttttcaaaattgaatttttttgtaatgtctataatcctgtgtctgatttgcaaatttggatgtaaaataagaatcacttgaacatagttgcagagtttgatcagagaagcagagtgaaaagcaataagggatgattacaggaatcagaccatatgcaattgtgggagcagggtgtcaggtcctggggtccgggtccaacccatgctgaagtccggaggagtgggtggatgagcagaaagaacattcggggggctgtaggcaggtgaatatggttttattcagcagcagctttattttattttattttatttatttattttttttttttgagacggagtctcggtctgtctcccaggctggagtgcagtagcgcgatctcggctcactgcaagctccgcctcccaggttcacaccattctcctgcctcagcctcccgagtagctgggactacaggcgcatgccacctcgcccagctaattttctgtatttttagtagagacggggtttcaccttgttagccgggatggtctcgatctcctgacctcgtgatccgctggcctcggcctcccaaagtgctgagattacaggcgtgagccactgcgcccggccagcagcagcttttatgaacagctttctcacactggctctctcacactggccaccctgtcttggctgcttgagccagcggctcccacacacagctgtgcagccagttctcccttgccttcagggtcagcagcttaactctttttctctctgggcat

SEQ ID NO: 50730 - DNA, 1029 bp, Homo sapiens
ggaggcacttgtgatgcttcctgtgagttgaggcaggaacagctttcttgcataggaacccaagatgatggggaagctggctttccaccttgatctcactttttccaatgtagaaaccatgagtctcggaggatttttccatgtggtgtctagtagtttgggggaggggcattgtggatagagaagtccatttctctcactttcagctcatagttttttacttctctgtggcctcagggattgtcacagctttgattttgagttctgggatattgctggtgataattgtggcaccggatagttgtttttggttttcagtgggcagggggagtgaatccagattgcttctactccatctttggtgacatcactccccaactctgaagttttgagaacgagtgactgaagaattgtaatgccattatccaagttaggggacatggaacatgtcatggtaaataaataggtcagtttgtgcttgttgaatttgagagtcatctgcaactaaatggactataagaatcatgaccttggcattcaggagagaaagctgagataaaagcatagatctataaatcatgagtgtgaagggatggtggttgaatcctttagagtggagggggtcataaaggtagagagggtagagtgagaattcaagagtgccaagaactggactttgagcaaccaactcctacaccttgacgattgggtagaagagaagtgagcatactaagacagggagcagcagttggagagataggagaaaattccaaagagtgcttgtcatagaaaccaagggaagagagaaattcagaaaagagaaagtagcttttctgcaacaggtttgctgccaacacaggttgtcttgaaaaccacccctaaaaaccaaaatgggaaaggaaaaactcatatcaatattgtcgtcattggacatgtagattcaggcaagtccactactactggccatctgatctacaaatgcagtggcatcaacaaaagaaccactgaaaaattgagaagaaggctgct

SEQ ID NO: 50731 - DNA, 1177 bp, Homo sapiens
tttttaattcttgtgggtatatagtaggtatatatatttatgggtacatgagatgtgtggatacaggcatgcaatgtataataatcacatcatggagaatggggtatccaccccctcaagtgatcattctttgtattacaaacaatccaattatactattttagttattttaaaatgtacaattaaattattattgactatagacaccctgttgtgctatcaaatagtaggtgtcattcattctaactattttttggtacccattaatcatccccaactcccctacctatcccccactacccttcccagcctctggtaatcaaccttctactatgtccatgagttcaactgttttgatctttagatcccacaaataagtaagaaaatacgatgtttgtctttctgtgcctagtgccccccaaagcactaggattacaggtgtgggcctctatgcgtagcctaaatgactttattattgcacattcgtatccttttctttcagattgaagaactctctctagcattttcttgcaagacaggtctggtgatgatgaattcattcaccttttgtttgtcttagaaagtctttatctctcctacatgtttgaaggatagctttgttgggtatattattctcagtttttgccttgagcactttgaatatgtcgtctcactctcttctgtcctgtatcgtttctgctgagagtctgttgccagacaaatcaaagtcctttgtgtgttatttgcttttatttctcttgctgcttttagaatcttgtctttgtccttgacctctgagagcttaatacatattttggtatagtcctatttgggtttaatctgtttggtaatctttgactttcctgtatctggatatttatatctttctctaggtttggaaagttttctgttatttctttgaataagctaatgacccccttttctttatcaatttcctcttgagggtcaatgactcagatttgctcttttgaagttattttctagttcttgtagatattcttcattccttttccttcttttttctttttttcttctctgactgtgtattttcaaatagactatctttgagctcactatttctttcttctgcttgatcagttctgctgttgatacctctgtgatgagttgttcagttcagccaatgtatttctcagtt

SEQ ID NO: 50732 - DNA, 1027 bp, Homo sapiens
attagttcagtctatgtagttaactcctgttctgcttgataatcataaacatttcagctctccatgggagccttggaggtttttcctctattctagtgtcacaatgtccaaagttatcaaaagtgtgcattcaagagcacctgtcagagtcctatgctgattataaaaccaccttttgaaaaggatgaaagtggccaggcgcggtggctcacgtctgtaatcccagcactttgggaggccgaggcaggtggatcacaaggtcaggaaatcaagaccatcctggctaacatggtgaaaccctgtctctactaaaaatacaaaaaaaaaaaaaaattagccgggcgtggtggtgggcgcctgtagtcccagctactcaggaggctgaggcaggagaatggcgtgaacccgggaggtggagcttgcagtgagccgagatcgtgccactgcactccagcctgggcaacagagtgagactccctctcaaaaaaaaaaaaaaagatgaaggtaaaataactgtggatgaaaaaatcttagaacagtcatagttaaagagacaattgacaaggaaatttggttacttctatggcatacaacaatttaacataataatcacaattaccaccgataacatgctataagacacatcagaatcacaggaatttcatataattctggaacacatactaataacacatttatataaatccaaagaaagttaaacactttcatatttaacaatacttctgtatggttttattatatcaaataagccaaagatgtctcttttggacttcaggagactaatatcaaaaaattaatgaggtctgaagttaaaatttgattttgaaaagtttgtcaaacataaagagtttaaaacacatgatatcacaaaataggatcacaggtcattgtaaaataagtcattcatttagccaaagtaataactcgattttttaaaaaagttaaaaacttttattctttgagacaggagacttaatttccaaaacaataagtcctaataaagatg

SEQ ID NO: 50733 - DNA, 1027 bp, Homo sapiens
ccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttg

SEQ ID NO: 50734 - DNA, 1036 bp, Homo sapiens
tgatttcaggaatttgcactttataatgaaccctttaagtagggacaataatacatctggtgatggttaccacaaattataagataggaaacctctcttttgggtatggagccatcattcctcattcaaatcctaccccagaaatgaaagcaagattgagaatgccaacggtgacttggattgttggtttcagttcaatcaatgtttactctgtgttccatgtgccacgcattgagccaggagctgtggaaatagaaattaaatgagacagtccctgcgttagtctagggacttgggggtggggggtcaggggacagtagtggggacaaaaaagtaaagaaaacattacccagaatgctatggaaacagcatacctaacccagaaaagggatccagatttagctacctagtccaaacctatactatgggcttgtagcagagactttggggattgttagaagcctctcctttttttttttttttgagacagagtcttgccctgtcgctcaggctggagtgcaatggcacaatcttggctcactgcaacctccacctcctggggtcaagcgattctcctgcctcagcctcccgagtagctgggattacaggtgcgtgccaccatgcccggctatttttttttttttttttgtatcttttgtagagacagggtttcaccatgttggccaggctggtctcaaactcctgacctcgtgattcacccgcctcggcctcccaaagtgctgggattacaggcatgagccaccgtgcctggcccacccttactttttaataacagctactattcactgagtacttactatgtactaagcattgtgctaagtgctttacatatatcatcattcaatcatttacctctttaagagaagtactcttgcaattgccatttttaagataagatgactgaatcatggagagattaagtgacttcaccaaagtcacagaggtggtaagtgaaagagtaaggatttatatctagggctgactgattccagagattgggttgggggatttttga

SEQ ID NO: 50735 - DNA, 1060 bp, Homo sapiens
gtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagtcccatacataggcctcgattgatgctaggcaggctacagaataagatcaacctgggaagcgttttataaaaatagattccaggctgcatccttagaggatttaacgtagtaggtctaatgaggagacagagagagagagagacagagagagagagagagagtgtgtgtgtgtgtgtgtgtgtgtgtgtgtgtgtgtgtgtgtaagctcccctgctgaacctgatgcatagtcagttagggaaccagtgatctagaatatttatttcataataaaagctgcggagtatctctttgtacacttttctcaattcctaagttgaggttgatattcaatatctctacatagtagctttacattgcagccatacatattgagctattgatctgaaccaacgtaggattgtgtgcagtctctctcttacttagatcactctaaaatacttgagccttccagtttccatatacggatagttacctagtcaccttactatatcacataagaaaacttagcaatgtagctggtaacttttctctgaattacccagttaagccatgtgaatgccagttagtcatcacggctgcaaactctgcagttaactaccattgtctttggccaagttgtttaacttctagtgtctcaatttcttcatccagtgggtgggggctttaaaatcctgctactcatttctttgagtgataatttgcatttcagaggaatgcatcat

SEQ ID NO: 50736 - DNA, 1032 bp, Homo sapiens
ttctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttcttt

SEQ ID NO: 50737 - DNA, 1034 bp, Homo sapiens
ggaaatgtggaagctgtgtttaaaagcgaatatactgtgagccattcgactacttttgcagtggtgttgaatacctagtctgacttggttaggccacaataaattgggctctccaccctaccattcttgcgattaaagacgttagttacactttaaaaatattttcaagaattcattttcccttttgtctgttttgcttatgtacttcaattattttgatcctttagtagctttatttttggactttttatctggctccccttcattattcccctaattttaagtccagatttgtgtttacagtttaaaatcgtttgcagtattagtatcatcacttcaagactgtttatctagtcacctgtaatagagatgagctgtgctctttctcttactttgaaactttggtttttatgtacatagaattaaaaatatcacccaaagagatatacagcatttaatactgatattgaatgtataatctatttgtggaactaggttcttggctgtgggtacctataaatacaacacataggtaatatttgactgtatggggaaagaaatagaattgcaataaggcagaagagtgttgattggattttactggatcagaccactttctagaagtagaaaaaaatagcccccttaggctgccaaccctgaccagataagaaatgcagtaagcacgctcaaattagtaagaggtcccagttttcttgactttgcagccactaaaattgtatgtactaagtcacgatctgcaaactttaaagttccaaacagtgagtgttttaggctttggtgccatatggtctctgtcacaactatttgaccctgctattgtagcacgaaaacagcaacacataaacagatgactgtggctgggttccaataaaaccttatttatggacactggaatttgaattttatatgctctcatgtgtcacaaaatatttttttcaaccatttaaaaatgtaaaggccatttttagctcttggaccagatctggcccatgggctacagcttgctgacccct

SEQ ID NO: 50738 - DNA, 1084 bp, Homo sapiens
tgaaggcaggattgaagtgtggttcattttggtagctcctggagtacttgcactctgaaattattagaatgactggctgatcagatgagtacttcagaaagataatagcagtgaaaaggaaagattaggactggaggggctgaaaggcagggagcccacttaagaggctgctgtgatccaggctagaggtggtgagggctcagcaagtgacaggaggaataaaattgaggccataaatcttcaagtgtctgagatccacatgactacacctgtgctccaaaagttggaaacaaaatacagaggaaagggatttctgtcagattatgagttctcttttacttagttgcagtttattctaccgcatgatttcttcttctgtgtaatagtgttagattgcttttcttctgtgggtattaaccgtatctgttatctgtagacagttgtgaaatgttaattaactggaagctctttttcaaacagaaaaatgaaaaccgattttatctgaaggaagtgaacatcagcatgtatttggttaatggctccggtaagcaaagcactggcctggggaaaaagactgtggattaccctgaaggattagaaattacaatggtcttattaccaaatagtgccttatttaatgaaacagaagatgctatgtaaaaagtgtaccttgatcataccttaaaatcagtaacttagaactatgatgttctgtctttttctgtatcccattttttcaaagtagagtagataataattaaggatatgactgatttttagactatagaaacatctatagaaagataagggaacctagttatggtaagaattgctttttgtgggttgatcttgtcccccaggccttcactgaaaaaccctgaggactgttcctttttttttttttttttttttttgagacagggtctcgctctatgcccaggccagattgcaggggtgtgaccacagctcaatcccaggttcaagccaactacccacctcagcctcctaggtagctgggactacaggtgtgcaccatcatgcccagctaatttttttttgtattttttgtagagacagggtttca

SEQ ID NO: 50739 - DNA, 1060 bp, Homo sapiens
cagtagtaatatcccactttcatttctgattttagtaacttgagtctattctatgtttttctttttttttttttttttttttgagacggtatcaccctgttgcccaggctggagtgcagtggcacagtcacagctcactgcagcctaaactcctgggcttcagcgatctttctgagtagctgggactacaggtgcatgccaccacacccagctaattttttaaaaatttttgcagagattgggtctccctatgttgcccaggctagtcttgaactcctggcctgaagcaatctttccatcttggtcttccgaatttctgggattacaggcgagagccatcatacctggtctattagtgatttctaattttactccatgtggccagagaagatagtatatgatttcagtcttgttaaatctattgagagttgtgtggcctaacgtgatttatcctggagaatgtttcatgtggagttgagaagaatgtgtattctactgttttgtgtggaatgttctgtatatgtctaccgagccaagtaggtttgtagtgttgttcagtttttctatttccttattgatcttctgtctagtattatccattattgaaagtggggtattgaagtcttcaaccattattgtagaactgtctatttctgccttcaattctaccagtttttacttcatatatagtgggactgttaggtatgtctgtttatgattattaataccttacccctatatcaatatatattattgttgtctcttgtaataatacacttttttacttaaaagtctattttatctgacattagtggagcaaccctagccctcttttggtttggtttgcttgcaatgtctttttccatcctttctctttcaacttgtttgtgtctagaacctaaagtgagtttcttgtcgacaatttatagttagatcttggttttaaatccattctgccaatctctgacttttgaaattggagagtttaatttttttacatctaaaataattactgatgaggaaggacttctgtcattttgctatttgttttctatgtatc

SEQ ID NO: 50740 - DNA, 1034 bp, Homo sapiens
cttgagtgtttcgtaggcatcatatagttgggaagtgcttttttaattcattgagccattctatatattttttgtcaaataaattaatcaattttcattcaaggtaatttcctttgctactttcttaatctcttgttttcctcttttgtgattaggtgtgtttctctagtgttatgctttgattccttactacttatcttttgtgtatctactagaggattttgctttgtggtcactataaggtttatataaaataacttcgcaaggtttttggttggctgggtattttttttctttcttcacgactttgaatatattattccattagctcctggactgtaaagtctatgctgagaaatctgctgctagccttattaaaatcccatatatattacatgcttttttttttaaatttttgctttcagaatcctctctttgttcttgctttttgactgtttgattataatgcgtctttaagtaatcttgtttgtattaaacctgattgaagacttttgagcttcctatacctggatattaatatctttcctcagatttggaaagtttattgctcttactttttaaaataagttttctgatctttgtcactctcttttccttcttaactcctataattcaaatatttgctcttttgatacttttccataattatgatgataatcttccttcttttatctttttttattgactatatttttaaataacctgtctttgagttcacagatttgtttgcatgatcaagactgttaatgttttctattttattttacaatttttattttatattttttagctcgagaattttcctttgatttttccatcccttggtatccatggggaattggttctaggacccttagagataccaaattctgtggatgttcaaatctcttacatgaaagggcatagtgtttgcatataatctatgcacatcctcccatatactttaaatcatctctagattacatataatggctaataaaatgtaaatgatatgtaaaaagttattatactgt

SEQ ID NO: 50741 - DNA, 1034 bp, Homo sapiens; identical to SEQ ID NO: 50740

SEQ ID NO: 50742 - DNA, 1025 bp, Homo sapiens
ttgttttggatactgtagtcttgtcatatgctttgaagtcagatagtgtgacacctccagctttgttctttttgcttaagattttcttggctatacgggctcttttttggttctatgtgagttttaagatagtttttttctaattctgtgaagaatgtcaatggtagtttaataggcataacattgaatctataaatcactttggacagcatggccattttcatgatgtcgattcttcccattcatgagcagggaatatttttccatttttgtatcctctctgatttccttgagcagtgatttgtagttatccttgaagaggtccttctcttcccttgttagttgtattcctaggtattttattctctttgtagcaattgtgaatgagagttcatttgtgatttggctctctgcttgcctgttgttggtatataagaatgtgagcaatttttgcacattgatttttgtattctgagacattgacgaagttgcttatcagtttaagaagctttgggcctgagacaatggggttctctggatacaggatcatgtcatctgcaaacaaagacaatttgacttcttttctttctatttgaatacactttatttctttctcttgcctagttgccctggccagaacttcgaatactatgttgattaggagtggtgagagagggcatccttgtcttgtgctggttttcaagggaaatgcttccagcttttgcccattcagtatgatcttgtctgtgggtttctcataaatgtctcttattattttgaggtatgagccatcaatacctaactgagagtttttaacataaagggatgtcaaattttatcaaaggccttttatgtatctattgtgattatcacttggtttttgtcttcagttctgtttatgtaatgagtcacatttattgatttgcttatgttgaaccagccttgcatcttggggatgaagctgacttgatcgtggtagataagctttttaatgagctgctagattcagtatgccagtattttat

SEQ ID NO: 50743 - DNA, 1047 bp, Homo sapiens
aaatggtaggggctaaagttagagcagcagcctttcttgccttggcaaataatctacaagtgatttgcaatttgttggaaagtaactggtccatgcgggccatttcctcttttaaggaggtactttagccaagtatgggcagacatcctagtagcctttttttttttttaggacaattatgtaattgatttatttctaccctactatgatccaaaaaggatttatgaaaaaaaaaaaaacatagtacagtatctttaaatgagaaaatttgtttctgggtgaaattagtaacctaaatgaagctattgccccaaaatgtcatgtacaagtgggccatggagaaactggcaggccacaaagagaaggtaatgtggttagttataggaactagtgtccatcaaatataaagctagttgcagcagagaagaatgtttcctggcaccgaggcctgaaagaaacttctttgcattcacaaagcagtcatgtcttttcagtggataaaacaaaggaatgtgtcttttaaatggtcttgagtattacccgatggccaacaccttagttcattctagtaaggttatttctacaatgacaccggaacatgcggtccaggcatgcaggtctctgatgatttgtttcagtccaggaaaatatttttaaatatttgggacagggtttgtaaactgggatttattatagccttgttttttgtaagtatgtttgtaaagattaggaaactcatgcgactgttgtttggttcccataatacaagtaatatgaacaagacctctttagtgtaaaagctttgcctgccctttgtttcatttttatggatggtgatctctaaggctgcctcttagatagaatgaagcttattatactgtaacttcaatattctatctcaatacttatcagaaatgtggtttaaatgcttaagtttttgtttgtttctgttttttttgaaacagggtctcactgttgcccatgctggggtgcagtggtgcgatcttggctcacggcagcctccacctcacaggctcaagagattct

SEQ ID NO: 50744 - DNA, 1839 bp, Homo sapiens
tctccctattaaaagaaaaacaaaaagcccacctttcatatcttcatgaggaatgagccagccattgtcactgacaactttcacagtgattttatatatctctgtttactcagtacccaaatattattcttttgtatgtgaaggttatgctacagatttgagtttttcttgcactgaccatgaatttgtattttacccctctgtgtaatctcttaggaacaaagggatgacaaaactggtcagggttagatatttggctcgtggtcttatagcaaaacttctagattcagatgttcttttaaaagtatgtctagctggatgtccatcctgttgaattcctcattgacaactttgtacgatactttcttcttgggtagactcttaattttgtgagactctggttgatagtttcttttcttttgagacaaagaagtctcgctgttttgcccaggctggagtgtaatggtgcgatcttggatcactgcaacctctgccttccaggtgattctcctggtgattcttcaagagattctcctgcctcatcctcctgagtagctgggattacaggcacgcaccaccatacctggctaatttttgtatttttagtagagacaaggtttcaccatgttggccaggctggtcttgaactcctgacctcaggtgatccacctgccttggcctcccaaagtgctgggattacaggtctgagccactgtgctgggccatctggctgatagtttctttttttttttgtttgtttgttttgagatggagtctcactctgtcgcccaggctggagtgcaatggtgcaatcttggttcactgcaatctctacctctcgggttcaagcgattctcctgcctcaccctccctagtagttgggactacaagcacgtgccaccacgcctggctaatttttgtatttttagtagagacggggtttcacaatgttggccaggctggtcttgaactcctgacctcaggtgatccacctgcctcggcctcccaaagtgctggcattacagacgtgagccactgtacctggccgatagtttattttaaaacaaaaaaaaattttaaatggaaacggggtttcgccatgttgcccaggctggtctgaaactcctggactcaagccatctgcttgacttggtctcccaatgtgctgggattgtaggcatgagctgccatgcctggctgatagtttctttttctggctgttgactgctactttctatttggatacattccagggttggtcaggtctgtttttcttccttttctttaagaatgttatcatatctgattggaaccgtctatttacaggctactttgaaatctgctgccctcccccactcaccttttattttctattctatagaaaggacagctcttacatatgtcatatttccatgattgaaagatgtcgttacttgtaagatttcattattgtttttagaacagtttttttaaggagggttggtagagaaatgacagtgatttgtaagtatcatcctgattttcacaaacattaaaataatcacattagaattaagatacaaggccaggcatggtggctcatgcctgtaatcctaacactgtaggaggctgaggcaagaggattgcttgaggccaggaatttgagatcagcctgggcaacatagtgagaccccatttctaataaataaataaataaataaataaataaataaataaataaaacttagctaggcatggtagtatgcacctgtagtaccagctccttgagagtctgaggcaggaggatttcctgagcacaggagttcgaggctgcagtaagtcatgattatgccactgcac

SEQ ID NO: 50745 - DNA, 2048 bp, Homo sapiens
acaaggaactaggaagtatgtaaaagtagaaaggcaccttagctcttctaccatactggaaactgttatggacaaaaatgtatgacatgaagttaatagggagcacttgtcctaaaaaaaaggtaaatataaaataatgtaaagtgagttgcagagttgagggatggttgagtgctgttgactttggccatctttgaaggctaagtaggattttaagaagttaagataaaaatgaacaaccattctagtaatgagaactgctggaaaggacagatgttagggagcagtgatagccacagcatagaatgcattgggttactatagcaggatataattgtgaaaagatggtggagagtttggaatgcctaaactaaggggtatgcatttaattcattaggcaatgagaaactctgtttttatgcaaaagagtatttgatcagaactattctaaagaaggaattgaattgggtacattctgaactaagaatttctgattgtcagttgagctatgtgactttttatgtcaagaatgaagtatttgaacattaatgccagaagtaagttctagaaaaatttctcaattcctcacagtacagaaagtaagcacagttcaaaacttcattattaataagggttgtgtgtgtgtgtgtgtgtgtgtgtatttttttttttgcttttattgggaaaaattactacttagagaagtcttctttgagtattgcagcaatatttcctttgtcttaatcattttcataaataatgttaagatatgaataaacctcacgattagaaaaatcttgatgtcatttaaggcattctagccagcaagagtatcttttagacaagtatttttatgactatcgttctcttgctctttattaataagcattttgtctatttcagtttatcaacttttaaacattgaaattttaaagaatctacttctgcattgctatggcagtatttctgagccaactgaattgaaaatgtttggtggtgttaaaaaataagtgtttaattctcaaactgatggttttcatttttcatgtattcctttgaataccaaaggatttcttcatgtaaaaatatttgacttttgactcactattctatttgttcctaaggtgtatctagcattgtgtagttatgtaatgagttatattcagtattctgctgcataatacttttaatgtcttaaattaaacataggcttgtagcacagatataaatgccgtaaggttaggtatctgattatttcctgactacttcctaaatattttatgttacagcatatttccatatttacaactcacctaagaagggttatctctcaattatttagttagaatatccttgatgattggctgttttattgcgtatagcccttttggcagagaaagaataggcagaggagaatattggttcattattttttagtcttttgaattgtttagtcatcctcagctgactagatggctttctgaggtatttagaaccaggaagacaaatttcacagttaattgtgattattttgatagaaattggagtgctttcagaagtagagaacatgcagcctttacatttgtaaaaataatttgagataatctttgcatggttcacactgaggcagaaaagaattattagcaaaatcatagctaggttttatttttatacttttgcccattgccattattgactgcctatcggtggatggtaagactatttaaaatttccatgattgtgtagaggtgtttttttctttttctttttttttttaaacagtagagaaactccagtcactattgttcatatatggactcttgtaatggtggttataggtctttacaatagagctataaggaatactctagcttgtgaatttactaatgagtctcagttgaggcacaaatgaactgatggagtttaaatggtgatttttataaggccaagaattgaagcctttgtataatttgtgccatgcccttttattttacctcttgtaatccagatagctgaccagtttttactttgggtataattcccaattg

SEQ ID NO: 50746 - DNA, 1017 bp, Homo sapiens
ctccatatttaattttaattctaaagtcatctaatttcatggaatctttgaatttgcagtacgttgaacttttaaaaaactgtaagttattaattgttcatcaagagcactgtggtggaatatcgtagttgatttctttttctttctttttttttaatgctttctttgtgtgtgggaggtgtgagattcaccatgataggcactttgcagaaaaaaaaagtgattactcttatatattttgttttcttgttaatacaatgccactgaatttttcagctaggatgtgtatattcatattagagttaaaaataaagtaaaatgtgaatcctcccaattaaagaagaactatgaaaaatataaggcaatgttgttcttccacagtgacctccagtattttaaattttttgtggagaaaaaaatgttttgctttcttaaacctcttaactatagcttaagtagagagatatgaacaatgtggcattgacatttatttttaaattctgagcagagaaagatttttatttcttacattgagtacatttaatttagtttttaacattccaattccattacatgtttttttttattgttgatattcatattgataatgacatcatgaaatttatcctcacaagaagtagctggtttatttccaggttacagccatacttcccaaagttcctctgggttctgagaactatgccagctcacctgtcatctccattcattttctacaggacagtctcatcgaactcaaggaatcttcagcaaaggtttgagtcttttaaaatcatcatgcctaagtaaaccaaatgttctttacttattttatttagtagatgtcctcaccctagtacattcagtaagctgagatcagtgggataaagtactctgcttacattgaataaccttcaaaaatattaaatgttaaaactgaaacaacagatgacagtggtcccttttaatgagattgttataaaatgtgtgtaatgtggcaacatttctatcatctctcct

SEQ ID NO: 50747 - DNA, 1032 bp, Homo sapiens
ccaccatgcgcagctaagttttttgtatttttagtagagacggggtttcaccatgttgaccaggctggtctcgaactcctgacctcaagtgatccaccctcctcagcctcccagagtgctgggattacaggcgtgagccactgcacccgaccattacttcttcctttttccttgtcttaaagttgtcctttagttttcaaaggactcccccttagttctagtatttttgaagttagtaagaaaccctttatgatatattttatcatatatcaaaggatatattttatgattatttgtgttaaaatcccatgtttttattcttaagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaaggggcaagtttacctttctttatacgttcttacgttttgttattttaatgtatagttggttattgtctccttgttttggtaagttatataggggttttgctaggggaacttgtcatacaagttggtgtttttttttaagtgtttggaaaactagaaatgtaccttattctgactatttctttttgtcttaacagaacaaaaacgccgcaaaattgatactcacccttctccatcacattcctccacagtaaaggttagtatagcctgaggaaggcagcg

SEQ ID NO: 50748 - DNA, 1228 bp, Homo sapiens
agtatctttgtataagttgaactttttgtgactacctatccaaatacgcatgatgtttttacacggaaacattgatctagtctacttaagtttcaatttctgctattttgtggatcataatttttctttaaaagtgacaaacattgtttccttaggaatgtggaaactatccaggattccttaccatattacgggcaactggatttgatggtggaaataaggctgatcaattagactatgaaaattttcgacatgttgtacataaatggcattacaaactaaccaaggtaaaaaaaaaattggatttttcaaaggcaaatttttctctgtatacttgtgcttttataataatggatctgaaaatgtttgttgtaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcag

SEQ ID NO: 50749 - DNA, 1044 bp, Homo sapiens
aggctgaggcaggagaattgcttgaacccaggaggcggaggttgcagtgagccaagatctcgccatcgtactccattctgggcaagacagtgagatgctgtctcaaaaaataaataataaataaataaataaaataatcaccaaataattactatatcttctatgatccttgatatcctcactcccttaagtcttagttgctctgttgaatctgtgccatactgaataatgaataatcctttatgaggggactgcaaggtggaaaatggaaaatatgcagaaatttaaattcagttgacatttgtctttaagccagtgactgtagtcagtaatagtcactgaaataaatttgtgtaagggaaggaatgtggaatgtaggagttttttatattaagcattttaactcaacttttttctgtgtctttttcaaattagcatgggttatgtactgtacactggtaaatttgtgtcttcccttgtgcagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccaggcaagttaaagtggcttttatgtttatgtacatgtttttaatcctgttaaaggaggataatgtgttataatttgaaaaatgtcatttttgcacatcatttgaatatgagacatcctaatgtgaaagacattctggaaatagggcctatttctatgtaaattgtgatatataagagatagctccaagagatgttatatgtaaggctgtcaattaattaaatattacatcattaaattcctgcaacttcaagttgtttgcatttatatctttcccgatctctggaaatctcagtcataacagaatagatgcttgcttgcccacttgtgcatgctcactctcttttccctttttttttttttttttttttttttgagacaaag

SEQ ID NO: 50750 - DNA, 1038 bp, Homo sapiens
atgtttaataagtcatacaagtaagttcttttgaaatcaggtccttttgcactgttctagcctcatcttttccctgcttcccgatattctagattccattaatactgaacttcttgtactttccatgaacttttgcccattattcacttgacttggaatacccttcatggcccactccatgttctgtttattcattagatttcagcttagaggtcacttcctctggaaagctttttctgttaatgctcccacccacaagtctgaattgggcgctcctcttttatattcccatggagccttttgctcatcatagttatttgtttacttttctgtatcttccactagactcagctccttgagggcaggacttgtgttttgtccaatatcatttaggtgcttagcaaatagttgtggaataggctgcagagcacttgactttacttgaatctcctactcttgtattggctggggtctcctccctattcatggtatgataaggaccattggttaaagttggtctcttgtctgcttctaggtctggtaatactttattttcttgcacctccacaactagtagcatgttccaagataaaaagagatttttttttttcttgactcacattcaggggctggcattttgtcatttattcaagtttactgagtgatctgcaagattttgttataacttagtttcacaaactctggaatcaggctgcaaagatttgacttactgctctactttgtactacgtgaccatgagcaagttacatgacatatctgttctgaatttgcctcatcaataggttataccaacctaggataatagttgcaaggattaaatgagataatcattataaagtgcttggtacagtgcttgacatatgtatgctcaataaatattggttattgttattattatgaagctccattcaacagcatcagcaatacaattattgctacctcattttgttttagaggtttagttgaaatgatacttgtgcattttgttttatgagttgtttttactctttttttatt

SEQ ID NO: 50751 - DNA, 1021 bp, Homo sapiens
atgtactgagcctacttatgtcccctaaatgtaccactctctccttagcttctcttcccctgtatatactttttgttccctctgtttgtacaggttttcccttaccttcctttccccctttccatctggtgacctcattcttggagagtgagctccagtgttacttctagtgaaggcttccctagcataaactgccagacacaatcaatctttatttccatcactattctttagcatataatgttatcatacctctaggtaccttgctatgattgttttttgaatagtttatgtgtttacatgatttaagtttcagtaaatataaaaggtataaatacagcaaaaagtctcactccatcctccatctactcagttcttcccctcaaggaaaagtaaccactgtttagtctcttatttatccttccatatattcttatgtatatgcaagccaatacaatatatattatccccctcttatattattattatattaatattgtttttctttgtaaaaatgggacctcactatgttgcccaggctggtcttgaactcctggcctcaagtgatcctcccaccttgacctcccagcgctggagttacagacgtgagctaccacaccccagccaccttttatattatcaatagcatataagtactgttctgttgattgctcttttttagaatattgaaatttaataaatgaatttaaatctgtctccttcactggaccaggcttgagagcaggaactgttactctgttattcatccttgtatttcttatttttttttttttttttgggagatggagttttgcaccgttgcccgggctggagtgctgcagtggcacgatcttggctcactgcaacctccgcctcctgtgttcaagcgattatcctgcctcagcctcccaagtagttgggattacaggcgcctgccaccaagtccagctaattctttgtatttttagtagagacggggtttcaccatgttggccaggctggtctcgaactcctgaccttg

SEQ ID NO: 50752 - DNA, 1042 bp, Homo sapiens
ttacaaccatgtgcaagttaaagttttttcaaattagaaattaattgtgacatcataatcttaacctttttgtattttattaatttctttttttaaattgtagtttcagtctgatggaagcaaacaagaagataaagaaaaaacggtaagagactagaaaaatccaataatgtgtctaatgtttgtcttgctacagtatattacaaattttactgtgaacaagctttaatcatctgtatgagtaattgttttataatgtagatgctgattatagtttttggcggcatatgcaaagttatcttttaagattaacattttttcccctgatgttgaaaaaggaagagagataaaagttcctcattcctttgctacccctttcctttcctcaccccattttatgtcttcgatggagaaacataaataagctttgtgaaaagggtgggtgaggaatgggatattgtgtgttatgttattaagaaatggtaattttcccaaggctgttataaatttattgttggttatattaatatagacctcttactgaaataacttttccttctttcttttaggaagttatccttagctgtttgcttagcattactgaccaggtactacttccatctctttctttgatggactgcaatgcttgtatgtctgaggaactatggggaatgtttaaaacatttccatatcagcataggtaaatacatattattttcatgtttttaactattagtaattctagtatattaacctctaagtgtttaacttttcctaattcttcatctcatcgttttttaagatatcgtctgtatggccagtggaagaatgaaacttataacagtcacccacttttagtaaaagttaaagctcaaacaatagacagagccaaatatatcatgaagtaagttttaatttatttttcatattaatctaaattatatctgaatctaatatactttctttcaggtagcttgtctgagcctcagttttgggaaagcctatgtgttgtgaatggtatagctgatttatatactacaga

SEQ ID NO: 50753 - DNA, 1047 bp, Homo sapiens
gaccttcatattcacttactaacttacccagagcaacttctgatcctgcacactccattcttggtgggtgtcctacacaggtgtaccattttaaatattttataccgtaatttttttgttccttttctgtgtttagataggtttagatacacaaacacttatcattgtgttacagttgcctatagtattcaatatagtaacttgctgtacaggtttgtagcctaggagccatagagtattccatatagcctacatgtgtagtaggttatgtaccatataggcttgtgtaagtatgctctaaagaggcattgaatgtatctccgttgttaagtgatacatgatatagttgagtgaatggctaagacaaatggaacatgattgtccagcagcattaagggcccatttgaggacagatacatgaaattggcattatggaaggattgtcattagtggtaataataagatttaggatatggagtaagtggttaagatagggtatagaagatctttggaagagaaagggttcaggagaaccaagaggctacatggtagaaggctcacctacatgtatatgaaaatctccaaaagttaagaattgtagtcagagagagtgacagaggctaatattgttgcaaaatgaagggcagtagactcaaggatccataaatggcatcaataggacatcactgaaagtggcatagtagggaactccagagctctgtctcgccacaaaaacaacataacgaagtggaaaaaactatcagtcaactttgctgctgtcttattcttccccagtcctttccctggttggtgtaagttttttttactatattctagagctctacaaagttaattgagagtgctgtggcattttaaattgcctgtctactagcccccacacccagatcagtggtggccatggtgatagaagcccacactcctggtgcaggttgctaatgctagagggagcaaagaattgtgtttttgggttttaatctggctacctgctccctgaaggacccacataggggcctacttttgtatctt

SEQ ID NO: 50754 - DNA, 1095 bp, Homo sapiens
tagccgggtgtggtggcgcatgcctgtaatcccagctactcgggaggctgaggcaggagaattgcttgaacccaggaggtgtggaggtagcggtgagccgagatcatgccattgcactccagcctgggcaacaagagcgaaactctgtctcaaaaaaaaaaaaaaagtcttgtcattgtgagaatctgcagttttaagggccactgagggtaggggaagaaatgtcagatatttttgaaaagttttggccttgaaggtaaagtaaggaaagctatgaaaatcaggaactgcttaggtgatgtaaccttgagagttggctcccaagcatatatggtcaatctgtgtattggtccctggcctaattcccccatacccctttcccatcactacctgaaaatgttcacaatccttttccccaactcatatgttgaccagctgggtcttatttggattaataggcttctttttttttccccttaatgctagtattattctatgatatcaacgacagtgagaggttgagcatcccaaatccacaaagctccgaaatccaaaactttttgagcactgaatgatgttcaaaggagatgattggagcattttggattttgggttttcagatttgggatgctcaaccagtatgcaaatattccaaaatctgaaaaaaaattccaaaatctaaaacacttctggtcccaggcattttagatgagggatactcaacttgtacagtagaggatttggggacagcatgagagacagcacaaaggacaggaagggagtacaagaaagtgtgaaggtaccagaagacaaacttgtctggagttgtcttgttacaggaaaggaagaggaggtgataggtctcatccatattgccctttgatttctggattcaaaacacagtaatagtagtaatggtagtaccatggttcaaccctattatacataccccaaattcattcatttaagaaatatagattgagaatctatatttgtgcaaggtagtgtactaggtactgaggctatatctgtaaacagaaattcttacttttttgatgtttagattctgagtaaattatatgttagaaaacaatt

SEQ ID NO: 50755 - DNA, 1010 bp, Homo sapiens
ttcaatccatctttcatattattgttattgttgctttcttaaagagacctaactgaggcacttcactggtcaaaaacctttacttctaggatgaaattcaaacttctaaatgtggcagaaatagcacttcacaatttggcactgttctttccggccttatctttatagttatttttttcttaaatctaatattctagtcatattaagtgactagccatttcttgaacttagatatagatattgctatgaacctttgttcctgtagttccttataactaagaaaccattcttacccaaccctctcacttctcctttcttcatcttgtgaactcctatttattctttaagagcaaatgctgcttgttctgtaaaggcttagctgactctttacccatgcagaattagtcacttcttaatctgtattctcataaaacttgacacataacttctaacacccatcagattatcttagaataaactgtatctatctcctttgccagactgtaaaccatatagggcaggtgaataaactgtatctatctcctttgccagattgtaaaccatatagggaaggttctatgttttactaattcctatggattaatttattgcctagcctatagtaaatgctcactaattgtaaacgagtgatctatgttttaggaagacaattctcttgatagcatggaggattttaatgtaataaggcctccatttaccttttggtatagctctgctaatttgtttacttgcctgggatagtcagctagtcagaaagcattcattgaatgtttatgattatgctgtttgctaggcactgaggttactctggtgtagaggagtgtctgtttctatactcttggagtgtgaggtcaggataataagataattccttttagtattcttaaatgatatagtacctactgcctttgctcatcttgtattttctatgatctgggatgctccagcagacagaagagaaagcagacgacagtttaaaagcatatagc

SEQ ID NO: 50756 - DNA, 1056 bp, Homo sapiens
tgggcagtatacattttaggtgcacatactttcagggtacttggtctgaccaggataaatccttacttatcatcctttagttaaaaggcagttatttggctggatgcggtggctgaagcttgtaatcccagcactctgggtggccgaggtgggcagatcacctgaggtctggaatttgagaccagcctggccaacatggtaaaaccctgtctctactaaaaacacaaaaattagttgggcatggtggcacatgcctgtaatcccagctactctgaaggcttgggcaggagaatcacttgaacctaggaggtggaggttgcagtgagctgagatcgtgccactgcactccagcctgggtgacagagtgagacactgtctcaaaaaaaaaaaaaaaaaaaaaaaaaggcagttatttgctcctaaaagattctggcacatcaaaatttttatattctgctggataacttggggctgtttactgcatgcgcaagcaaggaagcagaaccattatgcatctgcatggtgattgtgatctgacactaaatttgaacaacttattaaatacgaatgaatagtgaacagtagactattgagctgccaagtcatagacaccatacaagtggccatagcttgaagatggcaaaaaaacatcttttagaaattagaggaaaggatatcacaggtggactcctttgtttgctgaactaaacggtaagaactctactcttttggatgcccttcaaaaaaaatcagagcatcatgctgtacactttaaatatatataataaaaacaagtggttgctaagtgttctttcctttcctttcttctaaatcagtggtcagcaagtgtttctataaagggtgagatagtaaatatttttcggctttgtggaccatatggtttctgttgtaactacttaattctgccattgtagtgtaaaaacagcgtaaaaacagctatagatagtacataaataaatgtgactgtgtgccaataaaatgttatttacaaaaacagaccgctaaatggatttaacccacaagccatagtttgct

SEQ ID NO: 50757 - DNA, 1050 bp, Homo sapiens
gttaaattgaacttctaagcctttttataaattgtaggttgttatgtagagaatgttatttttgtattcttatttaggaagctttagtttgaatatatttaacattgtggatgcaatgctaaggaataaatgacctttaatattttttaatacagtatttagtttcagacacagttctaaaggaacgcctggatccagaaacactggaatcattagggcttatcaaacaatcacagcaattcaatcaaaagtcagttaaaatcaagacaaaactcttgtaagtacacgtatcttatgttgcagatcaagtatctgagtatgttttttcgttcatattttgaatcctagtagcttctaaggggactttgaagattgttttttttgtttgtggttagcatgtcttgtgttttttgccttctaaaagtagcctaatattgagtcatcagtgatctttacctgtgcaaaaccattgttacttttgcccatattcaaagttaaaataatactcatgctttcatcattagcaataaaataatttatgactgtggctatactcagggtatattcttagagatggaaatggtgatatgttattgttccctgatattaacaatatccttttcttgtgttactggttttccctatgtaattaatattggggttctcatatgaatcactgttattttctactctaaaaggtacacaaagaggtaaactttcaacaactattcttaggattgttgtaggttggagataagaaaattcagtgagaatacagtactctgtgcaagcttgttaattaaaattaattttatccccttaatgatatttatctgatttcagttataagcagcaaaaattcaatttgttaagagaagagaatgaaggttatgccaagctgattgctgaattggggcaagatttatctggaagtattactagtgatttaatcttagaaaatatcaaatctttaataggtaagacatttatctgtatagtatgtgttgttaagataacaagttattttagctattggagaatatccataaa

SEQ ID NO: 50758 - DNA, 1028 bp, Homo sapiens
ccatccagtgcccctgttcttagggaccttgagaggtagatcttagggactttagggccctggagcatagatacatgttgggtaaaagaatgggcccagtttagccccaatcccttaaaatcagtatctttaaagttctagactgaggagggaccagaaaaccagatagcagggcaacaattgggagtccctgaaaaggattggtgagatacacatgggttaaaagtcttaatgagaaattgagattgtattgtaatttacattgcataaattataccctaaaatttccttaatacacatgagctaactgtgtgcttagctacagtggccaggatatgtagaaatggcaactgtccaagaagggaaagtcaagggccaggaaaatgtggatatgtttgatgaaaaatccctttctcttttgattcttagtgttggcagtagaacatgtagatgacaatttttattacttcactaaaaccagtgcttctctttatagcatattctaaattatgagttgactgtaaaattaggttaatagtatataatcagttaaagcagtaatcctgagatcagccttgtttgtaatcctgccaatgctggttgaaatttttggtgcttggcatttggcactaattgttttttttcttccacacttcagatcagaaaattttttgacaaattttctgaataatttactgaaactctcagtttttaaatatttcagtaggaagataaaaattttgaataatttctatttactgactagaattataattcaagataagatgttaattttttttttttttgagacagagtcttactctgtcacccaggctggagtgcagtggcgtgatctcggctcactgcaacttctgcctcccaggttcaagtgattctcctgcctcagcctccctagtagctgtacttacagatgtgtgccactgagcccagctgatttttgtatttttagtagagacggggtttcatcatgttgcccaggatggtcttgaacccctgacctcaggtga

SEQ ID NO: 50759 - DNA, 1035 bp, Homo sapiens
tctctaattttagatctagatgaaaataactgagcacagttttcccttcagtcagtcctgtgctttcttttcttttcttctcttttttgagacatggtcttactctttcgaccaggctggactgcagtggtgtgatcttggctcactgcagcctcaacctcgtgggctcaagtgatcctcctatctcaccgccatgccctgctaaaatatatatatacatataaaatatatgtatatacacatatatattatatatacagatatatataatatatatgtgtataatatatatgtatatatgttatatatgtatgtatgtaatatatattatatatatgtatatatgtattttatatatatctgtatatatatattggtagagatggggtttcaccatgttgtccaggcttgtctggaactcctgggctcaaacgatctgcccacctgagacttctaaagtgctgggattataggcatgagccactgcactaggcccagtcttgtgctttctgtaactttgaatctaatagaagacattgccaaacattattatattcattttatttatttagttagtttttagaggcagagtctcgctatgttgcccaggctggtcttgaatgcctggcttcaagtgatgctcccaccttggccttccaaaatgctgggattataggtgtgagccaccgcacccggccaatattcactttaaaataagacatcctctgcaggtttgtgaacctggaatgaattgttttagctcattaatcttaattcttagaattagataaattacttaaatatcttactgagaatttagaatttgttcttgacaaatataaatcctggtgcttgatccttcaggaagtttcagatttcctaagttcccggtaatgttgggagtaggtcaaaatgtatgtggactgggagtgataaatgaaaagagaagaccattgatgagatgaccacatgtcccagttttgttttgttttcactggctaattattaatagtaccctcttttattctcataact

SEQ ID NO: 50760 - DNA, 1035 bp, Homo sapiens
gtggcatgttatggatatgtccattaaatccatttggtctgtagtattattcaagtcttctgtttccttactgatcttttgtctgggtattctatggaaagtagtgtatgaaattccctactattactgtgttggtgtctatttgtttcttcagctctgtgtcacatatattcatatgctgttgtcctctgatgtggtatgtgtatatatttataattgttatattttcaaagtatattttgtctaatataagcatagccacccctgttctctcttggctaacatttgaatggagtatctttatccatcctttcactttcagcctatctgtgtccttaaatttaaaacacgtttcttgtagacagcatacagctttttaaaaaaatagctcatcttaaaaaagatcaatttagatactttgtcttttgaacatggagttagatgttacatttaaggtaattactgacaggaaaggacttactattgccattttgttaattgtttttctgtgttgtagctcttctgttcctcttttcctctcttgcactcttcctttatattttattacatttttccttgcaatttgtttgtttaagagattgggtcactctctgttagattttcccacagtttggattttggtgattgtatccctatggtatctcttaatatattcctctgttgtctttttctgtaaattggtagttggatctagatggcttgatcagattttgattcacactttttttccccctaaagacaacttcataggtaggtgatgctttcttttcttttttcctttttttttttttcctgtctcccaggctggagtacagtggagcgagcagtcatggttcactgcagccccaatttcctgggctcagatgatttgattttttcaccccagcctcccgagtagctgggagtgcaagcatgagccaccatgccaggctaatttttgtattttttgttgagacagggtttcaccacgtttcccaggctggtcttgacctctgggctcaagctatctgcctg

SEQ ID NO: 50761 - DNA, 1033 bp, Homo sapiens
ctggagtgcaggcgatcacggctcactgcaggcttgaccccaccaggctcaagggattttcctgcctcagcctcctgaattgctagggctacaggtgcatgccaccatgcctggctaattaaaaacatttttttgtgcgggtgtatgagtagggatggggttttgctatattgcccaggctggtcataaactcctggcttcaagtgatcctcccccctcagcctcccaaagtgctgggattacaggcatgagccactacgcccagccaaaggaatacctcttttatactagggaaatgtaagtatctattatgcaaacaaattgccttattgtaataacctttcaatggttccatatgcaacttgagcaaatctttgagattctaactaatagttcatgatgacattgtcatctgtgtcctaatgaacatgtttgtagcctggtgactgacaatatagaattatatttcaattatttcttaaagttatgtaatgatgactgtaccattagtctaggtaggagtttgcaacactgatgcaacctcttccccgcaaccattggaaggctttttgcaaaagacatgcattaagattgttaaatagaaatgaaactattgaaaatgtgaggaagcaagtgcattgttataaggagaagttttttttttttttttttgagacagggtctcactctgttgcccaggctggagtgcagtggcacgatcttggctcactgcagccttgacctcctgggctcaagtgaataaggaggaattttaaacaattattttatttctctttctttctcatcctttccttttcctttcctctttttcttttttctctttttctatatgaaggaatatttgaaattgcattttagtagcccgagtacaaagggaaagatgagttactttattctgttaaattcttctttcaaagacatggtgcttcctgctattattattattattttttttgagacagagtctcactctgtcgcccaggctggagtgcagtggtgcgatctcgaccca

SEQ ID NO: 50762 - DNA, 1038 bp, Homo sapiens
ttcgtcattaaatgttccctaaaccccattttatcctgggactgcaactaattctggcagctctccaagcttctccagtacctaggataacgcgtttcctttagtcgtgaaactttcccccgtaacaccgaaaacagtaatttgccatacccctagtcttctcgcccccacgttagagcgctccctcctccccttcccctggaaggagtcgtttaagcagcaaagcaaacctcagatataagaacaaatattaataacatctcatttccttctctgggtcgcttttagatgctaaagctcaaccctggatgaaattaaccctcgttagccatttttgtcgtccttgcccacccctctccatttctagtagccagtttaccgtggctcatgctaaagattcaaatctttgtaacttcgttacttggaacgaaacacgaggaacgcgttgccggatcccgcgcttgtaatagtgccagcctatgtggcttcctcccccgcaccccccgcactgctgtatgaagtcttaacagtgtgagctctagaattccctaaataagcggctgtcttagccacttaagtagctgagtgaccttgggtaagttccttaaccacttggactgtttccccttgagtaaattgggaataataagtactctactcaaaggattgttgtgaagactaaataatgcctgtaaagcacttggcttatagtaagtgctcaagtgatagctattaaaagtaatattattccaacctttagatatttaaacttctcaggacagctcatgcacttaaagtctgtaccactcaggttagcaattaattggtctctgacttattcatgtgtgtttattcttgcactgtaatgaattgggaggcctttgaaatatagggactatgtctcatatttcttttggtttaacacatgccccgcccccccagcctatgcttagaatgcttattggtttattaattgtcagagaaggctatttgataaatcttcgtttttaactataatgaacattttacaaatcctcg

SEQ ID NO: 50763 - DNA, 1027 bp, Homo sapiens
atatattacctagcctcaggtatttctttatagcaatgcaagaacagatttaacacagaaaatggtacctcccccacccttgctcctgctctcaccacataataccctggcttcccctttgccttctaccatgattgtaaactttctgaggccctcactagaagtagatgctgatgccgtgcttcctgtagagcctgcaaaaccatgagctaattaaattgcttgtctttataaattacggagtctcaagtgttcctttatagcaatgcaaaagtggactaacacacctagcctgtaacgtttctgcaaacaagtttgctgctaggtgtattggaacttccttatttgttctttgcttcttttcttttactgctttcaggattctctctgtttttgatttttgacaatttgattatatgtcatgaggtagtgttatttggattgaatctgattggaaacctttgactttcctgtacctggatgtacatctttctcaaggtttggacgtttttctgctatcatttctctaagctttctactcttctatctttcttctctccatcttaaaatccaatgaatcaaatatttgcttttacaatgctgttccataaatcccattgacattcttcattccttttaattctttttttctctcctttgactagatactcttaaataatctaagttcacatattatttcttcagcatgatcaattctgttgttgatgttctctattgcgtttttttcattgtatttttcagccccaggatttatctttgattctttaaaaattatttctatctctttgttaaatttcttattctggttactttacagtttttctcatttattttaattatttatctgtatttttttaatgtggctgagcttccttaaaatagttcttttgaattctttgccaggtagtttgtatatctctgtttttttatggccagtcactggcactttattttgtctccctaataatgtcttgtttctctgattgttcttgatctctgtggccat

SEQ ID NO: 50764 - DNA, 1054 bp, Homo sapiens
aggtctaaagaataaccataaaaataaaaacgtgattctgctgagacagcattagaaaaaaataataaatgaaaactaaccctaatcaaaacaaataacatatatccaagcatctcaaacctttaaaatgttgtaaaggtagaactcatgtctatttacctagccctatgattgtcatatgttctaaaccaaaaattaggacacatagtccaacaaagaattcattttcagatttgtattctgatttatagaataagatacatggaagcataacaattaagttgcatttagctatacattttctgagtcatctttattgagaagaatatgggacactataaagttgaactatcctaaagattagggacatgtgatactctacacttttcttttgaataaaagcatatcagtaatctttgaatatccttgaaaagtaccaagatagaaggttattaacattcattgcaatgttaataactttattccagaattttcttttgtttctgttgtataacttcacttgtagaacacccattaatgcaataccaagcttatagaaacacatgctttatgtaatttttagtgtcggtaaaagtgatattcagagggagaaaagataattagccccagggtttgatagacatcatttagtagtcatcctgttaatctaaaatcctacacataaccaattaaccattgtaatgagaactttaatttttaaacttcctatccaatttctttcaatcattgctgccaagcatttgaaagccagtaatgcagaaggtgctttataggcctgtgttagaaatggtcacatccccagggagctaaaatcacaacagatcacacaagtagagtgatctgctttttattgtgggcattagataacttcagctttgaaaaaagttgtgttaaggatgaaacccagcaacttttagtgataaaaaaacattttgcaaccattgttcatagaatacacacccaaggccatttttttccttgatcttttgaaagaaattgtactatctgaaatgaattcagataaaggagattg

SEQ ID NO: 50765 - DNA, 1028 bp, Homo sapiens
tgacaagaaaggccttttctctttggtaatccttattttattccatgcatatgtcccgaatgcttgatggcagattactagcctcagtaggcttcctattagattgttagcttttgctaaacccattttccaggggaagagggttttcctaaaagcttaaggagttctttttaaatattgtttttgtataacttactccgcatcagttactatactagtgctttactttatatcacttaatcttcacagtaaccctatgagattagtttggttactaacatcctgttgttactttaaaggaattcagaagagcaaaggattatgctcaaggtcatgcagaaaagttgattcctgacactagtatgactggacatatgtagaagaagatgtaagaaatacttggacttaattattgaaataatgatttaaaacagatgtatctatggcccagagaaaatttaattaatggtaacaggatgtgttgtatgcagtgaggtgaggctaggactttgagcagtgttttgcccagtagccagggatgggttgcacctctcatctgctccctctggttgggagctttttcaattttctctcagctgatgttttcaagtttctgcctgcctcagtattttatgtaatcctgacagtgcaaaaactcagtgtgcatgtggtaagcccattctcatgcccactgacctcagctgctcctactttctccaggtgtactcaatctgcagacctcatgattcctgtctagttgatggcataaactggaaagcactacctagccatattaatgtgctgcttgaaagtcagaggaagaagggagagctgagtaccccactagcactcaccttccctaattccatcttaccttgtgacccttatctcctgcctccctagcccatatgttagctctattctcttgggagctgaaacctgtcactcaactcctaggttttgtgaaatcttttcttcaaactgtctggaaccataattccttatactacatctttaattgtgggtat

SEQ ID NO: 50766 - DNA, 1032 bp, Homo sapiens
ggttcaagtgattctcctgcctcagcctcccgagtagctgggactacaggtgcacaccaccatacttggctaactttttgtattttagtagaaatggggtttcaccatgttggccaggctggtctcgaacacctgacctcaagtgatctgcccaccttggcctcccaaaatgctgggatgacaggcatgagccaccacaccaagcctgtagtggtattctttgaatcctttctatatacatttgtgtatctactgtaaatttttgctttgtggctacccaggggcttagaaaaactatcttgtagttataataggctatttcaagctgatcagaacttaactctatctcgtacaacaactctacacctttaccccccatcattttatgtttttggtgtcaaaatttacatccttttgtaacttgtatccattgatgatttattttagctatagttgtttttaatagttttgctttttaaacctcgtattagagatcaaattgctttatgtaccaccattacaattctagaatattctgaatatggctctgtactacttatattattgaattttgggctttcatatgttttatgttgttaattagtggattttatttcagcttaacaaaattcctttagcaattcctataaagcagcactagtggtgatgaagtcccttagcttttgtttgtctgggaaaacttttatttctccctcatttctgaaggacagctttgccaggtacagtattcttggttggcagatttttttgtccttcagcactttgactatatcatgtcactccttcctgctttgtaagacttctgctgagaagtccgctgatagctgtattagaactcttttgtatgtgatttttaaaaatttattgctgctgtcggaattttttctttgtttttgatttttgatagtttgatagtttgtgtgtcatggtgacctttttgaggggggttgtatctgattggaaacctctatattctctatacctaaatgttagcatcttttcccatttaag

SEQ ID NO: 50767 - DNA, 1057 bp, Homo sapiens
aaaattttcatttgaaaatacttttctttcagaacttgaaggaatggctcaattgtcatctagcatccaatgttgcaaatgagaaatatgatgccaatctgattattgtacctttatagatcaccattgttttttctttttggaagcttttaacactgctttattttttggtgtcctggaattcatagtgatgtggcttgttgggtgtttttgatttgtggcattgagcactgagggggatccctttgatgtagaaactctattcttcatgcaattctataaaattatcttgtataatttgttccaataatttctccctctctgctttctctgtctcttttctgaaactgctgttaattagatttggaatttttggattgaccctccatgtcttttatctttttgctcagatttcccatctctttgtcttttccttctattttctgggaaatgtccccacccttatgctcaaacttgttactaaattttattttgaaaatcacattttaaatttacacaacctctttcttgttctctgattggtcctttatcatagcatttcgtccatgttttggggatgcaatatgttgaatctctctgataacactacttaaaattgttttgttttactgctgtttaagttctctttattccctgaactattgcagttgctcttggggtcatttttctgtttattattgatctctttttcattacaaattttttttcaaatgcctggtgatccctatgtgtcttcatatataacaataatgcaataaaatataaacaactgcttgagagctctgtgcttgggtaaagcttgtcaactagtgggtcactttaggctgatctggtagggatccctcaaggaacataaggcagaggcgtttgctctaggactatttaattcctccagagagtaatcctcctttctcttgcctggaatagaagcctggtaattatattcttttgtgtggggaattggagggtgaggagagacaactgttccatatacagacttttaattaatctcagtgttgtcagttccacgcttcac

SEQ ID NO: 50768 - DNA, 1064 bp, Homo sapiens
aaagagcataggttttgggaatcaaccaggttgtaggcctggtttctccacttaactagctaggtgagcttgacacattatctaactttcctgagcatgcatttgcctaactctgacgtgaggatgacatactcagggctgacactgagttgataccagcgtgggtggaacagttgtttatagctgagctctatcagagtccactctgattggtgggtgcctatgttgtactggttgttaagtatgttgattatcactattaataggacttaatgggtagggttattggaagcataaaatgaaatgatatatgtggaattcctggcatacaaatgcgactgacttaatattagttttatttattttcctgtatgactttaaaaaattgtttttcaacctaaaggtgagagaaaaatttctggcacttgttatcactgtgatgttaagaggttaaggaactgtttatatcttatatttattcaggatctattaaacaaatatgaagttactactttatgctaggcattgaggatgctgggcgtaaaagggtgaagatggcactgtccctaccttgtatgcattcacagtctaggaggagcagtaaacttctgatttcaatccaaacaaccctgagagtcaacatgaacctgtaaggtcaacatttgtgcagatttagtagagttctcctctaggcaggtacagcttgcttagcagctgagctcagggtggattttaactcccccttactccctcatctgtgtgccctgtgcagtgcacaacctacacaattacacaaggccctgagaacgttataactgatgtataccccaggtgctataggcctgtagtggtaggaggtactgagttttgaaggataaatggcatttggccaaatagagatgaaggagaaagccttagcatgtgtgcaaagacagagaggtatgaaagaactgggagagattagaggaatagtgggttttccaaccagacaatatatttggactcttggtattgaagaaagtgatgacaatgtaagttatatttatagactctttaagtataca

SEQ ID NO: 50769 - DNA, 1024 bp, Homo sapiens
tgagtagctaggactacaggtgcgtgccactgcacgcagctggcttttttagtttttgtgaagacggggtctcactgtgttgcccaggctggtcttgaacacctgggctcaagcaatcctcctgcctcggcctcccaaagtatcaggatcacaggcatgagccactgtgcccggccacaattattaatagttgtatttaaagagaccagcatagcacgtgacccagagtaggcgttcagtgaataaatgggcatagaactgttgtatttaagtttgcttctatcccatagactcctacagttggaccagatttggatagaatgcgagcaaattatgccagtgggttggagttcattttacttttcctttaatctacctttttctaaggttagactttatttggctatcatccctgcagcttttatttattcataagcttgaatagccagttataaatgtcatatgttttattatgcagcaatagtgttcgatttggtaccttgaactgttgtaacaatctgacatgaaatacaattaatgcactaacaggagttcatttaaggtatttattcttatgcgttatcttgtgaggaagtgataacaacattttctttttttctttttttgagacggagtcttgctctgttgccaggctggagtgcagtggcataatctcggttcactgcaacctctgcctcctgggatcaagtgattctcctgcctcagcctccccagtaggtgggactacaggcatgtgtcaccacgcccagctgatttttgtattattagtagagatgaggtttcaccatgttggcccggatgatctcgatttcttgacctcatgatctgcccgcctcagcctcctaaagtgctgggattacaggtgtgagccactgtgcccagtgatacagtattttctaaatagcaatgcttaagcagcagcagttacgtaaaagcatcataacatttaatacttgtttgtgaaatgtaggatatgtttatttgaatattaactctcatataa

SEQ ID NO: 50770 - DNA, 1034 bp, Homo sapiens
tctttccattccattgaactatgccataccattttaaatattgtagttttacatttttccttggctattttgacctgtttattcttcttgaacttagtaggcccaccgattaagattttatttggaaaagcagtgtctctgcttttaatgagctgagtgaggcaaatcacttaacctctccatgcctttgtttcttcatctgtaaagtggggaaaagagtatctccttttgcccaagttccagggaaattgtgaggatcaaatgagatggttatgaaaacattttgaaaaagtaaaaaaaaaaaaaaaccctatattttttacaactgaaatagacaatgatcctggaggtctttgaattaggtattatagggatggtggggttgatttttgttctggaggcttttggctttggactctctctttctcccacagagcgcttcgaccatcactgcccctgggtggggaattgtgttggaaagaggaactaccgctacttctacctcttcatcctttctctctccctcctcacaatctatgtcttcgccttcaacatcgtctatgtggccctcagtgagtatacagggcagtgtccgttgttggagtggggctgggtgggggaagagttaagggcagcttagagggttgttgggtttcctggtggtaccattgtgaaaggtactttaggacaggttagaaatgagcacagttatctgctcttgagcagggttgcaaacctcagtgcacatcaatgagtattaatcagtgtgttggccttctctttggccaactgctgggcactggggccataattactggtctgtatccagagtactggggcatttctgaggtaatcccaaaggctggggatgtattttgtctcggagcatcctctcttcttctgccttgtaaaacttgccttgtgctaaggggtagaaaagggtaagggttttgcctgagaaatgtctttttgtagctcatggtctagtttgggagatagaaagcacacccacatatgtacatgtgcacaaacat

SEQ ID NO: 50771 - DNA, 1031 bp, Homo sapiens
ttggaaggcaatctaataagattaatcgaaagccttaaaacatctataccttttggtgccagtggttcactttctagggagtctgtcccatgaaatcagagatgtgggaaaatatttcggggtggaaatgtttaactcaggattattatgacaattaaaagttgaaaagaacctaattgtctaccaatagatgagtagccaaataaattatagagccgggtgtggtggctcactcctgtaatcccagcactttgggaggccgaggtgggcagatcacttgaggccagaagtttgagaccggcctgagcaacatggtgaaacctcgtctctactaaaacatacaaaaattagctggacgtggtgacatgtgcctgtaatcccagctgagaccctggctgaggcatgagaataaaaaacccatgaggtggaggctgcattgaaccgagattgtgccactgcactccagcctgggcgacagagtaagactctgtctctaaataaataaataaataaataataggacattcgtacattagactgatggaaagagttcataccagaaagctaaatgacaaaatgggagataggctacatttacagtgtgaagtcagttacctatttttaaaaaatctaatgatgtataaagaaatatgcaaggaaatacaggaaatatgccacaatttttatagtttattatctataggttgtgggattatgagtgattttgtttccttcattttttcatatgccatcctccactactgtgatttcttcatttttccttttatttttttcaagttttctacaatgagcatgtattacttgtattatcagaaaaaatgtgatttaaaatactgtaaaaaatatatatctgtataaccattcttctctatacctttcttccctttcctgaaaagatgtagcttcctcagcaggagatagaccatttttacagccttattttttcaccagtacacagctcacttttctttcaaattgatatattttattcttttttttttttttttttt

SEQ ID NO: 50772 - DNA, 1081 bp, Homo sapiens
aagtgattctcctgtctcagcttcccgagtaagctgggattacaggtgcatgccaccacgtccggcttatgtatttatttatttatttatttatttatttttgagacggagtcttgcactgtcacccaggctggagtgcagtggcacgatctccgctcactgcaagctccacctcccgggttcacaccattctcctgcctcagcctcccaagtagctgggactacaggcacccaccaccacgcctggctaattttttgtatttttagtagagacggggtttcactgtgttagccagggtggtcttgatctcctgaccttgtgatccacccacctcagcctcccaaagtgctgggattacaggcgtgagccactgcacccggccttatttttgtgtttttagtagagatggggttttgccatgttggccaggatggtcttgaactcctgacctcagatgatccacctgccttgacctcccaaagtgctgggattacaggtgtgagcgactgtgcctggctgatctaatctttatctaagacaaattagtgatgtttgaggatactcctgactttggaggtctatattgggaattaccaccaaactttcacgtagcttattcttgtcagagacagacttccagcttatagcaattatgggattagtctagggtgatatttttgaagtattttttaaattgacaaatattttatatatatatataaagatatatatacaaagatatatatgtatacaatatgatgttttgatacatctatacatttggaatagttaaatcaagctaattaacatatgtattaccttacatacttatttttttaatggtgagaacgcttaaaatctactctcctagcaattttctggtatacaatatagtgttattaaccatagtccgcatgttgggcaatagatctcatgaacttattcttccttactgaaattttatgtcctttgacaaacatcttcccaatcctcccttcccaatacccccggtgggggtattttttatcataacttttgaagacaaacactatgggttgtagttcacaatagtcttagtgg

SEQ ID NO: 50773 - DNA, 1078 bp, Homo sapiens
gagggaggttttataaggacagaaactctactattatttttagagtccttttaatgatgttgaaagaacactgtggcatagtggaacatgcccttgactggaagttagcagtatcagcattgctgctgtgtggtcctggataagttatttcctctctctggtcctcagtttactcatttacaaaacaaagtattaataattggcacgatcacctataaaatcctctctagttccaaggttctgtgatgatcagatcatcagcattagattggaagcatagaggcttatttaagaagaaatactagcccctttccttttttgagaaccttttatcataccttcttttagagaacaaacacgaattggaaataaacttttcccacttccccgtccccaccccttcagtcagttttcaactttctgtctctgggaaaggagggttgaactgtattttcttattattgcctcatttttttttctttttctgctttttcttagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgagtttcggttgagtagagttacctgattatggttactttgggtccaggggaagaacctgctttctggggagtttggggctggtccttggatgactttaacgtcctcttgagcgatgtctgtagagatgccagctgaattcattgcttcgtggtcatcacagagtatgtacttcctaaaaagaccaatacctttgataccaattttgtagtactgatttggggctgtccttgatagacttgggaaataagaaagtttgtcttaattactcacctct

SEQ ID NO: 50774 - DNA, 1026 bp, Homo sapiens
aggagaatcacttgaacctcagaggcagaagttgcagtaagccaagattgcactactgcactccagcctgagtgacagagcaagactccgtctcaaaaaaaaaaataaattaaaaattagctgggtgtggtggcacacacctgtagtcccagctacttgggaggctgagtcaggaggatcgcttgagcccagggcttcaaggctgcagtgagcagtaatcgtgtcactgcactccatcccgggcagcagagtgagaccctgtctctagaaaaagaaaaaaacaacaaacagcaaataaatcgacaaacaccttcagctccattcctctcgtgccctccttcctaaccagctgagggacacttcctgccttaaccaactctgttctctgtttcttctcagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccc

SEQ ID NO: 50775 - DNA, 1035 bp, Homo sapiens
gtcgcaggcagggtctggtgggggtggggtggtggtgggaggagtgaacctggggcaagggctgcagtttcccaggcgcctcctcccagtactcagcctctcactcgtccaaagggaaattcagacctgagaggttgagttgagcgacttctcccgactttttgttggggtgggtggaaaggtgtgggggtgagggtgagggtgggggtggggcaaaggcacggccagccctgtgggctaacggaaaggaagtaggagaggcctgggtgtctcctgtgggggagagcggtcatcagggaggtcaccgtggtccccctccctttcctcccctttgcccctctctgaagttcctcatttctttccgggccaggataaggtttgcccaccccggcactgccaagggagtgtcaaggaggtggagtgcagtgtgtggcttctgctatggtgcatggacacacccacacgcacatccacacactcagaaccgagcccaggggaccaaagacgtggcgcctggaagtggagaagctccagtgatggggtggaggagcagagctggctggcgaggagggaggtgggagggctggggctgtgggaggcaggcctgggtgtgaccacccacaacacgcagatgaggcgcccgggcactgacagccctgaggagtggcgacagggggaacaaatgcaggcccggacgccatgtgacaccgtgagcgctgagggcacgtggggcgagaggaggtgtgtttgggctgcggcagacacagaagatttcctggaaaaggggcctgagccagccccagaggatggggaaggttccgcctgcccctcctccagtcggggctctcctcaccagttcccagggtgacagttcactcttgaaactgaaagcaaagctaaaccaagaacacaaacccacacacagcacagaggccacgctctctggtgggtggcggcggtagtggtgagaggggggtgctgacgaaaacagggtatgtggcccacctgtcccccagtctccaggctctctggagg

SEQ ID NO: 50776 - DNA, 1064 bp, Homo sapiens
tggctcactgcaacctccatctcccgggttcaagcaattctcctgcttcagcctcctgagtagctgggactacaggagggcgccaccacacctggctaatttttgtattttttattatagacaaggcttcaccatattggccaggctggtcttgaactcctgacctcatcatccgcctgcctcggcctcccaaagtgctaggattacagacgtgagccaccacgcctggccctaatttttgtatttttagtagagatggggtttcaccatgttggccaggctggtcttgaactcctgacctcaggtgatctgcttgcctcggcctcccaaagtgctgggattacaggcatgagtcaccacgtccagacaatttttttgtattttttagtagagacagagtttcaccatgttggccaggctgatctcgaactcctgacctcaagtgacctgcccgccttggcctcccagagtgctgggataacaagcatgagccaccacgcccagccgtggcttcattgttattggccagccctgaatctttgactgctgtgtgttcttgccagaggaaagggttgcttttttgaggatgccaggagacaatgagcaaggaaggaggcaaggaagaagagtcacttgggagtcacagtgcaactagctgtgtcaccttgagcaagtcacttcctctcctatggtagcagaagttggatgataagagggatggatgcaatgatctttcaggtctcttataactttgatatcctgggactctgactcaaggagaggtgttttttttttttttttttttttttttttgagctgaggtctcactcttgttgccctggctgaagtgcagtggtgcgatctcagctcactggggcccccacctcccaggctcaagcgatcctcccacctcagcctcctgagtagctgggactacaggcgtgtgccaccacgtctggctaatttttgtatttttttttttagtagagacagggttttgccatgttgcccaggctggtctcgaactcctgagctcaagcaatccacctgcctcggcctcccaa

SEQ ID NO: 50777 - DNA, 1031 bp, Homo sapiens
ctcactgcaacctctgcctcccaagttctagagattctcctgcctcagcctcccgagtagctgggattacaggcatataccaccatgcccagctaattttgtatttttagtagagacggggtttctccatgttggtcaggctggtcttgaactcctgacctcaggtgatctgcctgcctcagcctcccaaagtgttgggattacaggtgtgagccgccgcacccggctgcttttttttttttttttttttaatagagatggatttcatcatgttgtctaggcttgtctcaaacccctggcctcaagccaccttcccacctcggcctcccaaagtgctaggattacaggcgcaagccaccatgcccggccccttgcagtactttctaattagaacctcagaggttcagaactggctgagcctttagcaaaagattaccaaactcgcctacttcactttacagatagggaaattgggatccagagaggggcagggacttggccacattaatggaagacctgaaattaaagtccttagttggaagtgttttccactgcttaccccaaggaaagcagcttgcataaggttggacctgccatgcatactcagtgaccctgtacttacccttgcctaggattatagggaggctgggaggaggaaacagccttggagccatcaaccagaggaccttagcttgtgcatggccttcagtgggccgctgcccttctctgggcctcagttaaaaaaaaaagacaactgctttattagatatagttattagatatagttcaaataccatataattcatcctcttaaagcatacacttcagtagtttttaatctattctcagagttgtacatccatcaccagaatccattttagaacattttcatcacccccaggcagggcatggtggctgacgcctatcacctcagcactttgggaagctgaggtgggcggatcacttgaggctaggaatttgagaccagcctggccaacatagtgaaaccccatctctaataaaaatacaaa

SEQ ID NO: 50778 - DNA, 1032 bp, Homo sapiens
tcatattttcttttataggttttataatattagtctttacattttagtctatggtctgctttgagttaatttttctgtatgttgagtggtatggatccaaattcttttccttccttccttccttccttccttcctccctcccttccttccttcctccctccctccttctctctctttctttctttctttctttctttctttctttctttctctctctctctctctctctctctctctctctcatctttatcttgctttcttgctttcttctttctttctttttcttggtcttgctctgttgcccaggctggagtgcagtggtatgattatggttcattgcagccttgacctcctgagctcaagtaatcctaccaccttagccttccaagtagctgggaccacaagagtgtgccaccatgcccagctaattttaaattttttttttgtagaggtatgttctcactatgttgcccaggctgatcttgaactcctggcctcaagctatcctcccagcttggcctccctaagtactaggattacaggcgtgagccactgcacccagccttttttttctttttctttatgcatatgaatatctaattattctagcactatttttgaaaaagctatcatcagtctactaccattgtctatatgtgggcccatttctgcactctattcaattccattgattggtctacttatttctctttacattaacaccaactgttttgattactgtagctttataatcattcttgaaatcaggtagtattagcctttcaactttgcttttgtttgaagttgtttttggctagtttaagtcctttgcgatttcatgtgatttttagggctgacttgtccataacattttcttttaatatttgcatttatcccacttgcgttaatttttgttgtaacaaatatgtttggtgttttattttattttgagatggagtcccactccgtcgcccaggctggagtgccagtcgtgcgatctcagttcactgcaacctctgcttcctgggttca

SEQ ID NO: 50779 - DNA, 1051 bp, Homo sapiens
gctgggaaaggccctgggcagccttctgtcctcagggtagggcctgaccccaacccgggcttggcatctctcctggatttctaagctgcaaagaggtttctggcttctcttccaatttattctttttgtggttctcagactgaaaactacttctgcaggggagaaaggaaactcctgcaaggcacccagaatcccataggcgctttcctaggggtcaggggcttttctcatcaacaccaacctgcctgcaaatctctggccgctgagcctcgtgtgtcctgtaatagcagccacactgctaatgccctgtagctcgggccccagtgctggttgccaagaaactgctggtcggggtgcttatgagggttctgacctcataggggctgctgagtttcaattcaacagacatttattaatacctactgtgtgcccaaccgatgctaggcgccgtgggggagatgagagaaggaggcgctggggaagagatgactaagacactgaaacaatcagaggcgaggacaagcagccgggccagtggctggtcaggtgctaattgtgcttgttggagcagaggccagcacggctgggactggaggtcagcagcagctggaggagggagggaaggctttgtgagggatgcgggcctaggctagaccttgaaggggggagagggggaagcaagggggagatttggctcagcagaaaaggaagaaaagacgcctttctctctattccctggccacgaactgaccttcgaagcctggatgattgtttggcaaatgtgtgtcacataaaagaccaggtcagctagtgtgggtggctcagtgcaaacccctgtctccactccgggagatataaactggctggccagcctgccacccaagctgaggggatttcgtttgaaacccctcccttaccagacacacacacacacacacacacacacacacacacacacacacacacaggcccctggggagtgggagagatggcaggggagacgtagggcacttaaatgacaggaaaactgacatgccacttgtgctcatgg

SEQ ID NO: 50780 - DNA, 1031 bp, Homo sapiens
ggttataaagtgctttctcaaccattaattcagattcagtgcatccagtacaggagcagcgtagggggagctctctggagttcagtgaagattatcagggaggacttcctatcccagccagctggtgtgaggaagaggctaccttgcatctggttgtttttggggctggattcagagcctgggatctcttgttgggggcaggggtgggggggaccatgaagcaggctccatgctaccaccctcacccagcctcttgctgtgagccgaaggagtggcttgtttgcaactatgtctggcattcctccctgtgctgcactgtttgctcggtggttgctcaggaactggcgcccacccctggacaacctaggggcccaaaattcactctccctcacctagtgctaagtggtgacacagtggcttctgtcttctctggcatatattgggatctaaaatagagggtgctgtggtctgtctctaggggcctgagtgatagcatgtccaaaatgcccctcatcttgcaaaaatcaggccctgtgccgcacagacccagctagacacaggctgaggagtttgctttcctggggaaacctctgctcttctgctcttaagcttggccttcttcctttccacatcccctacccccgcaatgtaattttacatccagtttttgtttttgcgtttagagtgttgttttttttttggtttttgttttttaattcagggtctcactttgtcacccaggctggagtgcagtggcacagtcacagctcactgtaatcttgaactccttacctccagttctttttttttttttgagatggagtttcactcttgttgcccaggctggagtgcaatggcacgatcttggctcgccgcaacctccgcctcccaggttcaagtgattctcctgcctcagcctcccgagtagctgggattacaggcatgtaccaccacgcccggctaattttgtatttttggtagagacggggtttctccgtgttggtcaggctggcctcgaactcctgacctca

SEQ ID NO: 50781 - DNA, 1030 bp, Homo sapiens
gacctattggatgggacaagcatgttaataggctggacgggggtggtggggagccctcatgcctcatgggaagctatggaagatcacatctaatggcttcatttgtttttgcaatacaatagaacataagatggttatctgagagcgaacaccgtgagggttgagtagcgggattggattgaagagggagcttaccaaggacaaatcaaaggaggctaaagaagctgcttatccatcagatctcagttcatgtcattgcctctagaaagctttacccaacccaacctgactagattgcacatgtcatatgttcccagcgctacctgcactgttcttaccacttacatcacatttgtcactcttgattattgttagtgcttgttaaattgtcttggccactaaactctgaaagcagcaaggatcactgtctcaacttgatacatagtaggtgcttaattgaatggtctcagctagtaaagagtggtgcaaagactggggccctattctctctgactccaaagctcaagctcttaaccataagaaggagtagggtgcaagggaattaaaggtactggcaaaagaacagtttgggtgttctaccattggcccaaattagttagaatggagcagctagtcaaataaacagagaaaattgaaagcaagcataggagacagactgagcgaaagctgaagggatggaaaattgtgaccaacaagtagaataattgaggtaggaggagaggtttaggagataacaagatgaggaaaagtatgagccaggttccaaggtcttcagtgaatcaggaggagtagccaggaggtggctcaaaacagtgattcgtaggaatataggactcctctgatgtccctcagaagagaatgaaagtacaagaatctggaagcagcagaccagtaacctcaagaagcttgcagaatgccaacacctcctcctggccttgtgatgtggagtgtgggggaacgaacagcctctatgtgtaagctctccttaagagagagccaagtttccgtg

SEQ ID NO: 50782 - DNA, 1029 bp, Homo sapiens
acattacctttcatgcaagattgaactgtgtcctggttagagtgttgcgttttattttgtgcaagattggaaccatctagattactccttaaatggttgttataatgtcccaggtagcccatggttaactttgtatatctacctattcagtcatctctctgtgtttacttaatttatgggaaagacatgaaggaagaggtatttgatgaactgttcgtgtttttcatgatcttttctggaagctgaaaattttctcactggacagcattaaattttactcttaaaaacttcagcaacttaagagcgttcattcagctgtctgtagtatttatatatgcagttttgatgatatttttcttgatcatttaacggtgaatatctgtgggcaataagtcttgtacagtgcattgacatttaatcataaatatgtattaactattttatttttgtatgtgtgtgtcttaataaattatgtttcttaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgtaagtagaaaagcagcgtgtataaagaagctgccaaacagctcccattaatagactcgatagtattctgctttaaaacttttgcaactaattcccctttctccttttggaaaaattttcaaaaagccttctcttaagtgcctgctgcctaatatcttatgggagccaattctggaatgactgaaatttaatctcatgttgattgatttctgctcttttcacttgtctttttcttctttacttgaaagccactatgttttcctagattcgagtaacccacaaaattgtacctgttttcttggatgtcacacactaacctgtgaataaagtcaaaatccattgcagctccttagcacaatatttgattttgacctatttgtcagacattttatttcctcagcttg

SEQ ID NO: 50783 - DNA, 1051 bp, Homo sapiens
gataggtgtatttgagttatgtcctgggacatactgctcttggaacttaaaacctctgcttagcttttaaactaatgccttatcaatggatgtcatctttgagggttttgtgtattgaaatgatggtgctctgtgcttgttgcacagaaattgagataacctgaattttttttttttttttttttgagacggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaatttttttttttttttttttgtatttttagtagagacaaggtttcaccatgttaaccaggatggtctcgatctcctgacctcgtgatccgcccacctcggcctcccaaagcgctgggattacaggcgtgagccaccgcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcatacacttgttctttgtcctttggccgtgcaccaaagtatgacatcatctgcctttaaaaatgggtgagggtagtgttaaattttcaaaaagaagttctgatactctcattttaggaattaactctgttttgtggcttgattcctaactgcttttaatctgatttctttttcatgtagtagcatctaccgtgtgtttttgcacaggtgggaaagagcaaggttcgtttatacaccatttctccctccaccttacctttaaacttttttttttttttttttttgag

SEQ ID NO: 50784 - DNA, 1031 bp, Homo sapiens
ctcacccttaaaaactttggcaaaatctttctagggtttccaccaacagtgttcactcagatgttaataagtgttcccctcttaacttgttcctggtaaaagaaatttagtgaatggctggatttacaaaattcatagaggtgttttttgtttatttttaacaacaagacttttcagagcttttaatatgctaatactgtaaatctctaagcaagggacatagtgtgtaatagtcctcaaacatttttaacctttgagccctttatttgcacaatacctattaacatttcttgaggtatagagtttgggaaacactattcttggtggtctgtatttcattttttggccttcaattttgaaaagaagaatggaacataaagcagtatctctgactgtctaattatgggttttttaacataattctttcccctgtgctttactaagctccagagtgatatagatgtagatttgaagggagtgataacatgcttagaaaggtaagaaagacataatgaacccactttgtgagctgtgtcttataagtggtttatctgatctgtagtcattcttcatatcctaagttgtatgccttaacttgctgtatgtattggaaagagttacccaacaggtctgagttgctcaaatattgcacaatttcagaagtgcctgcttgtataactggcccttggctaaatcttggaaattgagcttctaaaatgttctctatgttattaactgataagagtggtttacatgcctggaaccttgagccatgttgtaccagttagtcaagaaaattcgcacaaaaaaatacggttatggtgaccacctgcttttcttgcagtgggaggagtcgtctgaaaatttggtggcttacctccataaaaaacctaagctcttagactcaagagagctttcccatcaagcaacactttatacgtgttgctgcagttcattgctgagggattttatacatgttgctgcagttcattgctgagggattaagtgtgtcctatgtgactccattggaa

SEQ ID NO: 50785 - DNA, 1031 bp, Homo sapiens
tatatatgagtctcccttgtttctttaaatctggcattgcctggctttacctagtttcttaccccatagataatcatgtgttaagtacctactacatatccaatacactactgtgtgtaggaggaaatacaaagaaagaaaatatgtttttcactctcaaggagcttactttggagttgaacatgtataattaaggcacactaagaaataggcagtttgagatcatatatattaaatcttgaattgcatagcatagactgtcagtgcagtaagaggttaaagaaaaacaaatctaatggtttgctgaggaagttataattgaactaagagttggaaaggggcaaagaatcaatttggggggatatctgtttgaagttagatacttattaatatggcattttcctgaatctctgttaccacttctattaggtagatattgtgctcatgttagaggtgagaaaatagattcaagtaatttctccagagtcacataattaaaaatggtgcagtgaggatttgaactattcaatttgatgtcaagtgcatgctctttccactatactcgaatgatgtggacagtataaggtaaggagaaagggtattccaggtggaagaagcagtacgaatgaggacttcaaaggacacaatgagtgcggtattttcaagtattcagaatatacaaatactgaaatatgaattaatacttttaattgtctgacttacaacattctatgtaatgttttttgaggtatttggaaaaaagggtcagttcataatattggttacatttgggagaatttgaagattttttgttttgggggtttctttgtttggtaggcagactactgaacatcaaacaatgttatgccaagccatgatatctggcatatctgtatagaagaggaaatcaaaatgttttaaaagaatggaaccaatttgttaagaggttttgtttgtgtactgtcctcaaatcattgttttcaagttttacatgttaaggccatgctaaaggatggccttaattttgagtc

SEQ ID NO: 50786 - DNA, 1023 bp, Homo sapiens
tctcattaaatttgttttttaaaagttattctcattaaaagtatttttattaacttgtaatgggcttataaatattttaaataaaaacatttgaaatctgtctcagtttcaatttctaatatgggaaatatcaacacatattgtccatataaacataaagctcattggggttctcattaagttttaagtgaaaagaaatcctgggataaaagagtttgagaactactgatgtgatgcagtttatttatgatatgattttaattgagctcttcatgtgaactagatttgttttctttaagtgcttgtattcatcaacttaacggtatgacttcaggtaaggaaggagaagttgagaaaaatagtgcaaagtactgttgaggaatatttcacttgctttatttaatgttcacagtagtgctgcaaggaaggtattactgttttcgttttacagatagaaaaactaaggcttacagaggttgattatacttacagatttggcagccaggaagtggtagaccagaaattcccactcaggttgtcagcccctatgtccagtgttcccatcaatgcacttacttacattttccctggtggataagttttactcgtataaaaagcaaattgattaataatacatacttcttgaggttactttaggaattagtgattatagaatatcttatgaaacttacataaaatatttactatacagattggcttcaaaaggccagtaattgtacattagtcttttccccatattatatcttttacatatgaattataataaaagcgtatgcctataaagtctataccctgagtataaagtaaaacttctttgtagaagtatattttattatagtgccccatcccaaagctgacataaaatgttttaaaatataggcaaactttgcaaagtattatgctagtgagttttaaatcttagtgtaaaccagctattttctacaaatagatgaagtatgaaaattaacagagacaaaagttgaaaatgaataaggataaaat

SEQ ID NO: 50787 - DNA, 1033 bp, Homo sapiens
atgttctctctgtcccacagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttac

SEQ ID NO: 50788 - DNA, 1036 bp, Homo sapiens
gagtgtggaccttaaacttttttaaaaaaacaatggtccttttaacagtgggatgaaatcctggctccacttccttgcagtgtgatcttagccaatttacctgagcctcactttcctcatctgtagaatggagataatacttacctaacagtgcctagcatcttgttagtataccataaatgttgggtctagttgcccagattgcttgtataaagtcaagatgaaggcagaaaaaaaaaaaaaaaaactggtgaaggtaaatgtttaaatgtttctgtgttttggagccctataaataaactttggaatatctgtgatgcttttgtaatttatgctattttctctcccattcagtaatccaaattgaatggtattgtttttatggtcctgtgttaagttacctgttgtgtagttaattgaaaccaactctattgccaaataaagtgaactgacctagaagcatgttgtgtccacaggaaagctgtgcttctaggctgtgtgcctcaaaccaggatagcgaataccctcttgagaagaccatgaacagcagtcctatcaaatctgaacgtgaagcactgctagtgggtaaggaagctaatgcacacatgccacgtacaatgcctgggtacaatggaggagaggagggctttacctaagattaataagcacatgccaagcatttatgaagcatggcagcgcaagaactcagagttctgaagatgataggttaagaacaagtacaaatttccaaatttaacagcagctgccagcctccctcacactccttgtagccactgccatgtcaagcagtcaagcatgtcagtacaagcactaagctaagaggggtcagctggagaaacacactgtagattttttttaaatatctgtgcaaggatagataagccctctcatgtccactcagggggctagcgcagaccgtatttggcagagagcttttccagagagcctctggagcaactataggcctctcaagtttttccaggttactggctaagctatttttacaacacttctg

SEQ ID NO: 50789 - DNA, 1031 bp, Homo sapiens
agtgctatagaatctaattaccaaaaattcggcagcacttaataataacagagcattccacgagactattttaataagaacataaaggtctcaaaaaaccctgcgtaggtgtacttaaaagacaatatactgttcaggaagcatccatctaaacatcaccaaaatcagctctctgttaacagccacctcctagaaacattcttagggctgccaaaagaaaggggatttccatcagtgatatgaaaacaactaaattttgccctttaaatttgaatctgtccccctgaaagtgcccaagtgctagcaatctcctgaatggggtggctgttatctcattttgtaaaagaaagcagttaaaagaaacaaaaaaaaaatcccttacaaaagggggctagaaaatgtggagatcttcattttttttctgatggaattggagcacctttgggagctggcactgtgcacagtgcacccaccccatagcattgtagcatctttaatgaggtttatgtagagctttcatctcatcctctcatttgatcctctccacagttctgggagaataggcaaggtaatcattggtagccccatttttctgatggctcagatgatcaaataagatgaatggatgtgcaagtgtattataaactgtaaagagccctagaaaggcttgcttatgaaatgtattcattcttcctttttctaaaaagaatgtatgacagttttggcattactgggtaatattattctttgtaacagctttaattagctataataatttaattttagtgaggtataataattgacatacaatgatcttaacatatttcaaaaatacaattatataatattctatatatgtattcaggtatgaaaccatcaccaacaatgaaaataatgaatatgtctgttatccccaaaagcttcctttacaccccttttgcaatcctgtccttctacccctcaccactctcccttcaggcaaccatttatctgttctctatcagattagtgtcattttctagaactttaca

SEQ ID NO: 50790 - DNA, 1051 bp, Homo sapiens
tactgatcccaggacgttggccattcctgggaaatctttgagctccttgatgaaaaggcatcatatgaggctgaaaaatgtaatataatttcatttataactgaccctcagaactcctttgggagcagcacctattttgcttcctggatttgaaaacttcctactgagttgtattgattattattttattttacagaaaggaaatatgggggagagcccctcatttaaatgattttgtgtaacaatcaaaatggatcatatagggctaaaaaagagctcaatgaatatagatgttttaatcccaatgttactttccgtatggtattaattacaaacataaattagaccagaagtttttgttttcctatcaatttcatttaagaaaaatattagatttaattatcctagctaaaatcttagtctttcttgttaaatgtatttcatcttattagcctgttaatttcttctgttaagctgactgactaatattaatgcaaagttttatcaactgaaaacggaaagtaaacttgtattgtacccctaatttccccttgtatgtgctagttaagtaatttgaacccagaagctaaattacctttactagagaccacaaagcagattagttagtatgaattatgggcttgctttctgcctcagatatttgctcatatctatttttcttgctctaaaaagattgtggtaataattgtgatcttaccaggttacaccgttctagtggctggagcatcaactcggatattgggataccatttgcagttgagcaggttcacatcacttctcaatccatttcctcttcggaaaaatgacaatgataatatctgtccttatctcttttgcttggaggttgtaagaataaatgaaacatggatggaaacagtttgagcataaatacataaatccgaggaattatgactcttcaggaattatttatgtataccagtatttgtgtatttagaaagcccctcccttacccataaacacatgcacacttcaccatcatcatcaaacttaaagagacatgcacacataa

SEQ ID NO: 50791 - DNA, 1026 bp, Homo sapiens
aacccagaaacacacagcataattattttaaagaacagcttgcagaaattctgcaggaagcaacaatgtatatatgagatcagagttttatgaagacacggtacctggtcccagaagctttctttttcaaatcatctttgacaatcgagattaaaaaaaaaaaagacaaatagatttctttaaattggatcctgctttgttatattcccagctatcctcctttctcaacatggttgaaaaatgtttatcaggggaaaaaaaagaggaacaaagtaagcaggaagtaaaggttaaagagcagttaagaaaaacaagaatttgtaaatgcccaagaccagaaaccggagcccagtgccctggggatttcagtcaaattgctgtcaacaggatctgaaagagatggagttccattgtaaggagagtgccattcattagggctaatcccaactaaaggggatgtgcctgagtacctgagaggaggcagagtcagttgaaagagaatataaaggttatgtctaggagtagtatagaaacttcaaaagcaacaagaagacatgggctgaaaggttgggctctatagtggaagttagagaatggaggaacaagaagggattgttttatcacttaaactagtactaagtaatgtggttattacaaaattgcctgtaacttagcaacccccatttaaaatgtaagctccatgagatgagggcttattgtctgtttgtttactgatactaatatatatatctccagcaccaagagcaatttctggccatagtaggtgctcagtgaacatttgttgaattagtgaatgatagaagtttactatgaggtttcctcctataaaataaagttaatttgtttccctgaactgcctctaattgctgctttggagtgatgaggagtaaaaggtaaagaaggaccttaaacccaagatgtaaatcaaagtaacagtggaaacctggctcagggcaagaatggtttgagggctgcctttagaaagtgttccattcatcttagttg

SEQ ID NO: 50792 - DNA, 1050 bp, Homo sapiens
tatctgctttcaaagtgtctgatttgaaggtatcagataacttgcctaatacagagttaatataaagcagagagatgcatacctttgaagctcatgctttggataggagtcttcaaatatttgaagagctgatatgaacaagaggattgaagattgatatgtgtcactccagagggtatccttagtagtgatagtagcagttgtaaatgtagcagtaatattagcagtaagatcaagagctgatatttactgagcacttattttgtaccagggactgtgctaagtacttgatttgtgttaacttgtttaattgcaatcctatgaggtaggtactattgttatctccatttttacatataaagaaactgaaacacagagattaagtgatctacccaagatcatataaatgagggaacctggatatgaacccaggtagccataggaattcagattttcgcctagcatataggggaaaacctttctattcaaactgtctggcggtggaatgggtgttcttatgaagcaaggacttttccagtcctgaacatgtttaagtatgtctagatgccactgttaggcatgctgtgaatgagattcttttactgggatcaaggttaaaagtaagataacctcaaaggaccatttcaactctaaaattatacaaatctgatttgacatgtctactggttagtgagcagctatgacctttctagtccatttgtggacttagttgggtactcagagctcatagtagaaaggcttcacttctgttactgtagatgagctgttggcacaggagaagtataagttaatgcactgggccaccaaatggagagaagccattccaagggtctgttgcaagaaccaatttagaaaccactggacaaggtcaaaagaaatccattaatgaaaattgattagtctgtaaggttctggtttctcattgtaataatttgtaatccaaatgaatttagtacccactttcaaattccaacactttcaattttatcttaataattcctagtatcaacctgccatatgcttcttccc

SEQ ID NO: 50793 - DNA, 1022 bp, Homo sapiens
ccacaatgcctcaggcagtactaaattagcactataggtgtattaaggccagcctggctggggtgagcacggcattacggctggctttagacccttggttgaggagccagctttgtaatacccaacttagtaattatgggggctttatgtttgcatgtgtgaaccttagttaagctttgtcatagatttttcaaaacagctggggcttttggtctatgaagacattaatttgtgtctccaggggctatgcataaatcaaattggaaaagaggggaggaggagcgaatttctttttttgtgtgaatcccagctccctgttaactgtttaattgaggagaaggaaagagtcctgtgacaattactgaattagtgatgcactattatcttcttcttgatgtattctagcttgatgtatttatgttaaaaagacagtaaatgctgtctcccatagaaggccctgctttgttgcccttcaacagaaatgtagactcagatttcacagttcctgttgtttcaaagggaggcttaatgttggttggtgatggttgttaatttaaactttagtcctcttttcttaaccatctgctgtgtagtggctctcagtcacagttgagggacagcaacaaggatcccacctggggaaagcaaagtaataacataggcctttggaaattctgctgtttattcctctctagccctgtaaaggattattgggaaatcatgtcatcatggaagcaatggccatgttggagtgaactaagggtgggaagcgagcctggtcctaaattcttatgacctttggaaatatcagtataaatgatgctgtggtaatccaaggtttccccctcctccactgtgttatcttttagccactgctgaatctaactgaagaatgccagaatgtagaaaaatggggcttctttgtggttttcttattttcatatttgctacctttttagtccattagagaagtagatgatagcaaatacaatacactctgcaaaataatacagtaactccca

SEQ ID NO: 50794 - DNA, 1080 bp, Homo sapiens
gttcctgattcaggatgatgacatgatgaaagtgatggaaattaacctagaagtagtgtgaatgagaggttggaaatagaaagactagaaatcaatcaggacaatgttatctgtatatgaagtggtgaggaactagttgctggaatggaatgcaagtaatggatatgagagatattttaatggtataatgaataggacttgattgattaggaaaagaggattgatattgagactagatgactgagagaatggtgatgccattgttagaaaatgaaagaacagggaaacccattttaagtagttgatgatgactaggttattaacttgtttgttgaaagtgtgagattgcataatagaaatatgtatgcatagggaatcactatataggggtttgaatgagaaatataaaatcgagaggccacatatagaaaggtgatcattggatttcaggaaatgaatgagttttttgaggaaatgaattatataaagcaggagcccaggagccaaatcttaggatctacggctattaggatatgataggaggagcccctgaagaaggctgaaaaaacaattggagactattagaacagaatcctatcagattgcagaagccaatggaagacatagtttcaagaagaagatataaatcagccatgtcaaattccacagagaatagaagatttaatgtataacgtaagctctgtgaaagctctcttaaatgatctctgtatattttactcaatgatgtttcctaagtgtgtagaattgtacttggcacatggtagtgaatcaataaatgagtataattagctagtgatgctgaaagttttgtgcaaaacttttaaatataagcatattgaagaaaaataactaatgagcaacatcttcagatacaaacctctgtaaacatattgattctctctatttgcttatcaggcagtattattggaagccagcacagtgttgttgaaatgcacagtgaagatggaggtagatcgtttagccttgctgattcacatatgaggcagccagagggaggcagatgatatgtctgtttgcataattctacagaccaagacc

SEQ ID NO: 50795 - DNA, 1060 bp, Homo sapiens
ctggatattagccctttgtcagatggatagattgcaaaaattttctcccattctgtaggttgcttgttcactctgatgatagtttcttttgttgtgcaaaagctctttagttttattagatcccatttgtcaattttggcttttgttgccattgcttttggtgttttattcatgaagtctttgcccatgcctatgtcctgaatggtattgcctaggttttcttttagggtttttatggttttaggtcttacatttaagtctttaatccatcctgagttaatttttgtgtaaggtgtaaggaaggggtccagtttcagttttctgcatatggctagccagttttcccaacaccgtttattaaatagggaatcctttccccatttcttgtttttgtcaggtttgtcaaagatcagatggttgtagatgtgtggtattatttttgcagcctctgttctgttccattggtctatatctctgttttggtaccagtaccatgctgttttggttactgtagccttgtagtatagtttgacatcaggtagcgtgatgcttctagctttgttctttttgcttaggattgtctttcttgcttccttctttttctttccttccttcattgcttccattagcatgatgatctgccatgcagaggtaggttaggaatgaaggtaagtaatactttgtaagtattaaacataggctgatgctgaaatcaagtagagaagagatatgccaccatgcggaaacatgcaatattagacatagggagacatagtttgaaaaagacttctcgaagattctgatatgatcttcagtgagtgctataccagcctagctgaaaatcactgagataaataaaaatgactactgtttcatccatgagaattttttaagcaaccttaaataagttcctatagcttaatacgtgcttttgccttacaaaataaaacagaacaaaactaatgctgaagaaaatagaaacttacttagaacaacttgtcagatggtttctagtattagcaatttgctatgtccaaaaactgaggagcccaatgaggta

SEQ ID NO: 50796 - DNA, 1021 bp, Homo sapiens
atggtaagtaactatgcctgctggacctgccctctgttgcctagatcccagttctttgtatacttttcaattgctaaaatttttagcacatcctgaaattcccttctttctctttccattcttcactttctttggctctgttttctgtttttaatggacagcaggcatcctccccagcttttttgtaccattcaaactcactcccagaattcattgttgtatccaacctcactgaactgcctagaggagttcaaaacgggtgtttcaaagtgcctctcagggccaccctggagcactctgcatataggttcttttgttttgaggactaaagagacagtatcgcagctacagttttgagaaatgtgtaaagagaaaacccatttggatctaaaggaaaattttaacttcttgcctctcccttcccccagactacatctacaattttcagtgacatttttactttgtttaggaaaccagtcatttctgctttcagtaaaaaaagttcactctgatcaggatccttcctaatttaaaccagagtagagaagaagggaaatatgttttaaaggtatgctataggactatgctaagatatttacataaattattttatttaatccttgttagtactctcaataaatgataaagaagttgttcttcttagccgagactatatataccactaacttgtctagagctctgtctccagaaacactgctcttagaaagcctgcattcctgttgctttttacttatacacataattgtgaatggttacctattctcttactctgtttctctgtgggtatgggtgttgaagagataagatgggagggagggagggatggagggagggagagaaagggagaagggaagagagaagagagattatcagtactaggatgttccctcataaaaatcccagatctgcgtaaaatgggagaatgtaaagaaaacacttcctgtgctagctgtgtattgaacaggaattgggatgtgttttaagagggcttctgactaag

SEQ ID NO: 50797 - DNA, 1053 bp, Homo sapiens
gaattaagaactattcctttaattcttaagatattgttatagtaatggattcaaattgcctgagttcgaatcccagtaccagtcaagtactgtaagcaagtcacttagcatcagtaagccttagtttccttgcctataaagtgaggataaaagtgtctgctataggaggattacttgagccgaggagttcaaggttacagtgaactatgattgtgtcactgcactccagcctgcgtgacagagcaagatcctttctcaaaaaaaaaaaaaaaaaaaaaaaaaaaaccatatagtgttgtattgtgaagattggttaagaaaattatgtaaaatttgccatgtctgacatgtaataggggctcagcctatactagatcactgtcatttctttccttttccttttattggaccaaacaactcatctgtaactttcacttgaggaaaacaaactattcctgaaacatttttttgaggagagacattctgaaaaagtatattaggttatttctgaggctgaacaaggacagttaccaactcttaaatgaagtgtatttcttttaaaaaaaaaactttttaaaattttatttatttatttatttaagaggtgggatctcactctcttgcccaggctggtcttgaactcctgaggttaagtgatcctcccacctgggcctcccaaagtactaggattattggtgtgagccaccatgcccggccaagtatatttcaaaataagctagaaacatgaatccttaaaagagttggggtggtccatctctctgcctcctgcagattaaggctaaattgtgactttatctgtttcatcactagactaaattccacagttggcatagactattaaaactgggatattgggatattggcaatcccagcctggccatttcatggcaagcaagctgaggctaagagagtagaagtgacttgaccaagatcaaacagtgaagaaaatcaggagacgtcagttcttctgactccttatccagtgttcattctgtggttcccttgtcagctttcagacaggtgaaaccaaac

SEQ ID NO: 50798 - DNA, 1033 bp, Homo sapiens
tgtaccacactgtagggtgtcggtctgtggatgtctctgtgttccccactagactgtgaactccttgagggcagggaccaggtttcattcatctccatacccatagcatccagaagagcacttgacacatggtagtcacctaataaatggttattgggtgaaaagaattgataaacagatttgcatgaatataactggggaccttggtagcacagagtgccaaatgctatgaaaagactagctgtttgctacatttgctacttttgctgaagaaaggagtaaattaaagtgcccataatttcatgaaagacctactttttccctcttttcttcactctcccctggttatcttacctttttctttcctatcatttacctatccaggcacctattccttagccctgcccattactttgctgctcttgacagagttcatcttcctcctgccctgatactttgccaggaaacatccttccttctacccacccaagtccagtacactccgtccttgacatcactctcaagttcatctcctactcatagactctgctgctgggactataatttgatacagctcttctggagagcaattcgtcaatatgtatcagaaaccttaatagaatacagcttttaacctaccacttcaacttctagagctctatgctgaggaaacaatcatgatgtttccaaaaatttaatactcaggacatctatcccagagttgtttatactaatagcaaaaacaacaaaaaaaaaaaaaagaaaaaaaagaacatcttaaatgtacaatactagggatttgaatgaaatcaattgtggtacatttatagaatggattactaagtagccttgtaagttgattttaccaaacaatatttaatgatgtggaaaattgtttttgatatattaagagaaaattcacatcatagaactctcagtacagagtgacagatcccagtttaaaaacatatacataatacacacacacacacgcacacacacacgcacacgcacacacacatctgtgtaggca

SEQ ID NO: 50799 - DNA, 1027 bp, Homo sapiens
taaccgacatgaaaataaatctagagccttcgtctgtccccacaagcacaaacccataaccccaagagagattctctagacagtgcacccaaactacaatacccagaatacccttccccgtctgaacgctggggacaatcggaaggggaggggaagaattgtgcgtatagagaaataagtgtcccgcaactccatctcccataattctcggtcctcacttgtgtctgtctgccaatgtcaacacgagttacccccaggaagaacagcctccagcgacctcaaactacatttcccatgaagccatgggctcgggcctccggcttccccggtgaccagtagccaataggagacgccgcagtgggcaccctgtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggaggtcagagaggcagaaagccccggtggccgtggctggggactgtgggactgagggggcctagggaggagggtgcttccggggccgcggtcctcagcgcctaactccacccagctccacctctgcaggggagggggtatcgggactgggagtcgggggtgggcttttgagctctaggcgccagttctcttgagcccgggagcgcgctgtctttgctcttttttttttttttttttggtccaactcgcccgcccctttttttttttcccacgacgccgcccccctccccctggctctgtgcctcctcagaggtccgaagttggggtttgcgtccagggttttgcctaggcggtgactggactctaattcttaccgcaggaattgggtgatctctttcctcttttccctcaatttgtatttcaggtttgggcacataaccctccctgcgctacactccccattttctttggggcatg

SEQ ID NO: 50800 - DNA, 1034 bp, Homo sapiens
tcacttgaacccaggaggcagaggttgtggtgagctgagatcacaccactgcactccagcctgggtgattgatagagtgagactccatctgaaaaaaaaaaaaaaaagtatgtggttcaatagttgttggtatattcagtggtgtgccaccatcacaatcaattttagaacatcttcatcacctgaaaaagaaattccatgccacccattcctgtaccactcttcaagaccctggtaaccactaatctgccttctgtttctgtagatttgtctatttctggacattttatctaagttgaatcataccataaaaatggaggagcagcaaaggcaacatttattaagcacctagatatcagttaagcactttatgtattttgtcttatttaatcatcaaaataatcgtgtaaattaggtaacattatttccattttagacaagcaaattgatggcaaagaggttgagcagtttgcccaatcatactattaggatgtgcctggatgctttgacaagatctttgaccatgttctttctgccttaaggtagttaggaaatttggaaaacatccctcccatgctcttccctcagtggtctttagttccttgaacagagaccgaaagtaaatatgacatttctgatgcagtgagggctgaaagagcagagaaaggtggagtggtttgtatagcatagaccacagaaatttgctctcccagcttctctattaggtgttgagaataatcagtgatctgtgtacagtatgactcacagagccataggaaattagagctcatagctggaaagagcctcagagaccacctagtctagttgctccattttattgatgaagaaactaggacccaaaaagagcaagcaatttgctcaagatcatatagctcaaacacagtgacagagaatgaccttttatctgttattggaagaataaatataccaaaggtgaaagtccgctccagaataacttcagaaaataagaaagaagagagatagtgttacaaagtcactgaattaggtcagga

SEQ ID NO: 50801 - DNA, 1055 bp, Homo sapiens
atccccatcatctcagcaccaagtctcgttaagctgataagcaacttcaggaaagtctcaggatacaaaatccgtgtgcaaaaatcacaagcattcctatacaccaataacagacaaacagagagccaaatcatgtgtgaactcccattcacaattgcttcaaagagaataaaatacctaggaacccaaattacaagggatgtgaaggacctcttcaaggagaactacaaaccactgctcagtgaaataaaagaggacacatactgcccaaggtaatttatagattcaatgccatccccatcaagctaccaatgactttcttcacagaattggaaaaaactactttaaagttcatatggaaccaaaaaagagcctgcattgccaagtcaatcctaagccagaagaacaaagctggaggcatcatgctgcctgacttcaaactatactataaggctacagtaaccaaaacagcatggtactggtaccaagacagatatatagaccattggaacagaacagagccctcagaaataataccacacatctacagccatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatcgattaaagacttaaatgttagacctaaaaccataaaaaccgcagaagaaaacctaggtaataccattcaggacataggcatgggcaaggacttcatgtctaaaacaccaaaacaatggcaacaaaagccaaaattgaccaatgggatctaatcaaactaaagagcttctgcacagcaaaggaaactaccagcagagtgaaatcatgctgctataaagacacatgcacacgtatgttcattgcggcactattcacaatagcaaagacttggaaccaacccaaatgtccaacaatgatagactggattaagaaaatgtggcacatatacaccatggaatactatgcagccataaaaa

SEQ ID NO: 50802 - DNA, 1045 bp, Homo sapiens
aaccaacagggtaccttctgacacatgtcttagctaaaatattgtctatgtttgggatgtctctcactcctagattgtgcatgccttcatttttccatagttccagaatttaccacggtgcctgacatagagtgggtgcaaggtagctctttgacctgagctgatattatgtagatgtagtagtgaggtctgggaggaccctcttctaatatcccctgctgaagttacatttctagcttctcctacattttctattctgttgtcgttgagccccagttaggagtatgaaaactgaacatgaagtttctaaaagtgtgggtggtaaggagagggtctgagtacgtagcctcactgaaaaggctctcttatcccatcctcacccatctctttcccctagccctgcttcattttttataacacattctaatacctgaagttatattaataatttgattacttgcttattatttgtctttcactcaaatgtgaatttaataacagggcccttgtctgctgtttactggtgtattcctagaacatagaacagtacctgggggatcacaagaacccaataggtagtaaatgaatatataaagtcctaagcattcagagctgttattcagaatctacctactcctcttgccacctgcactgccattctttattccaaggcatcatcatcattcacctggatttttccagtaacttcgtcattggttttcctgtttctagtcttcttcccatccagttcagatgattcagttgaactgtaagtgaaatcaggtcactcttccattaaaaaatttattctatttttattgaggtatgactgatatacaaaaaggtacacatattttatgtatacatcttgagtttgaagataagtatatactcatgaaacggccaccataaataatgccgtaaatataacaaacatccctaaaagtttcctccttctctcttttatctttgtaataagaacacttaacataagacctactctcttaataaaattttaagtatacagtatcatattgttaactat

SEQ ID NO: 50803 - DNA, 1512 bp, Homo sapiens
acaaattaattataaaatggttttcatctataaaatgctcatgtgataaacaatttaagatttcctatttactaggtcttcacaaaaaagtaaggttactaaaaataaaaattgaatttaatatataattctacatgtaaaacatgccaaaaaaagatatattctgatgaaaataagaaaaattataagacataaaaatgtgttcttaataaaagtaaataatttttgtctaattcaagggttactttgaaacagggtaaaatgagctgatagtaagtaaaagaaatgtaaagaaagctatagctataaaagcagtattttttggtaatagagtttaaaaggaaaataattttgtgtgaaaaagaatcttgtatgataaatttttgtcctagaataaaacagaaagttcaagcatgtcataaatagtatgtgaaagtcataatagggtttgtaaaaaacagaatttataaaagaaattttgtgtgtgattaagttggctatactggaaaggaaattatttaatcatcttctagaaattgtgctttgatactaaaaatacactaatataaaactaaagttttggtagactagattttcttaaaatattgatttattcaatgaaattgcaagaaatttttaaattttaattatgtaattcttttttaaacttgaaatttctgagattatcttagaagttcaaattctgctgtactctgctgtttttagcctttctgtctttgagaagtcctgggatgcaggtttgactttcaggttattcaaataagcttcccataaggaaaaataattgctaccataggtcttttttgttgttgttgttttacttttttggtgattagcgtaaggaacagtgattttacattttatcaaaataattcctgtgttgttttaattaggttttaaaaaatacttaaaaaacaaactttgaaagggttaatgtttttatatttgtgtaacttcctatattgttgttgaagtcttttgattgtgactcttgttaaatgattaactattattttataatgttgtatggttctgttttaataaaatattttgagacttttaacatttttgacaaatatcctcaaaatcaaatcccaaattaagtctctgacttgacttattgctggaggcttattaaaactataaaaattaatcactataaggatatagaatctttccacagctgccaacaagtcataaactccagtatcaccaccaccagcctgatgattagacatcagttgagagactccctctagccccacttaaaaaaggtctttatgaaatgttattaactaacccttgtgctgttaagttgcagggctttgactcctgggtacatgtatctcatctgaaagggaatcctgacgcctactgaatcttaatagtcaatattgatatctggcatcaaattcaagttgaccaaagttccatcttcagacctgggagaagatgacagtcaaaatgaactgctttcatgtgacactggac

SEQ ID NO: 50804 - DNA, 1023 bp, Homo sapiens
cttgtgtgaatcaacgagagactgaacttctcagctccactccattgaaacgcagactacagtttggttcctcccttaaagaaaattaaaaaaagggaaacaaataatcaaagaatgaggagatacaaagataacaacccccttttgggcacgttgtttggttttatgatgcctctacttgcaagcatttgtgtaaatggaaaagtttgaaggcatgccaggttttctaatactccagctggttacatattatggtctattcttgggcacattttaaacttgtggctaaattacatcaagaaaaattcagaggtcaaaagtcaacctgcgaatatagagtctttaaagttttatgtgtatttctctattttcttttctgcctgctttaaatctgttgttacttttctactggagttgagataaaaaccactgtctgcatccaaccatttctttttctttctttttttttttcaaactggtgagtttgtatttatctcatggttagagttctgaaataaaagctataagatctttgtttgtatgtgtgtgtatgtgtttagatgtgtttgtatgtacgtacatccattttttttaatgtgttgtgaccacaaagtaccaaattggctttacaataaaggagtactcataaattaagtaaataagcccagtgcttttctagttcatgtgacttaagtaaatctttaacaaataagctgactttaaaattattggtaaaataaaattagaaatgtcttcagaattgtcagcacacattttgtctagatttactggtcaggtggttttgtgtttatctcttatagatattttataaggtgttaaagtttggcacaaaggatatagaagtataaactcagccccaaatctatgatctttgtgtaatttttgataaataaggcatttaatattgttggtctaatgaaaacagataaatcctgagttatcagcaaaaaaaaaaaaacatttatttaactgtaaatttcatacttagttaaacacctgata

SEQ ID NO: 50805 - DNA, 1030 bp, Homo sapiens
acctgactagctacttagtgtaacaaagctagaaaagttgctggtctcagacctagaattccttaggctaaagaattgtttattcattccttgctaactatctttaatagaggctgtgtgcctaggcagtggatagaagcctggtaaggaaatcacacctagctgaatcccagtggtagtgacaggaggttgattggtttcttctgcaagggaggatagtgtggaggggcaatgagcctatcattcccatttaggttggatacatgtcattcatctgcaccaggtaatccctttagtcctcacaaaatcttaattgcattctatgtcctcataagcagccattccctgtgtctgatttagtgagaaaagtaaattattgaaccttgaggattaaacccttccacacggtaaatgacaaagtaaagtatattttactctacttctaaaatgtgataaccttaaaccaaatatataatcatgtatgtgttctagagagccaatatgcacattgtgatgtatctgtaaaaattcaaacaaaaaatagtgtctacttttctaaagcaatgttttcgagggcatagtttaagatttacctttgtttataatgaaggcttaaaatgttgacatataatattgatgacattcaaattaattcatgctcctcaaacctttgttaacatacatacttggtctgattcaatccacaatgtacaatgtaatccagtttttttgttttgttttgttttgtttttgagacaaagtttccctctgtcgcccaggctggagtgcagtggcatgatcttggctcactgcaccctctgcctcccaggttcaagtgattgtcctgccccagcctcctgagtagctgggattacaggtgcccgctaagttttgtatttttagtagagatgaagtttcactgtgttggccgggttgatcacgaactcctgacctcaggtgatccgcccaccttggcctcccaaagtgctgggattacaggtgtgagccaccgtgcccagcctataatcca

SEQ ID NO: 50806 - DNA, 1041 bp, Homo sapiens
gctgaggcaggtggatcacgaggtcaggggttcgagaccagcctgaccaacatggtgaaaccccatctctattaaaaatacaaaaattagctgggtgtggtggcgggcgcctgtaatcccagctactcaggaggctgaggcaggagaattgcttgaacctggaaagtggaggttgcagtgagccgagatagcaccattacactccagcctgggcgacagagcaagactccgtctcaaaaaaaaaaaaaaaaagtacaacagagttttcttacagcactaatttgctctttaacaaaaattggcaaagaattataaaagatttataagaatcttaccttatggtcagacattaaaattggatagatttgtccataaggtttcattaagatttgggtttgacatcaatagtgcactaatacaatggtgaaatttggctttctctcttgaacaagattttcatgtgatattaagaaatgatgaaagatttttgtttgccttttgaataaactgtaggaagaagaagggaaagaaaaaaagacagattgtttggagagctaagtctccctcttaatgagtaaaggttttttccgttttaaaacattttgagttattgttttggctaattaaatgactcatggtgacctgggatttgattttataatatcaagtgttttaaaccattgatatttgacaaagcttccaaaattaaattataaattatatttttttctgacataattactagtttagatattaagtcctctgaagtccaaacatgatatatttggcctatttggtataacaatcatacagtaaacactgtcaactatgaaatggtgtttggctttctttgggttgtgtttgtataaatatattagcggttgaagttatctgtgctaccagcgttgaatccaaacaggtctggagcaacctcgattcctgccttctgagaagaaagaatccgactgaggggcataaggcagaagaagagaccaaggaaagttttagagcaggagtgatgtttattcaaaagctttagag

SEQ ID NO: 50807 - DNA, 1049 bp, Homo sapiens
cctttggaagtatcccgtttccttgcttttgatgtttccggtgtccttccgttgagatctgcacatcctgtgtaaattgcttctttcaagtttgtgaattcgctttgtaggggaggacttcctcctcttccccttgcgtgggagctgcaggctccaatagcttgcaactttagccatgagatagcaatacaagcttgccagttttactttgccccaacagataatccaatgaaggctgtgaaccaaaatttcgggtaagcagtctccatggcagtttgatttttaaagtctaaacctccccagactccaataaggatcactggggccaaactaacaaaggaaggcatcacacgttaacgaggccccctacttagaacagcagcacaaaagcccggttacatgcaacaccatccggctttcccattagacaataaacttcagattctaaacaattttggggccaaggaacattacaactctgagagaaaattccaaggagggcttaatactagaccttagaacctctgcagaaagcatcctctttggagaatttgaggcacggaggatcttccagagcatcctcctgtggggtccaaacttagagttccagacgtctctggcgttacttaggtgggcaccggtgccgctttacatgcgttccctctagagccttctatgaactttataagaatagccatgaactgtataactggaggccgggtgagcctttttgttccttagccagtagagtacaataaggaaagaatttagcataactcagttctaaaaagtgccaatattttaaaacctattattatttccaagaataattaattattatatttgaaaagtacttaatttgtaagtgaagataacttgttttaatagttacactacaggataatttgaacattggcttataagttcatattatatgtgcatcgtcaacagatgataatatatggcccagacattttaaattacttcgtctcactatgtttgacctaccatatactttttgaattataatttcttaaagttcttctaga

SEQ ID NO: 50808 - DNA, 2050 bp, Homo sapiens
tgcagaaaaggtcaaagggagtagcctctggtccttttgttacttaggcgttgaaagtgagggttttcctttcaatttagttctaggaagtcagcgtaaaacagccttaggtcccctgcctccaggccctattctcctgcctcatctccccgctgagagacttgatccccataaatctttatgtgaggcagagggactgaagagctttcttctgtaactgcttcatgccgacctggggcatagtccctacctattggaaatcacggaactctcgccatgctctatctcgtggaggcagggtagcttcttgatggccaggggtggtgtcttcacctggaactggctggaaccgtggttgcatgatcatctgaagcttgatgattatctaggcgagaggaaatgaatttggctaaaagatttaatgggaacttcagggggttgatacctatgctgtcagaaatgttttttatagagatatgcaggagaaaaaaaacaaaacctggtctcttgtagaatctatgcgtttccctaaagttttagcacgagcgactccattttggtttggtttggtttggtttgtaggggcctagtgcatgagctcagtccaaaacaatggcctcccataattttctttaaaaaattcccctttattcaggttttcacttgagtgagagtgggaccaaaacttagggccttagtgccactcttggttactattattttgggttttcattctcagcacgtcaggtataggttacggtgtcctcatggttgcagattcttttggctcttgttattccagttgaaaagaaactatatttcattttagagatggctgcatgcaagcatttaaaacctttgagagaacgcagcacaccagggagactattattagaggatataccaagaatttggagtatgccccttacccaagatctccataaaccaaacctcctaaaaccaaacagatcaaagaatgagctagataaagagtttactcacttaatgaagcaatttcttcatcaattcccgatcactgaattttttttttttttttttttttttgagatggagtctcgctctgtcacccaggctggagtgcagcggcgcgatctcggctcactgaaagctacgcctcccgggttcacgccattttcctgcctcagcctcccaagtagctgggcctacaggcgcccgccaccacacccagctaattttttgtatttttagtagaaacagggtttcaccgtgttagccaggatggtctcaatctcctgatgtcatgatctgcctgcctcgtcctcccaaagtgctgggattacaggcgtgagccacctatgcctggccactactgaatttttataatcctcatttgatgtatttccccataggccacaagtgccagcagctgcacagatactttttctgtttagccatttctatcccaactttcacaagagaatttagaatcactgtgcaactgcagcctttacagtagaatttgctatagaacctatcatgagggatatatttccaatcattgcttcttttactccaaatcatggaaaaaggacttaacaaatgatgccctttgagaagagtgaaggccctctggcagtgttctcttcaaccaatgaaatgggccaagaggaatgaaccaatgttctgcttttgactgattatgaggcaatgcatgtaccattaaagtttcttacatacattggcctttatcctttatctaccaaagtataagcttatccatgtaaccttacacttgcaggctggctggaagctccttcacaaataaaagtacaccctattagtgcacataacagacacttttccacttctattgttcacagagacataagcaagaaaaaaactttcaaagagaagagtttcatgtcactagaagtcttaatctgtgaccttgggaaagatattcacatcaaggatgccatcttcttcttgggagaaatttccctggttagctttacctcaagggttacaatgggtgcacagttccaaaagtgtggaggaacccttctta

SEQ ID NO: 50809 - DNA, 1083 bp, Homo sapiens
gatacggggtctcactacattgccaggaatggtcttgaactcctgggctcaagctatcctcctgccttggcctcccatagtgttgggattacagtagtgagccactgggcccggccaatgctatatatatttaatcatggtaggtgttataatgagtatacgtttgaagatggtatttttggccaacaaattcaaaactttaatttgtcattatataaacagagacagtaataaagcattctagctgcatgtgagttgtgtgaatgcatccatcttacagttttcttaggttacacctccaggtgactgaatgtgagagatgcctatttcaactatcatttattgaattttgctatctttcttttgaggtttcaaagataaaattttaaggaaagaattaagaataaaaatttgagaagaattaaacatcctaattttctaggtataagtatgtataatacatatgtttctattgtatataaacgtgtttctattttatgtgtgtataaatatacatatattttagatataaaagtgaaaatggagaacttatgttttgatgaatagtccaatcaagaagtttttgcaaatattttattgtctaaaattcagatattgcaactttcttatgagaataaaaaaacctcaggaatcagatgtgaaacttttaattcttcaactttatttatatatctaaattcaagtaaaatgtaaatttattgtggtgtttgactgtatatatagaactttttatctgagtgttgaaaaaatgagaggaaatatggaaacaatgatcattgtttaatacagttttatgacattgcttttctcttgatcagcacatggttatttttaacttctttgcaaattccatgtctttgttactaatgagaaaatataggactgattcccaactgaaaaacaataagacacatacacaagaaagtcatagggcacagtcctaagtgacagccatttaatgacactggaaaatatttctaattcagtgttaaataatgaaactatgagacaaaatcctgtgatcaatctgattagtatttacagtcattcctgtgtttgtgt

SEQ ID NO: 50810 - DNA, 1048 bp, Homo sapiens
atatggttactgttttactttgcaagttctatgtcttgtcactaatgagaaaatataggacttattcctaatgaaaaagagtaagacacatgtacaacaaagttataggacagtcttaagtcatagccatttaatgacactggaaaaaatttctgttccaatgttaaataatgaaaccatgagacaaaattctgtgatccatctgattagaatttatagtcattcctgtatttgtgtccattcaagtagggctgtgtgtgttttctcaggctggagagctgtccgaacccttatgttagagccccactaaatatcagcctccctctcaacatataaggcctaatgactaggtcagatcgtgcagtaaaactcctagggaacctgggtagggagtcaggacaagaaccacatagcctggtgcctagatttgctcttctgaaagaccttaggggtaaaacttttttttttcttctctccttaggcatggaaacctaaggtctgtacccaaaactacaggactatttgacatcataataaaacactgcagatatgatgctgagtaagagtagaaatgggaagacttggttgtgcagtaactgagttcttgaaaagaggagatgcttgatgagggtgagtggattacatcactgtttaatatccaatggaaaccaaaagcaaatggctaagagtggaatatgtttacacgaattgagcaaaatattgggtagccatagtttctggtgtctttgtttcttcatggccttctttttgaaacgtgtagtcatgtatgtgtacacattcatacaaaaagctgatagtgtctactttactaaagtaatattcttgaggtcaaattttaagatttatctttatttgccaggtgcagtggctcatgcctgcaatcccagtgctttgggaggccaaggtgggccgatcacgaggtcaggagattgagaccagcctggccaacatagtgaaaccccgtctctactgaaaatacaaaaattagcagggtgtggtggcacacacctgtaatcccagctactcg

SEQ ID NO: 50811 - DNA, 1044 bp, Homo sapiens
tcttaatacgcatgcccaagaagctgcttctccctggggcctgcattcagttcacacttttaatattatcaggtgtgggccatcaggagattgcctctcccttgctaccaaattatcatttttagggagacaatgtgatcattgctgaaccatcatgtgacatttctattgggtgggggagagtcctttcctgccctgcttattgcctatgtaactaactgtaacaactttactttttcatgtatgactattgtgtcaggcacattttgaagaagcatgagtgtttcagtaaattcaaaaacagatggcaaaagtgacatcaatgacaatggtgcagtagacactttctgtagtccatctctccagaaaagcaactcaaaacagttaataatgtataattagaagatcattttctcagcacgatatatggggcattaattaaaaacctacagctaataatatagtcaagagggaacgactgaaagctttgcttctaaaatcaggaacaggagaagaacacctacttttgccacttgtattgaacattatacttaaaattttagcccagggcgtcaggcaatgaagatatataaaatacatcccaattgaaaagaaaaaatggaaattatttctcttcacaaatacgatgatcttgtaaaaaatgcttaaaaatccagaaaacaacaatattagagctagtgaacagtatctagcaagcacagcaggatagaacattaactcggaaaaatcagttgtagttttatttgtgtacactagcaatgaataatctgaaaattaaattaagaaagcaattccctttacaatagcatcaaaatgaatcatatttttaggacaatagttaatagatgaaagtcttatacattgaaaatcacaaaatattggagaagaagttaaagataaccttgattttaaaaaaggacatcctgtggtagtgggttggaagacaaaatatttttaacataccaatactacccactgagatctataaatttaatgcaatcattattatcccaatgagcattg

SEQ ID NO: 50812 - DNA, 1050 bp, Homo sapiens
tggcgttttttcagacaagaagggcgggagaagaaggctccacgacacctgttagcacatctagagcactactgccaccgttaggacatagttaagcaacgccctacgccctatgcctaagccatgtcaatgtccttcccctgaagacagtccttccacctgttggagaaggtctggcctgtggggagggggaagaggcttgagctccatgctgctcatccttgccctatcctcaaagaccacactttgggaggctgaggcgggcggatcgtctgaggtcgggagtttaggaccagcctggccagcatggtaaaaccccatctctactaaaaatacaaaaattagtcggatgtggtggcaggcgcctgtaatcccagctactcaggaagctgagaatcgcttgaacccgggagggggaggttgcagtgagccgagatctcgccattgcactccagcctaggcaacacagtgagactccgtcaaaaaaaaaaaaagacctggacattggtagtgtcttggtatagaacctggagagtgaaggaaagtaaatactgtgaatgtcgcttggtaaaatcctgttccttgtacacggtactgatgctaccagagacccaaagacctgtagcaagatgcaagcacatgaaagcctgccaactcttgctccaaggggcaggaacaggagacagatgcccacaagagcctgcatgtgtgtttgagtgggttcctgttgtccagcaaacaactggggaaatagaggccctgccccggaaattcctgtgccaggactgcctggcagctgctgcttcactccaagcccctcactctccaggttctacaccaagataccgccaatgtccaggcctctcttaagaccttagaggagaaggcaacaagacctagcctggagcccaatcctcttccacctcagcatagattagaccttcccccacagcgaggcttccagggaagaatactgtaatggcggattctgtcttcaaactatttcctcacggtggcagtagtgcttcatattttcttggaagctctgtc

SEQ ID NO: 50813 - DNA, 1074 bp, Homo sapiens
atagaacttttatctatgtattgaaagtgggagcaaatacgaaaaagggtatcagtgttttttatttttattttttgagacggattctcgctcttgttgcccagcctggagtgcaatggtgcgatctttgctcactgcaacctccacctcccggttcaagcgattctcctgtctcagcctcccgagtagctgagattataggcatgtgacaccacgcccagctaatttttatatttttagtaaaggcgaggtttcgccatgttggtcaggctggtctcgatctcctgacctcaagtgatccgcctgccttggcctcccaaagtgctgggattattggcgtgaaccaccgcgcccagccttcagtgtttaatacacagttgtatggcattgcttttctcttgatcaccacattttttttagcttctttgcgaatcccacctctttgttactaatgtgaaaatacaggactgattcctaactgataaacagtaacacacatacacagcaaactcataggacatagttgtaagccattgcagtttaatgacccaggaaaatgtttgtgttacactgttatataatgaaactgtaagacaaaatcctgggatccatctgattagcatttatagtcattcctgtatttatgtacattcaagtagggttgtgtgtgtctgtcaagcttgagagctatctggactcttatgttagagccccactaaatagcgacctccctctcaacatacaaggcctactgactaggtctgaacatggagtaaacctcccagggaacctgggtagggagtcaggagaagaaacacgtggcctggtgcccagatttgctgtcctccaagacctcagatgtcaacatgttttttttcctttctctttagacatggatccctgaggtcggtccccaatacgacaagacaatttgatatcataatagaacactgcagaaacaatgctgagtgaagaagagtagaaatgggaagacttggttgagcggaaactgagttcttgaaaagaggagatgcttgatgagggtgagtggattacacctcagtttaatatcca

SEQ ID NO: 50814 - DNA, 1005 bp, Homo sapiens
tgggaggctgaggcaggagaatcccttgaatccaggaggcagagattgcagtgagccgagatcatgccattgcactccagcctgagccacagagcgagactccatctcaaaaaaaaaaaaagaaagaaagagagagaaagaaagaaagagagagagagagagagagagaaaggtcatacttagatacaatagattaaaagtcaaaaactgtaaagagaggcaaagaaggtcactgtataacaatgaaaatgccaatacagcaagaggatataacaattgtatatatgtatgtacccaacactggaacacagaaatatataaggcaaacatttgaagatctaaacagagtgatagaatggcgtacaacaacactgggagacttcagtactccactttcagtaatggacagcttaattagacaaagaaacattgaaattaaactgttctctagaccaaatgaacttaactgacctttacaaaatatttcatccaattgctatagaatatacattcttgtcatcagcatatggaacattctccagtatagagcatatgttaggccacagaacaaggctaaacaaatttaagaaaagacccgaaaatatgaaattactagaataagagcctggggaaatgctttaagacattgttctggggaaagattttttgtataagatctgaaaagcactggcaatcaaagcgaaaatagacaaatgagagtaaatcaagctagaaagcttctgcacagcaaagaaaacaacaaagtgaggagacaacctacagaaagagagaatatcttagcaaactattgatctaacaatggaataacaaatcacaatgtaaaacaaactcagctcaataaccaaaaaccaaattatctgatttacaaatgggcaaatgatctgaataggcatttctgaaacaaagacacaaatggccaacagatatatgaaaatacgttaaacatcactaaccgtcagggaaacgcaaatcaaaaccatgtga

SEQ ID NO: 50815 - DNA, 1030 bp, Homo sapiens
acttgtttcttggtggtggcattaactgtgacctacctgcttttctttaaacagggctactgtatctgaaaatattgtaaataagcagatctaatttcgagaaatgccaaaaacaggaaggcactcttaaaaacaacctggcatcccacaaaatatttaagaataatctttaagaatatttaacaagtttgcaaatgtttaagctacaataaatgtagagaacatatttgaacactggacatacaaatatatgggaactttaaatagagaagttcttatatgaccaatagaagacgtgaatgtgtgataaaaccattttaaaagtcatttcctattgggattgagagaccacttatttatgatatttatacacctatctgtgtacacatgtttactaaccatagtagtgattagtcatggtagtgattagtcatggtaatcatttcagttaccatgatctgtgcctatatccgtatgtatgtgtgtatgtacttatttatacaaaacaagatgttaaggagaatttgtacatgcatttaatgcaagcaaatactttcccttcaaaactttgtcagaatacacatctggtctgatccaaaccacaatgtacagattaatccaattttaatatagatttattttttgtgtgaacaaaatatagtaggcgtatgtatctatacattgaaaagtatggaagaaaataacccaaaatgttatcagttgtcttaacagattttatgatggtgttattcttcttgatgtacacaagattatttttgaactatatggcaaacatcattcttttttaattttttttttttagagactaaggtgtcagtatgttcttcaagctgctctgctcctgggcccaagctattctcctgcctcagccttccaagaagctgaaactacaagaacacaagactgtacctggcttgcaaacaccattgctaataagaagatattgtaagactgatacctaagagataagaggtaacacacacacacacacatgcaggcacacacacac

SEQ ID NO: 50816 - DNA, 1069 bp, Homo sapiens
tcgccattgcactccagcccaggtgacagaacaacattctgcctcaaaaaaaaagaaaaaaaagaaatctagccaaatgaatattccagaaaagagaactgaagtggatgaagaaggagaaacaggaataaagaccttacactcttcataaatggaagacataagcactctaaatagtcataattgagggactatactgcaaaggacataacatgagtacagaataaaaatattaaagaattttaacaaatcttttaagtggggaaaatataaaaggacgaattggaatacatattttaatggacacaacatcttgggttagttttgaggaagaatattaggtaccttgagctaagaaatagtgtgctttgggggactttatagtactttgtttcgggcaacattagaaaaatatgtggctattggtagacatggagaaatgaaggtaactattaatggaaattaacaattggtaaaaagatataatcaacaactcaaacatcagaaatgaagtggaaaaaaaagtaataaacataatgtaggaaggcaggaataaagttaagtgttttcttcattacagtaaacgtgagtggacacaattatctcctcaaaagacagaagtcattatattgggctaaaatacaaaacgcaaaacaataacaaaaacaaccctatacagtgcttttaaaaattaagtcacttaaagccaagaattataggaagttttgaaaattaaggttggggcaaataaatatcataccaaaggaaagtagcagtaccaatattaatatcagagaaatgcgcttttgaagtgaaaagcactaaaacataaaaagacggacattttgcaatgataaatagagtagtactgaaccaataaatcaattgtcatagaactgatacctttatgatactgcattttcctatgtttgatcatggtgtctgcatttatttcaatcttctttactattacttagtaatttttttttttttgagacagggtttcgctcttgttgcccaggctagagtgcaatgccatgatctcggctcaccgcaacctccacctccc

SEQ ID NO: 50817 - DNA, 1049 bp, Homo sapiens
agctattgtccttgatggtggtattccagtagctgacaggagtaaagaacactttatactctaccacttgtggaatttcagctacttgttacttaataactccaacaaaataaattgtagcccacttaagaggcataagcagccttaggcccctaacagcctctgaacaagccaacctttgaatcagcaaatacagtagctagatgagaaaaatgacaacttgaattaaaaaacaaatatgaaattattaagattcagatgcctcccaaaagcctttatttaggaaaatgctaaaccattaggaaaagttttgaaagggagatcaactgacattgaatgacaggctagaaggatcaactgcataacatatctcaaaacaaaggaaaaaataaagcaatgggaaaaataaggaaaagttaataaccttaaagatctaaggttttaacatattactaaaagatgttacaatagggaaaaaacagaataaacaaggcaaaatttaaggcaacaagtagaagaaaacttcccacaattgaagaaggcccagattgtagagtctcactgtggtatagaacggaataaagatatgcactaagcatatgttggtaaaatactagaattattaaaaagtcaccttataatcttcccaggtaaaaattaaaacttacaaaagaaatattggaatgagactccattctgacttctctgcaacactggcaaacaagtatcaatggaataacatctatagactattaggagagagagaatacaacataaccgttgtgtgtctccagccaagaaattattcatcagtcaggctgaacagaagttccttgtgcatatggaaaccttcagataatatatcatccacatatcctgtataaggataatacttgaataaatatctagccatggccgggcgcggtggctcacgcctgtaatcccagcactttgggaggctgaggcaggtgggccacctgaggtcaggagttcgagagcagcctggccaacatggtgaaaccccgtctctactaaaactacaaaaatta

SEQ ID NO: 50818 - DNA, 1442 bp, Homo sapiens
cattgggaggatgggaagaaaggatggatgttaagtgaagtagtaatattgatattagtgaagtgtagtgagggcaaagaaagtgaaatattcttctagaaggaagagtatatattatgaatgtatgggttagtttataaattggtaatatgggcattctatttagggatacataagctagtaaaaacttattcgctaagagtgttaaaagtgtttcaatcagccgggcgcggtggctcacgcctgtaatcccagcactttaggaggccgaggcaggcagatcacgaggtcagaagatcgaaaccatcctgtctaacacggtgaaaccccgtctgtactaaaaatacaaaaaattagccaggtgtggtggtgggtgcctgtagtcccagctactcaggaggctgaggcagaagaatggcgtgaatccgggaggcggagcttgcagtgagccgagatagcaccactgcactccagcctgggtgatagagtgagactccgtcttaaaaaaaaaaaaaagtgtttcaatatcggaggaatgtcagagatggcataatgttgtttgtaaagtattgtacaaataactgatgttgaaaaatgtgttcatgtataattttgacttaaaatctttaaaaactgtatctatctatctctctatccatccatccatccttgtggtatataggcagaatactaagatgattccatctccctgtataattccttaagtatgagtgggacctgtgaatatgatagattatcacttctctgattcctttatattatatggcaaaaatgatagggtctcaaaagggagattaccctgggggggcctgatctaatcaggacaggaaaagagggcctggtggtctgagatcttctcttttgctagcctcaaagaagtaagcaattatgagttctatagctgcaacaaaatgaattctgccaacaaccacatgagcttcccagaggatcttgagcctcagatgagtccccagccctaaccgacaccttgatcgcagccttgagctgagtacctacctgaactatgcccagactcctgactcacagaaactgagataaaaaaaatgtatgtcgttttaagctattaagtttgaagtaatttgttacatagcaagagataataaatacaatgcttacacacagggaagaaaaaaaaaaaagaaaacctagtaaggactgaaagtttgtgttacctcgaaattcatatgtgaaagtcttaacccacagtgcgatggtatttggaaatgagacttttgggaagtagttaggtttagatgaggtcataagggtggagcctgcattatgattagtgcccctataaggagatgaagggacagaggtttctcactttgccttgtgagcaacaggaagatgtccatctgcacacctggaagaggaccctagccaggaactgaattggc

SEQ ID NO: 50819 - DNA, 1052 bp, Homo sapiens
catacactaagaggccaaaaaatgttacacctatagccaaggcctgtcccctaatagagttttgccgtcatctcaggtctcttggtggggttggtggggaagaaggaaggagtgctcatctctttatttgttctcccagaggatgctgaactccttgaagtctagtgattctcctcatacataacaattgttcttctctgttacttcttcataaaaagctccagatgaggatacctggtaagcctgacaacccatacttcttgttcccaagttggtggagaatgtctagaattacttgggattcattgcataatggagaaacattctggcgccctcttctactttcctcactcagttagcatttgacctcatagagtagttgaagatgattttttgtatgtgtgtttgcgcgtaagcgtcctgtgactaaaaaatttaaaactttctgtttctgtcgtatttaaaccaacggcaaaattggtaaaggaattaaacaggcaatttacaaaagaagaactccagctgtttattaaataaatgaaaagatactcaattttactagtgtttacgacgttccaattacctacacacattgtgtttatgtatatactgtgttagtttataaatatatgcaccaatatttgcacatattcctatatctatgcacacatacctgttatatatatatatttatatgtactatgtatatatgcatgcacattaagttatatacaattttacaaatatagagatatatataaagacatgtatgtgtaaatgtgtgtgtgtgcacaattaaaataattctattcacttaaatattatattcaattacatattaattatttcagttaaatattataactgatattatagtaaataaatataactgaattatattaagttaaatattaaataattctattcagttaaatgattctattcaattaaatatcctatttagtattcttttatccccaaggcttagaacagtgcccggaacttggcagcaactagataaatattggttaaaggaatgtatgatttcctct

SEQ ID NO: 50820 - DNA, 1024 bp, Homo sapiens
catacacctagcaactattactgatacagtggaatgtgactttgaactaattggactgaagggaagtactttttgttttatggctgagagaaacatttttctctctctgtcactgaaaatgaacaggaaggatatttcctcagtggctttaggaagtcatcttcaatgaaggaagccagtctgggacctgtgtacacacacagagaaggactgagctgagagaagtggagaaaaatagaactgggaacttgattgtaccatgctcagaatccaaactatttgggggcttctagacatgtgaaattaaaattattatttaactcagtttatgttggcttttctgtttcttgcaagccaagatatactaatacaaccgtctactcccttaaggtgaagcttctgacacttacggagaatttcagggctcattttatttggttggtgcaagtggactagaaattgagataaacggataaacaaaggtttacagaggcagagaatcaattataaacacggactttggttataactctagataattttcattggcccaatgttagggaaggaaactagcattagttgaatgcctattatgtgccaggcactttccaatatttgaagacacttaatcctcacagtaaccctgtgaaggaggtgtaagtttgtctgtagaaagtgaggcttactgaggttaaatgcatagcccaaggtcacacagctcataagtggtagagttaaaatccaatcttaatcaagttagctacacatccagtgctgtttctgttacatccttgacagacaattctttccagataattagagtctctacaccagagaaagctatccaaagctttagaccaatcctcttctataatggtggtattatgtagtggttaaaagcatggactcacaccaacattggcttaaattttggtaccaattattcaggtccatttcttataaagttcttctttgcactgaggcaagctggcaccattcaatatctttttgaccttcaatgagt

SEQ ID NO: 50821 - DNA, 1032 bp, Homo sapiens
attatcatcatgctgggctgctgctgcttcctgtagccaagaatttaaattgttggaatgagcttagtggaaagtcatgggaagaggctccaaggtagtgagaagagcaccattaaattagctaactacagagtgtgacctaggaaaagaggctgttgtgaccatatcatgtggtcatgattcaaatgaaatgggaagtactgggtgattagatattacaggtagggtgaagaaccagttcagtaacttcaaggagtgatggagacagcatggaagaatgacatgattagagatgagactgctgagtccaaagtggcaattgctattctgtggctgatatggatttaaaggagccagctcttctacctcctgccattatgttcttcaatattcctgttgatgtcctcattttaccaaactcactggagtcttgacttcatagttacgttcttctcctggttgctcaagtacaatttacattaactttaattctctgtttttaaacattctcccatgtagttctgagttccactggcacaaaatttaggtaacaatttgggtgtgcgtgtgtgcatgtgtgcacatgtgtgcttgtttagtgtgtctcagcttatttctctttggttgcacatatgcctattgataggaaaattatattcaagaagactcggttcaaatatatgtggcattgcatgcttaagagtttctaataatgctgattttcatatttcaaatgtaagaaaactgacttttgaggttcatttgtctgagagttcctaaggatttagtaaagctgcttttggatataggcctgagaactatggctttatgctgggttttgaatgtgtgagtgtggatgtgtgtgtgtgtctgcctgtgctcgctcaagagctcacatgtgcttgcttcccccacctcctgtgctttgctgtaattgaaacatcacagagcagcccccagcaggacgccagcaggtaccctgagggctactagctgtgtgattttcttagagttgtgaaaaagaaacttgag

SEQ ID NO: 50822 - DNA, 1024 bp, Homo sapiens
tctaagaattgcttctgataattcctcacatttatgtcttaacatctttcaatttgggtcacaggcctcgtgcctaacacctgtttatctgcgtggctcccaggattgtttcctcaccttttaccctcccattggcagtaactttagtgtaagtttggaagcataaccagattccttatacgctgccatcatcctgatttctttactgatctgaggagcgtatgatcaagtgctttgaagggacttcttttgctgtatggcagcagtataatggaaacccgggtcagcattgtcaccctgttctggtttcattcactatatcatagctcttctgtgctggtataaattattggcagttcactgtttgggtatatttttgttgagaaggattgatgttttgttaataatctcatagtactataaaagaagtaaatcactgtcctgtgggagttcagggaaaggagagaccacaaccaactggaacagagtttcttaacattctgggatctttgctgtttggggctgtcctgtgcattgtcagatgtttaacagcatccctagcttttacccactagatgacagtagcatcttcctcatcccccattatgacaagaatatctccagaaattgccaaatgccccctggggacaaaaattgcccttggttaagcgccaccgagttagagatattgggagcaatagcatttgaatcaggctttgaagatggataggacttgaggggactggtggtaggggtggggggtgtcagtgttgaccttcaaacagaaagaatgccaagaaggagcataatcatatcctaaaatattctgttgattccctaatagtaagggggaagtgcagtaaaggtgtctcttaaatgtgacagtttgatatatccttttggcaaatagaatattttaaagatgatttttcaaggattcctttatgtcagtccagtattgatgaaagtgataaagaaagaaaatgggggaaaaggtgttattcactgtggtttgaaggtctcc

SEQ ID NO: 50823 - DNA, 1035 bp, Homo sapiens
ttgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaagg

SEQ ID NO: 50824 - DNA, 1112 bp, Homo sapiens
ggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattcta

SEQ ID NO: 50825 - DNA, 1066 bp, Homo sapiens
actcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaat

SEQ ID NO: 50826 - DNA, 1025 bp, Homo sapiens
taagttttactatagtctctaaggatgctgttacatcagctctgttttctatcccttgggcaactgttaacttttttccgtctaggtcccttgcactctcccacactttatttaaagcttcaccttggctgaagtcaaacctaaaacaccaaataaatactataattggctcatttttaacattttctttgaattcctaacagcccatttaccatatctgtcattaactgggatcttggctttattgagtgcctacctcacaccaagcatttgcacatctgtcatatgacttattcctgctaggaaactgagatactgagtttaaatatctggacagaggttcaaattcaggtctttgtgattctaaaccttattctgtagtgtatacaacaacacactttcttcacttctctgggtctggtcttagtttcctcacctgcaaaagggaaaaaaatatataaaaagtagactgagagcctattaagtgttaggcaccaggctaggttctgctctgaaggggttcacagaaatagacaactttaatttaatgggttcatggtggtgatgtctgtttgaacagtgttttgagtacccattgatcccttttacttggtgtaaatcaaaagctggctctcgcagaataagtaggatttctcccattctaaggaagcacattccataatcctataagacctttaaatatatttttaaaaatcaaatttatgttgtactcttctttctatacacaggtttattaagtatgtggcatggaaattatagtttgttagactattaaagttcatgagaacaggaaccatgtccactgccttgtactaatacttaatacatatttggaaaacaaatgaaagaaaaaatagttttaaatatggagactcttacacaactgacaatttgaagttttaatgagtaactactatatagtgcacactacctttattatttatacaaatttcaactcaactagtatttattgagaatctagtatgccaagtactgtactagga

SEQ ID NO: 50827 - DNA, 1022 bp, Homo sapiens
tgatcatctcagatccaggagaggagctctggctcatattattcctcatgttggataatcattaaaacagaagaaaataaaaccctcttgaaatggcaggttttttaagtgaaaataagtaaggtttccttggacccctataaggagactcttgtgaagcatgcatccagacttctgagactttatactttttgctttctagagcaggaaagacttaagaaataggaagtcagaaagtacagtaaaaatctatgggttctgtgctgttaagggtccctttctgattggcttggtgtgaataatggtatagaatttaaccatgtaagatgttagaggcctgagacttcccttgacatttccttatgctggcaggcccaggcagtttgactttggctcttgtggcacttgggtggcaggagaaacagtgtttacaaccaccttcacctccaggaatgtattatacttttaaatcaatcttagtatctgtaggcaggagtttatatataggaataaaatttgaacccccattttcacacccaataaaaacgtcctgtaataggtgtttattcagagtcaactgacatttattgaacaattactgtgtgccagatgctctgctaggtactttcattttgttatgacagtttttttaagttatgaaatacagttggttctagctgggcaaatactctctttggcatctaatagatatcaggctaaaaattgcatcctcaagtccctgctcactttttgtataaaacacaccccccaacacacaatcatttcttctctgtcttgcttcatcatttgggaaccatctaatggcccatggcctgcctcttccatccatgaagatatttatttcattataaatcaagccaacactaatctgttacccatcttgatgtaacaaaaggctgctttcactgtttgatggatggtgctacagtaggataggagaaacaggaagaggcttgagaggtggatgaagagtgaggggtcaggagtgtgaaatgatgtgg

SEQ ID NO: 50828 - DNA, 1030 bp, Homo sapiens
ctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggctctgagtaatctcataatttcaagatttgcagctgctagacattgtgatctcacaaaccagaacagaatttttttcaacaagacatttccttttatcctcttggcagccaggtatgaaaattagatggcccattctaatccctcacactaaaatggccttaatttggggtgattccttctgggagtccatgttttttgtacaagcgtgtccaacccacaatggtgctcttcattctcccttctatccacagggtagagtttaaatgtaagcattaatgtattggtttttaaagtcccaaacacaaaatgtgcacattttttcaaacaaactcttatagttagcactatgggggagtggggtatgatttgtccttgcgcttttccaaagagactttaaatgtcagtcccaaggggttagaggaagaaagct

SEQ ID NO: 50829 - DNA, 1066 bp, Homo sapiens
tctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtac

SEQ ID NO: 50830 - DNA, 1043 bp, Homo sapiens
caaaagcttgtgacaaatgaaagcattaatattactgcttattttttcttttactttcttttttcttttttgcaattgcacctttgtagaaaaagacgaatgacaaaagcataaactgatgtcagaatgtattcctaaagatggcttttagtggagtgtgctcaaggatgaattcatttatagcctaactaccttttccttcagtagtcccccatccagaatagtgtgagatctttgatcacaacaaaaaattccagtttatcccagaaagtgcatttattaataaggcaggaaagtagcctaagctatttgaaaaggactttcaataaccggggataaataacataggctggacatgctttgatatttaacctagtgctagtcagctgtggcaaagggctgtttaaagatatctttaaataaattaggcagccttttgtgtatttgaaagaacatcagctttggagttaaatagacctgtatttgagtcctgactctatcattcattaactttgtacctacctcattgggctgttggtgaggattaaatgtcataaactaagtaaggctctcatagtgcctggctcgtgacaagccctcaataaatgtcaactagtgattatgcttgtttcagctgccaacgtattgcagtgggggacagtgtgacctggccagtatgattctgatgagctctgtttggctcagtttttctggttgtctgcttttgccagttactgaaatgtggaagcaaaagccccagcaccataataacaatataacataataacataacataaacagtgcccatagattagatgctacaagaaatgagtaacagatccaggaagaaagagtccagccatggaaatgtttcttagcaagttcacctgcatctctgtgatggttaggatatacagtacacttcgtgacataataaatccacccccccaacccaacatatatgactttccatgctggtcatgcttctatagcttagtcaagaagagtgttctgttaatcaagccttgaaaagcaggaaccat

SEQ ID NO: 50831 - DNA, 1021 bp, Homo sapiens
ttctggttgctctatttcattgcctggatgtgaagctgggtagccagccctctgtttcagggaggaacagatggaatgggatatgtctgagcagcagagccagactaccctggaaatgactttcagggaggtgcaagcagtttcttctatgccaacagtgagccaaattgacaagacagaaaaaaaaaaaacttcagtgcagaactgtgtcactgagatcaggaagcataggttttgcagaggttgacccatgaccaatcaggccagaccactgcatttagcctcacatatggttccctttggtaatgtgaacctgttattctggccaacacagcagaacacagtcaatccatttgctgacccattggattatccccagaaagcaagtaactgtcaaagctgggcatgtgtagtagccaccaagagcctttataatgttcatttggtattggaacattttcatactttacatgagaccaattattttgctgaacacaaggacactgagactcaagaaaggtaagtcactttccatgaggcacacacctagctactagcagagggcagcctagacacctggtcttctcatacttgtcccatgatctttccactgcaatgtatgctacagttcttctcccagagagcaagatacttcagctaattgcaccaagggaggccaggagccagatctcaggatgtccagccaggtgctcttccctctttttgtgtgggctctgccagctactgtgaaaatggagactttttggaaaaattagaatcatcctacttttaaaaaaatgtagcagtagcggtgatgaaaggaaaaagcatgtacttctcaactgcttcattttttcttctaaaataatggtatctctggttctatttggacagctacctttcctcaacagtattgttgagccatctcaagcctctaatctactccatcaatgaagcaatagagaactcatatatcactatagctattctctctcgaatcagccaaccaaagctaaggaga

SEQ ID NO: 50832 - DNA, 1058 bp, Homo sapiens
cttctttttcaatttggatgccatcatttgtttctttcttttcttttcttttcttttcttttcttttctttttgaaatggagtcttgctttgtcaccaggctggagtgcagtggcacgatctcagccgcagccacgcgtgatcccaggttcacgccattctcctgcctcagcctcccaagtagctggggctacaggcgcccgccaccacacctggctaattttttttttgtatttttagtagagatggggtttcactgtgttaaccaggatggtctcaatctcctgaccttgtgatccgcctgcctcggcctcccaaagtgctgggattacaggcatgagccactgtgcttggccaaaactacaagtttcattctcttgtctgattatgctagctaggactttcagtactatattggttaacagtggtgacagcaggcatccttgtcatgttccagatcttaggggaaagactttcaatttttcctcatttagtatgatactagctgtggctctgtcatacatagcttttattatgttgagctatgttccttgtatacccagttttttgagggtttttatcatggagagattgaattttatgagatgtgttttcagcgttaattgaaatgatcatatagtttttgtccttcattctgctgatacgatgtatcacattggttgatttgtgtatgttgaaccattctagcatccacaggatatttctcacttggtcatgatgaatgatctttttaatatattgttgaattcagtttgctagtgttttgttgaggatttctgcatcaatattcattagcgatattggcctgtagttttctttttttgatgtgtctttggttttggtatcagggtaatactggcctggtagaatgagtttggaagtattccctcttcctctatttcccagaatagtttgagtaggattggtattagctcttctttaaatgtttggtagaattcagcagtgaggccatgaggtccagggcttttctttactaggagtcttttattacagctttgatctcatgacttgctattg

SEQ ID NO: 50833 - DNA, 1053 bp, Homo sapiens
tgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcccagctcggtgcagagagaacatctcgagtctgcactgtctgctgtttctccgtaccacggtgtgctagcaggaaagccttcaaaggattaaaacccaagtatttatgagctaaacataatgtttccctctctctgggaatgcccagtgagaataccacttacatctgcacagaatgattgcatttcgcaaagtactttcacatgcgttagctcattaaattcttaaaacttttactcgtgggaaatagatagacactacatttttaccatgttacaaatgagtaactaggtatgccctttaatctctgatccctgaccccacaagccactcttcaaggcttgaacccatggcttctagtccggtctttccatcatcctgaggtgctcagttattcgagcctgtagctaatgactgcaggacacataatcatagcaactcacatttattgaactcttactatgtcccagacacttcacataattttaatttaatcttcacaacaacctagtgaggatcatatcattattgtcatcggcattttacagaggaggaaaatgacattcagagaggttaagaaacttacccagggtcacatgatagtaagtgacagagttaagactgaagctgagtcaattgaaaagtagaaaaattcttaaccatgatgctctgttgctggcaactccctgtcccttaccctttccaaaaacattaagaataggaaaaaaaagaagagtgagttttccctcttgggctatgctagcaacagaggcccaaggggaaatgctgttttaagccaacctcttggaaagggtcattagcagctgacatgatgccaatatggaccaa

SEQ ID NO: 50834 - DNA, 1056 bp, Homo sapiens
tctaaagctccacatacacataagtgattataagaaatttaacaaagggtagtcacataattgacattgtcctttggaggagagaaaattggtgctatccccttggtggacaggttccctcatccttaaagcacatttccagagcagaaggaagccttcatctaagtccaagcgctacatttctgatatgagagctagtttgagatttaaatgaaccctgtctctcaagacacagctttgcatctattttgcattcaaatttatttatctagagacaaaattgtgcattctttaattctactcacagcgtatgcacgcagaccaaatgaggtgctgatccagcaaaacggcaagtagccttttgcttccctgaaattgctaattttacaaatggcagagtggtgaaacgtggcacggaatatctattttactagaatccggcaaaacgggcacatatggtcttgtcaagaatgaatcaaacacagtttcgggattataattaagtagttgaaattccaaaaggaagaagttaatatgaacaaagtgagatttcgattgcttttggttagcattctctcaggctccttcctttacacattatcaggaacatagctactttgatttcttgtcctgaaaaatgtttaattgtaaaatatcaaacgttttcaccccaactctaattgtacttgatttgacatctgtacaccatgctcagggtaccaaatattattaaatgtaataagtccaggcatagaagtcaagccaaatgttcctacgtaagtatttaggttgacaccttctgtcaacaaagctaaacctctgaccaattctgtagcaggccaataaagatacaggaggaagatgggaaccattagaagaaaacactctctcctcatctctctctctttcagtactgtttctacctgaaatcagggacatattccattctggtccacaagcccagcatctagcacaggggctggcatgtaaaaagagttgatttgggctgggcgcagtggctcatgctgtaatcccagtactttgggaggctgagat

SEQ ID NO: 50835 - DNA, 1033 bp, Homo sapiens
ggccgaggcgggtggatcacaaggtcaggagttcgagaccatcctgggcaagatggtgaaatcccgtctctactaaaaatacaaaaaaattatccgggcgtggtggtgggtgcctgtaatcccagctacacaggaggctgaggcagagaattgcttgaacctgggaggcaaaggttgcagtgacctgagattgtgccactgcactccagcctgggcgacagagcgagactccatctcaaataaataaataaataaattaaattaaataaatgttcttgaacatggggaaacatattttcattgcagtttatttatccaactgagtatttattcacttatttatttgctttctctagtggcagtgtaggggacaacttaaatggaggggagatcagaggcaaaaaagtcaattgtgaggcttttacggtaggtaaaaggcagcgaggacatgaactaggggcgtggtaatggagaggaggggacacatataagagagggattgacaagacaggacatgtgaccaatttgatgtggtcagagcaagagtcaaagagagtcaccaatgaaggcatgattttttcagcctgtatgttgtgatgggttgaactgatggactgagataagaagcctgggcatcggtttagaaaaggaaggaaagtcaattcaattttattataatctaactttctctgagtcctccacgtgttcagtaagcagatggacatatgggtctgaagcttgagggaaaacaaggatggaaccctggggaatatctatatgtgtgatctgggcggaataaatgtaacaaacaacctgaaccatgaggaaacagttggagaggtagcaagaggaccaagagtaagtgagagagagcatctaaatcatgggagaagggaatttcaataaggaaacggaggtcaacattgctaagcgctaaagaatggccaagttagatagactgaaaaatgtcccttggatttagtaattaagtaatttagtaattaaagaggttattgagtaataagaagcaaac

SEQ ID NO: 50836 - DNA, 1134 bp, Homo sapiens
tgggagtctctcccacaaaattgggctcttcacctaggttttgtagagcctttcagtatccataaagcccttcaaactagatgcaaaaatatgtgtgtatattcaagggagataggccagagttttcatcaacttcttgaagaagtccatcacacacaagagggttagtaacttccacataatcctaaagtgcatgtagcacttgccaggcatgaatatgattcatgaatatgtgcatgaacttaagcaaactcatttcattctcaccatagctatcagaggtaggtatgattatcatgcccattttacagaaggggaaactgagactaagagaggttataaagctaataagtgacagcactgggatttgaggccaagcagtctagctcctgcttttaatcacttttgactgcaatttcctttttatttacttgcatatctccagcacagtgcccgacacataatgggatgtttattgatatttgttcaattgaattgatttgcacactgccggctctgtgtagatttcatcttaggaatcattctcaaaggtgtgactccgtaagtcttggctggacgaatgaaaagaatcaacatggtcaaaagataatttattagagtttctaaagacaaatggcttggcaaagcataggcattttactttcaatcagtgttccctggagggctgttacactgatttccaagcccattcttctcccaactggctcactagattgttccaattggttatgtggtgcccctgagtatgggctaggtaactctgcaggccccatgaatctatgtgatgtttcatttcctgattactatgcataatctcccctgccttttatttccaagtgaccaaccagaagccacccaaaccctctgcatattgacatgattcaaatgtaggtctctacaaggtatgccaagcttattgaggggaaggtggggggagatgcgaatcctgttcaaccacctcaatgcaagttgactgtagttgagtctctaggatggggcattcttaaaaatcagaacaaaaattggctgtgattgtgaagagtgtatggtgaattggcaagatggtgagtaacaaggtggagcagcctgagtttttaatcaccttgattacat

SEQ ID NO: 50837 - DNA, 2108 bp, Homo sapiens
ggatcactcagatgcctcttcttgcctctaaagaatgggaacgggggccaagtgcggtggctcacgcttgtaatcccagcactttgggaggccgaggtgggcggatcacaaggtcaggagatcaagaccatcctggctaacacggtgaaaccccgtctctactaaaaatacaaaaaattagctgggcgtggtggtgggtgcctgtagtcccagctacttgtgaggctgaggaaggagaatggcgtgaacccgggaggtggaacttgcagtgagccgagatcccgccactgcactccagcctgggcgacagagagagactctgtcttgaaaaaaaaaaaaaaaaaaagaatgggaatgggaagcaggaactatgatttcattacagtgaggaaaaactgcttttgatgatctctcagtaactataagtaagaaatattctcttatttaaaaggaatgttatctatctttgttaatgagggttttatggtggggggaggtgatgagaattatcagtcaaatcactttgagaaggaggagatctgaatttcataaataaaccctaatttgttaatgggaactgatgccaaaaacaaggagtttttcctccttgcggtgacactgaatgtcctgggctgtggagggtagaaacaggacattctcagtgttccagctcacaggggtggagttagagtaaatatcctgcccagtttgccatcacactaacactgcataccctatcatcagcctaatgacctttcaattctgattgaatggaagagcactccggcccttgatccaactcgtggttgattacagtgctcatgccccattaccccaaatattcctataaattaccagagcgagcattcacgcttatacaccatcatagatttagctcatgccggtggttctcgatagcagccatctgaagctccttttgcccacagctccctggatagctccaccattccctgcatgctagtcttgtggtttggtcttcagcctgctgtctgtactttctcacacgttgcatgggctttctccgatgcctacaagcaaaatctcttttccattcttcctttctctggctcctgggttcagaaatctctagggatcattatcagtcctctggctgccccctctcctacctacctccatctaccctagctctaggacagacctatggcgatgcccaactttctgcattttgaaataggggtgattgctttgacttgggccctatctattagggtctttcatctgtctattttggacaaagacaatagcagtgaagcagggggcctttgcattgagaggctcagactctcaaactctctcttaaaaaaaaaactgtctggcattaaggggcatagtctgcttgccttcaatagacctcaggctggggaggctcgaggtgcctactagggcagccagtttgcatagtgccttctaaaagcaggaagagccacccttgctgccttacagcctttgtccttgggccttagaatgaaacgcttcagagctcacaattaacatttggccaagcctcttcctcacccccacccccgtgaagtgggaagaaatacggtggcgtgacattcactttgacaaagctctttttcttttctctacttctcaaaaaagcctaaagaaataaaaacagttgctaagctactgggtgggctctatcggtgtgttttgttgcagtcttggcgttaaggactcatgctatcatatatgcagcagcttagactaaagggaggaagcaaagtgcttgagagggctctcttgcaagttcacttttttgtcaggtcaagtgcttggctctgggatggcaggggacatggagcatgacaactgcaattctctctccagatgggaaagtagaagggaggatttcttccaatcctcaaattcttccaaaagagaatgctgttttggaaccttgtctttctttaccatttatttcagaaaggttggatctctaggaagcatgggtcatactcttagttctctgggtattgtcttttgtacacatcacatgcagttggtgctactgatggggcctggacactagctagttctggtgagctcctagctcagtgtgc

SEQ ID NO: 50838 - DNA, 1030 bp, Homo sapiens
tcaacataggacagagaatttccaggccaaggattctctgcagtttgtgtcctctgaacagatacaaatgggccttttagcatgatgcccctgaaagttgactgaagtcactgactcaggtctttacaacccagtgttccactagttggtttcctcctttctctctcctcgtataccccagtatcatactagaatactgggatctcagagaccttttagttcaaggccctgttcttatagaacagaaaacagaggcttagagaggaaaggactttgcccagagtcacacagttttagaagtgtcagagcttgggcccacatcaggactctctccacccaatgagctatgctagtgtttgccaaaggccttctccatagaaagcaacaaattcagattaggaagtgtatttcaatcactaagtagttgttttagctttctagggttaacagttgacaaactttatcatagatgaaggtatccctgaattaagagatggatttcagtaatgattgctataaaatgagtttttggtaagtggcctctatagccttgtggatttcaataaaatcagatgtccttcaaatggaaaaaatgttgaccctgctgaatataataaaatggcactttttaatgcagtaaatcttttaaactcgcatttaagagaaaagcaatgacttttaaagttaaagtttaatggtatcccttacttggaatacgattccagttggagaataaatcatagaataaaaatacttagagtaacaacaacaacaaaatgcttagagtaaccatagaatagaggccaggccttctggcaggtattcaggctgccttccttatctgacaaactattcacaacatagagcagtcagtccctctaagtctggcctcaaaggtcccaacactttgaattcctttaccctttttcttctgactttggccatcatttcactttatggcctttgttcaaagatacactgtctgcttttctacttttgcttggaagcaaaatcattttagaaagctaag

SEQ ID NO: 50839 - DNA, 1050 bp, Homo sapiens
ttctctgatgagtaatgattttgagcattttattatatgcttgttggtcatttgtatgtcttcttgaaaaatgactattcatgtcttttgcccgctttttaattggggtgtttttttaaaaaaaaatagtgacggcaggtggtatgttcctcacacttgacttgtcatttacaactgaatttttcagctcacgatattgaaatccagaaccactttttctatagtcaagtgtgattcagcaaaaaataaaaccttcttgcattcatttggaagtaatatatgtccttttggaatttctgtgtaagtccttttttagtgagaaaaaaatcaagtccaagttaaaatgataaaatactaaattcggtgttgccaagtagagtttaatttcaattcagatactataatttataattctgggtcttaggagccaaagcctccttagaccatccctttaatccaggcctatcatttggagatctcatagctcccttcactgtaatcaccgtctggtgctagatagtggaactgagatacttctttgctaatgacctacttgctttcagatacagggcaaccagcggatggttcctgggatctcatctgatgagtgacatctttccggacagaactgatgactctctggcagtaaaagggtggagagggcagggcagatatgtttcacgagcaagaagggaaatagtgtgttgtaaagctttgctgtaggcctgccaggatctggtgaagtgggtgggcggggagagcttgtgttcacagaagagtcagatggttaaagaatttatgataattaaaatgacgtttctatgtaagtctgaaggaatacagccataaaaacataattgctgtaaaacatgctgcatcagactaaataaccacttgatgatggcaactatgcctgtgccataaagaaacctgtgcttttgtgaggagaaaaaaatatgtatttattatggctatttgcgtctcatgttaattgttcacaacaaagccattgattaagcaatgactccttacaagatggggctggatcaa

SEQ ID NO: 50840 - DNA, 1035 bp, Homo sapiens
tgctgtgtgaaaaatgaatgtgctgaaattaggctgtgtataattgcaacgaaaccaaaattgagcagatacagttcccacagagaggtggaaaaccttgtcagggagcattcgccagcctgagctgttgtttgtggctgtgtgtggaatggactcaaagcccactgtggctgctggaaagtggtagggtgatttgatctattcagtcagaactagctgatgtagtgaccgaattatctcaagtgcttcccctcctgttatgtaggcaaaacctctaaattcaatgggttggattttttctaacctttaatcatttgcgtttgatatcatgtcttcattgccagtttcctccttaacccaacgtctttcatcttcaatcttcttaaactttaaaagatacaacccttcatctttcctttgatcttcacctgatgggcatgttagctgtgtccatcagtttcactaacctatttctatgaaaacagagaaaatgtttaacctagtatgacgggcctatagattataaaaataattgactaattttgttgtaaaaaaatactactctttgtaaaaacaaatcagcaaagctggagttttgtctttataaaacatgatgcttggttgcttgcttttttcaccttttaactggctatttgggtatcaagttcaactgaagtgtacttttgagaactgtcacagtagggcctccccattttatatggtagctcaccaaactgactgctgctgccagcacccttttggtttgctcttaattctattgggagccctattgctggcaagaaggctcctcatttaattcccataataagcttcattttcagcaatgcctccctaccctgagcttcataaagagtatcatgcctgtcgattttctttacagaaaggtgagcggtacttctgttgcccagtttgatacccagtagggagattcacaagatgccaagggtcttctacagaggaggtactagaagagtatttgtggagtatatgaaggaccaaggatgcagcaactaa

SEQ ID NO: 50841 - DNA, 1406 bp, Homo sapiens
tctagctgttaattttagttagttgagtccagagtaaaggtttgtaaagggcataagaaagcaacattacttttttctcacaatgagcacttaaaagatcttttaaaagtgtttctgtaatgtaaaagaaatagtcttactgcagtttttaaaagcagaaggttccttgtgtctattaaaattattttaatttattgtcatattactgtaaattggaaaggaccacaaatatattatgcttaacttccagattcaagtgtcttgcaataagttaaacacatgtaatggtttatgctctttaaaatgtttttgcacttattttattctgcccagcagggcagagattattgtctgagtttcataggtgaaggcgttgaagtacagatgcttatccaagaccctgctgtttgttagaagcagataccaggacaagaaacacagcttttcttatttcacagcacttggccatagcaactactttttgctgttttattcacattgacatgaataggttagtacctgaattctttaagacagatgaaaagtaattaagtctgagtctcctcaaacaagatatccctctgaaaagatggatgttgtaggatcatgaagatggcagtctttaaaaatctcagcaaggaacagcattgtgactagcgatagagtaaaagctgtgagaattgcacagattccaaaacgctgttaagatgatctgctggtcctttttccaaatggggaatatggtgatatggttttggggtatttgtgctttatttatttatttattttgagacagggtctcactgtcacctgagctggagtgcagtggtgtgatcaccactgcactgaaggctcactgcagccttcacctccacaggctcagataatcctcccacctcagcctcccgagtagtttcgactacctgtgcataccaccagatccagctaatttttgtattttttgtagaatcagggttttgtcatgttgcccaggctggtctcaatctcctgggctcaagtgatcctcccacagtgctgggattataggcatgagccatcgtgcctggcctatttgtgcttttgatgtacattagtccctaactggctcttgagcttctgcttcatgcctcccacagtgccaactctaggattgtaagctccccaccctgattcacttacaatcataatgtagggcttgatgtaaaacatgagaagacttgatgtttctgggtaacaatgggtgcagctcttgattattcatagtctgattatccttactggggagtatcctgtctcattttacttcttgttgtctgaatgcctaccttttacctttgtaaactccagatttaaagtttgtgtagggtggggtgcggtggctgacgcctgtaatctcagcactttgg

SEQ ID NO: 50842 - DNA, 2555 bp, Homo sapiens
agaggaacatcacacatgagggcctgttgtggggtggggggaggggggagggatagcattaggagatatacctaatgtaaatgatgagttaatgggtgcagcacaccaacatggcacatgtatacatatgtaacaaagctgcacgttgtgcacatgtaccctggaacttaaagtatagtaataaaaaaaaaaagaaaaaaaaagttgttggttaaatagtctctgctaaatttgcgacacatcttcccagataagattcttctctccgaacctttttttttttcctttttttttttacacagagtctcactctgccatccaggctggagtgtagtggctcgctgcaacttctgcctcccaggttcaagtgattctcctgcctcagcctcccaagtagctgggactacaggtgcatgccaccacgcccagctaatttttgtatttttaggagagacagtgtttcaccatgttgaccaggctggtctcgaactcctgacctcagttgatccacccaccttgacctcccaaagtgctaggattacgggcatgagccaccgcacctggcctctctgaacttttttaccagtatttattttaattttggttgggggcagtagagagatgcagaaaaggaaaggaaggcatgaaactgcttgagaaatacatcagtgaataaaagttttttaacatttgtggtgtaatgacaaatcctggagaagttttagttcacacctggagtattccagcagaagttggatgccagccgctaggcattcattctgcagaggggcttctctgttaggtacaaggttgggttcaagtaccttctgaagtctagctcagtgtattttttggagtgtagtatactaacaggcaagaacaagaagtggaggagatgtgccaggggaggaatagtgatgacgttgtaggtgctcagctcccagatgatgggaaaagtgtttcatggcctcacacatcttttgggttttttgttgactgtctcccccattactcaatgagctgctacagcatagggaatgaatcttcaacttgtatttccagtacccagaacagaggcttgtactaagaaggcattcaattggtatgtaatggattagaataagttgaattgaagattgaactgaagtcaaaatctgatttctaaggttccttctggcctgaaaattcagactcctctgatttcaaccataacagcctggctaagcctccttgagagaaaccctgtgcttccttagtttaaccacctctttgtggttgaatagtataggttttcaatcaagtcctaggagggtgtcagtttcttgttgtacttaccaggatgtgataggatttcaaacaaggcccaaaagaatgtattttcaggagttgagatgtagccacactttctacatttacaatggcctgaaatgggttacagtttagaacaagctttcttctttatgatgcacaggatttctatgatgggtggctgttaggcaatgagtgtgatgggggagcattttcaatcttagctcaccttagcacaccttagcacaggactctagttacagggtcataattccccatgaggttagcccctgtagtatcagctactttgtatgtgatttaagccagtactgattattctcctgcttagggagaagcggtagaaggcccttggaactgtgagttttgcattccaacttgctaattcaacatagatcctaattccttaaatgcttgtaattagaaattctcgtgaactgtattggtttttgtcaagcaatctgtttggggaacttgaccaactggggcactgctggctagggtgaaatttatttaatttgtttttatgacattcttcatcttggaaatggggttttcaaatattgctttcccaggcatcattacttatttgctggtttttatttcaggattgggactagctcagggtgccagggaagcgttttgtggtgctctatattagagtcgtaatatccaagaaaattgtctgattgtatgtggtatcttggatgtggtaccttatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaatctctgttcactttagaattcacattgaacatgagctgatccaattgctacagccttggcagtgatagaggcaggagacagccaaatccctaggcagatagggaaaggtccccggagaatctccgacctgccccacaagtgttgacaccagatgttttgtgcagataagggaacctgcacagggggcttgcctgggcatgcccacagcatactggaggcccactgggggaatgggatggagccactaggagttcacaccttatgcaggggtggagcctggcctcatcagttc

SEQ ID NO: 50843 - DNA, 1032 bp, Homo sapiens
ttttgtctacatcattatcttccccttccctcccctcagtctctctctttgggctttcaacattttggccattatgttcctaggtgtagaatttttgtattaatcctacttgggattctttgatctttttggttgtaggctatttattttttaatcaaatttgggaaatttttagctattatttcttcaaattcttttactccctttttgtcttctctcctagaattttcattaatcacatgatacttgatgtttcacaggtctctgaggctgtttatttttattcagtcctttttcttttcttcttcaaataagataatttctatagatttatcttccagttcacaaattctttcttctgccatcttgaatctgctgatggggctctgtgggaaaattttaatttctctttctccaattttccagttcagaatttccatttagtcttttgtaaaataatttttctgtccttactgaggattttaaaaatttgttatttttgttgtcatacttcaactctttaaacgtgggttcctttagttctgtggtgaacatatttataagaggtcttttgaagttctcatccagcaagtccaatatatggggacatccagaaactttattgattgctttgtttttcctgagcacatctcacttttctgtttctctctaattttttgttcaaaactcacattttacataatatattgtagcaactatggattctggtgtttttcctctgatggttggtgttgttgctgtttttctttgtttgtttgtttgtttggtagtttctttgtttattaacttgcctgatctaaatatgtgaattatgtctcccacatcgtgtgtagcccccgatgtctgtgctcagtttttaaattcttgttttttatttttaagcatggctttctattggttcttttctctgtctgtgtagtttagtgtacagaggctgtgaccaaacatcttgtgccattaaggctactatcttctgttggtgggtctgtgtttggtagagttgctcattca

SEQ ID NO: 50844 - DNA, 1023 bp, Homo sapiens
cccagcataatctctctgctcttgaagtaccaagtgttggtggaaaaagttgcaaaatgatgctcattgggtacacagatcagtagtactttctgatcttagctgggccctccctactgcttgaatgctctcttggatgctcttgtattcctctcttgccatcttctcagagaggcaggatggcacagcagttaatagcccaagcacaggcaactgatgagacttagacgctgaaatcctgggtctgctacttgctgcctgtatgattgggaaaattgatctaatcttaggctttagttttcttcacctgtaaattgggattgctcctcaccttaggggattgcttgtgaataccaaatgagatcatatatggaaagcacttataacacagtgaatggcacacgaagtacaaacacacacacacacacatgcacacaagcacatacacatcagctctattgaggtatgaattatataccataaaatctaccaattgtggcaggacacgttggctcacacctgtaatcccagcgctttgggaggccaaggagggcagatcacttgagcccaagagttcacgaccagcccaagcaacatggtgaaaccctgtctctacaaaaaatagaaaaattagcaggacatggtggtgcgtgcctgtaatccagctactcgggaggctgaggcatgagaattgcttgagcccaggaggcggaggttgcagtgagctgtgatcatgctgttgcactccagcctgggcaactgtaatgaaactctgatatggtttggctgtgtccccacccaaatttcatcttgaattgtaactctcataattcccacgtgtcgtgggagggacctggtgggagataattgaatcatgggggcgggtatttcttgtgctgttcttgtgacagtgaataagtctcatgagatctgatggttttataaatgggagttcccctgcacaagctctttattgcctgccaccatgtaagatgtccctttgttcttcctttgtcttccacc

SEQ ID NO: 50845 - DNA, 1068 bp, Homo sapiens
gatttgttaatctgattcctttttttttgaaacagtgtcttcctttgtcacccaggctggaatgcagtggcatgatctcggctcactgtagcctcaacctcccagactcaagtgatcctcccacctgagcctcctgagtagctgggactgcaggcctacaccaccacacctggctaattaaaaacattttttcatagacacagtgtcccactatgttgcctaggctgttaagctgattcttaaacttgtgaggtaacggaaatagctaaattaagacaaaatattcttttaattttttttaatatagagatggggtctccctgtgttgcccaggctggtctcaaattccttggctcaagtgatcctcccacctcagctgacaaggtattcttaaacaacaaaatgggcatacttgcccctccaaatgtcaggctataataaataagactttgtgttagcgttgtagtagttgtccagaccagtggaacagaatttgagaaacagatccaggaatacatggaatttgacatttcttagaggagaaattgcagatcagtggtgaaagaattgacttttcaaagtgtggtagaacaatttgacagccatgtgtggaaaaatttttcccagattactaccttatcatatgcacaaaaaataaattccagatttatgaaaaatctaggtgtgaaaagtaaagctaaaatgctctttaaagatagataatataggagagtgtctccatgacctcaggatagaaaataacttcttcaacaagccattgaagcaataactgtaaaggaaaagttcatatattcagtttcattgaagtgaagtcattttgttcttcaaaagatgtcataaggatcataacaagaccaaccacaagttggaagaagatatttgcaaaagcattacaacagtgtttgttggttatctggaatacatagagaagaactatagctgggaaaaataaataaataaataaatatgggaaagaccattaagtactatacaaaaagagaagagtaaatgggcaataaacaaaaactgcatttggccttattagta

SEQ ID NO: 50846 - DNA, 1049 bp, Homo sapiens
aaaactgatacccagggaggataagcaattggctcaagatcatgcagacagttaacagaactgagaagaccatccgtgggtcctgatttactcattcaatgttgttacacattaaagcaaaacataaatctaaagatacgtcttgaggaaagagttattcactagaagcttgcaagaacatcattttattgctgaaagcagctcaccttcaccagggacgttgagtcattgatatcccagaaaccccgtgtcattgggtgatttcaactacaagttggtgccatagcctgagccctgagccctgagccctgaggatggccttatactgagcattgggtgttttatcataacagagacagttaaggtttaacaatgggctaatggccgatggcagtgcttcctgcactgctagtgagagtgccaaaccaaggaggagctgaggaacagtccagtggctaatgtggggattagctgctgctttgggtaatctgtgtccagttcaggctggttacaggagagcctcaaggactcatttcacttggctgcttcttgacctgcaattttgcatgctgcatgctgcaattttccctttgaaaatacatctttccttttaaaaatgtggtgacatgtgacttctctgaagtttaaatgtttgatcatttttaagctggcacaaaaatggttataaatcttaatacttaaaaatgtaaaaggaaagcataaaccctaccaacttgtttggtcccttttgtgtgtttgagagagcaagcccagctcagcaggccctttggatgtccgctgaggttcagaaagcaatgatctagtcgcatcaagatattgaatcttctgaattctggccttgtgccccccaggtcagggctgttgtgttggttagatggctgcccaaaaaatggtcctgccatgcccctgagtttccctcttgtgaatgaatagaaagtttccatctacagagttggcaagctctgtgctgttaatttcacttagttaaaaggaaaaaaataactaaacacacaattattagtaaacca

SEQ ID NO: 50847 - DNA, 1023 bp, Homo sapiens
tttatattgggtgggagcagaggcaggggcaaaacaatgtgaggactgaagagccaagagcttagagtactggtggaccagtagtagggaccaacccatgcagatggagctgcctacagttattgtctcctccatccatctagccagttgctggttagctagctgcgcaggcatccaacatgccaaaagtattggctcttggaccagacaagctttttcatgtcatttacgctaaaaccccaataacttgatgtctattctttcagagtctctggcagataagatgcctcactgttttttttcttttaaatcaaaatgttagctagtctgggtcccatcagtccaaaatcccttgctcatgttgcttttacgtttgaattactgagaattttagtgtacatcgatcaacaatttgttctatatcctgtacctaaaagatgttttgccatttcctttttcttccagatttttttttctgtgttttaagttggggtttggtagatggttactgtgtgcacattctcacggaggtgtaagcatcgatgatactgtacctgtcctgggaatgggatgcagtgccttgggtggtttcaggagattgacacacttccaggaccaggcattttcatttccaccttaaagaaggagcctgctgtgctttctgagacctactgtatctgggatggccagacttcaggagacaagaagaggaaggcatcctatccttttggtgggtggatggacgggccgaatctatctcagaaatttttaatttttacttccatgtcactttccagtcttcagccagccccccaccgtctacctcccactgctggagtgtggcttcattcaggggagaatgctgagctctgttgacatttggtagaatttgttttcttccctctttaatttagcaactaatcacgggggttgttctttgttcatctttccagggttttccgtacgctgactaatgcttacagctggctctctctggagagaagtgctgggaagatcaatcaa

SEQ ID NO: 50848 - DNA, 1069 bp, Homo sapiens
gagtgccctactgcaatcttggctcactgcaacctatgcctcccaggctcaagcgattctcatgtctcagcgtcccaactagctgggattaaaggtgtgtgctaccacgcccggctaatttttgtatttttagtagagacagggttttgccatgttgggtagactggtctcaaattcctggcctcaagtgatccacccgccaaggcctcccaaagtgttgggattacaggcgtgagccacagaaaaattttaaacctacctataaagccggaagctctccccttcaagttgttccgcctttctgaaccgaaccaatatatttcttaaatgtatttcattgaaatcccatgcctccctaaaatgtatacaaccaagctgcaccgcgaccaccttgggcacatggtctcaagacctcctgagggttgtgtcatgggccgtggtcactcctatttggctcaaaataaatcacttcaaatatcttacagagtttaactcttttcattgacactctgccaaaaggagccctgaaatgttggtcagatttggataaggaccatggccatgtggcttaaatggcatttgctcgcttgttggtaatgagttgcatttgaagaggtggaataaatggagacaaccggcatcattgggcacctgtggacaaagaaaagcctttttggttgagccaaggtgatactatccacatctgcctaggaagttgtttttttgtttggagtagctgggactacaggtgcccgccaccacacctggctaatttgtttggttttgtatttttagtagagacggggtttcaccatgttagccaggatggtctcgatctcctgacctcgtgatccgcctgcctcggcctcccaaaatgctgggattacaggcgtgagccaccatgcccggccctgcttaggaagttttttgaaagagtgtttatttgtgaaaatgaaggtgcttctttatgtctatagctttctggctttactcctttcagagatttgacttgtaaggcaatagatagaaatgatagctcatcagcatctaatgagccaaattacttact

SEQ ID NO: 50849 - DNA, 1033 bp, Homo sapiens
tttttaaaaattacattgttgaacaaaatggtctgaatatttctgcttttaggtaaggatctatgctttgcagctgcctccttcagtttgtttttatgacttaagcaaataaaaaaaaaagagatcattttagcattagtatagcattctacaatcttctggaagcttttatatttatcgccatatgggtgtacattaaatctgcatctccctctcgtttatatgtttatgaagttataaagatatacacatgcgcacacaaaataattaagcaagtgatgtgtgtttgacaacgattggtgacttaatgccaattagagggtgttaaaaaagaacacttgctttcttaatccaattgttcccatgctttttggtttatgcacttaaggagagaacccatttaaagtgccagaatttgcatacatgcagctttgactgagccttctatttaatccagtggtcttaaaaaattattagtgagggttttagagacctacatgtcatgagatccattaggacgagactgaaagtacactttttggctgcctcctttatgggaaggggtgtgcttttgatatggggagagctaaaggtatgtggatcagctggactgtttaatgcagccagattagctcagctcatctcagttagagcatcttgtgttgcagccaccttgcctaatgccattatgggaaagtggctcataattttccagagttcagctgaatgctaagtgaaaggctacatacagtgttcgtatgtatgaaagttagcagttgcattgacgaactcttctgttttaaaaattctggttggactggaatgggcaggattgtgatattcccctttcaatgtcatgtttgttttgctttaaatcatggtgatgtaaccattattcattgtaggaagattatggcttcagtgtccaaggactgggtgcggggtttcaggttgtgacctttggctgagaatgccttctctagagaatgtcacagaggtcagatttctatgctgactgcaaacaaacctgcga

SEQ ID NO: 50850 - DNA, 1239 bp, Homo sapiens
acagaaaacaaattatcaattacttaaaattatatgaagtgccatgggggaaaagtacaggatgctatgagaacacatactaggagactaactggagttatcataagtgcaacaaattggaaacaatctgaacatccacatggagaagaatggttcaagaaatctcagtacatccacttgaaagattattacaaaaccacttaaatgtcctttgatagagcatggaaaattgctagtgatttaatgctaagagaaaaagagatagaaaattatggacccagtacgactacaattatattaaagaaaaaaagatagcgagcgagcgagcgagagaaatcatctcctacccctcccaaatctaagcataaaagacagagactggaagaaaaaaataatagaatataaatagatctattagtgatttattttcttattctgcttttctgaaggttttgagttttctttgagtctacattacttatataataacaataagcattaacaatttttaaaataatgttttactaagctgtgattaattgcacacaggtctacttttttggttcctggctggttatttcattagcctcttgatatcctgggagcctttaatgaggagagtagcctcagccctaataaaccctcaccctgaaaggcagaggtgatgagtcagacattggctgctgattttcgataactgacttttatcatattcccacacaatgcatggaactctttttataccagtatggtatagagctacttgagtgaattgctattgtttctttctcatttataaattataaattttaatttataaattatatggaacaggaagttaatagtggtacacagttggaaatataaagcttattctgctcagccagagccatccgagatagtctggactttggatctccatgagcttctttcttagtgagttgacaccagggctgatggtctggctggaagagttaaaatcttggggttggtaaagggctatagttctaaacatccataactgggagcttagatcagttagtgtatgtgttgctctcgtccagcagaaaaggagagttcactttgctaagcagcgccccctagagaagtttcactgcataagagtattacccccagttaaccataaataaagttgattagaaatgtcattgtccaactattccaatatctgagggaccactctatgcacatatagtgaggtgcataatcttattgttg

SEQ ID NO: 50851 - DNA, 1043 bp, Homo sapiens
gagtgtgtgtatgtgactgttgtatgtgtctgtgcgaggcaaaaatttagaggtaaaggcagctgcaccgatggtgaaatgtgggggtgagaagctggtgtctggaaatgggagagtctgcttttgggagttcctgtgtcaaacagcctctccatgccagctggtggtctctgtgctcctctcaactgaggggaacaacagttccacctttctggcctgggagttcagacagctgggccttagttctaggccagccactaaccagccatgtgaccctcgaccagatcctgtgtagagagtgcactccagtttatgataagcgttcatatcccttatctctggtattcctctgtaaacctgcaccatcttcagcaagaggccagagtggacaaaaggatccccatttatcagatgagaatgaagcccaaaaaggctaaagggcttccccggggtcactgagtttttttagcggcacagcaggaatctgactgcacttctgtctgactccacaacccttgctctgttgactgcaccttgatgaacaagggttttttgcaaaaccacagtgaggtcttgagttagtcattcccacaaagtgaatgaacacaataaatgttggctgttgttgttatcacctacatcattatcatcgtcagtcattttacaacatgtgagtttggatgagtttttgggccaggattaccacacccattgggagaagaacggatttctacatccctaaggctttctattcactggggataggttttgtggctagattgcagaggggtctttcattgccatgttgggaatccctgcaaagctgagcaggatgggagcgggctgaggcctggttggatgagcttcagtaggagccttcagctgcgacaggaaccacctactgactcacagccattcatccacattagggaggtatcagaggctattgtggctgcaagccaagactctgaatcctgcttccagtgctacatttgggatgcttctctgcctccgcggatggttaagtgcttgggtgatatata

SEQ ID NO: 50852 - DNA, 1040 bp, Homo sapiens
ccctgtcacttaagggctgccttcctatggctgtcagaggggtgtgcttggggaatgtggactcattttaataatagcctaagggaaacataattaagaaggtaagtctcctgccaagaaaaagaaaatacacatatataaaatgcataccagagaccaaatagaatttcttagatttaccactgcctgtgtgtgcttttctgcatcaccacagataacctaaagctgactgtaacccgctgttcatggtgactcactgcacagagcattttggtgccaggtcagccaaaaagaaataatcacagccagtgggtggttttctgaacacacacattaggatctctctgtcctctttcagtgcatttgtctttaaaggtctttactgcccccaccctcacctttcttttaaaatgtgcataacaaatggtttttactctgctgtttcagttcggaacactttgcaacaggatctggcagcggtaatgaacatttagacattatttaaaaagaaactagttatttgctgtttatttacttataacttcctgactgagaagcgaggcaggggctgggcctggtggctgacacatgtgataccaacattttgggaggccgaggcaggcagatcacttgatgtcaggagttcaagaccagcctggccaacatggtgaaaccccgtctctaccaaaaatacaaaaattagccaggtgtggtggtgggcaactataatcccagctacttgggaggctgaggcaggagaatcacttgaacctgggagttggaggttgctgtgagctgagatcgcaccactgcactccaccctgggcaacagagcaagactccatcttaaaaaaaaaaaaaaaaaaaaaaaaggtgaggcaggaagaacctgtgtgcccggcactaaggctgggccacatcaattctgttacagaattctgcagagtagaagtcagtccatttcatagatgagtcaaaggatgcaaagaagtcgggtaacttggccaagggtgacacccacataagaaatgcaagaacca

SEQ ID NO: 50853 - DNA, 1059 bp, Homo sapiens
agcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagac

SEQ ID NO: 50854 - DNA, 1024 bp, Homo sapiens
gtcaatgtaatgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgtgtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgg

SEQ ID NO: 50855 - DNA, 1049 bp, Homo sapiens
aaagcaaaacaggaggagatagtgataaatcaaatttcaggttgtcagtaaaatgcttgatgcttttcctttttttccttacatttttatatgcttatgtttgctgttcttcattaattacttgatcttaggtgaaagagtcgatgggtgtaactctttaaattttcttagaagtttgaaaggtatgatttgtagcatttacaaggaggcttcttttttcagcacttctgttgatctagtaacttaatgtttgcatgccacaccaggggtatgaaatacagcatttatagtaagagaaaaatcaatccttatatgtaaaaggcagcttcctaataatgtaaataccaggtggtaatttatagcaccaaaaaaaatggatcaaatgaaaagggccccaatctcttaaggttatgggttaattctagaatgcattaatcaatagccagttgattgtttataaaggagtaactaatgtggcatttagtagcagaactggaggttctttggcctatttcaagaattttgaatgtttatttgatgcaagacaagtagctggggatagaagttccagaagtacatggtgttcttctcttttttaaaagacaggatatttacatagaaaacatttatatggaaaagttttgtcttttcactctagtttttcccatgttaaattagtactacttgcatttagaatgattagattttagaactggaaagtacttacacttccctagctcaatccttataccaagtggacttctggcaaagaaggtagtatgcaaatgaaatacatgggtggggggtgtcgacctgctgatttattcttattttttatatgtgtgtggtgtgtgtatggtattctcttgtttaatgtaatgtaagctctcttctcaagggtgaggtttccccattccctatttttcacccagcagtcactcccaccctcatagatgtctgggacgtttcacaacctttaaaggtagaaccattaagcatttcccttaggataaacagttcccaattttataaggccttgcgtcttctta

SEQ ID NO: 50856 - DNA, 1085 bp, Homo sapiens
aatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaacatctggtagggagtgcttttacttgcaatccagtacactcctattgtcagtccaaaaatatgtggaagtaaagagattccatctcagacccctccaattgccataacagtgggcctgatatagaagttgagaaggtgtcaataaagtgttaatggagatactcaaggaattcagagcatttcaaggcacagcatatgttcacatccctctggtatcagcaaaaactcaaaagtgaaacctgtagggtcatttggctttcatgctgtccaacaatagg

SEQ ID NO: 50857 - DNA, 1059 bp, Homo sapiens
accacctcttcccccacagtgcgcgcacacacacacacacacacacacacacacacacacacacaccacaacaatgtccattctgtggctcctcctaccatggaggctacttgctgcttctgaatatgcctcatagacattctctgagcttggtgattttggtcaggctgtaccctctgcctggaataaccattcattcagcccctgccataattctgtccatccttcatggtgtagattatgtcccaattattcttaattttattattttttatttttatttcaatagtttttgggtacagatgttatttagttacatggatgagttctttagtggtgaattttcagattttagtgcacctatcgtccaagcagtatacactgtacccaatatgtagtcttttatccctcacctcactcccactctgtcccctgagtccccagtgtctattatgtcattcttatgcctttgtgtcctcatagcttagttcccacttataagtgaaaacatacgatatttggttttccattcctgagttacttcccttagaataatggcctccggctccatccaagttgctgcaaaagacattatttcattcatttttatggctgagtagtgttacatggtgtatgtataccacattttctttatccacttgttggttgatgggcacttaggctggatccatatttttgcaattgcaaattgagctgctataaccatgcgtgttcatgtgtctttttcatagaatgacttcttttcctttgggtagatacccagtagtgggatatcccaattgttttaagaagtcttcccagatctttctatttggaatttttatctctttctcttctatccccgaggtgttttgcttgtgcctttaactgagccctttctactttctgccacgtagctagttgaattgtctcttgatcaatttcccttgccagtgagggggctcatgaaggcagacagtaagtctttctctaaccctcaactgtgatgcttgagacatcataggctagttttgtttgttgaattaaattggattacat

SEQ ID NO: 50858 - DNA, 1052 bp, Homo sapiens
tgctttcgtatggttactaattcactcttacttggcagaccaaagaatttaaatcatcccactattggcttactgccacttgaaatactacctgaaacttaggttaaaattgaatgtcagttttctgttgaacaactttagccatttcttggaatatgtttagagaatttttcatcattattactgtcctccaattataggtaaggtgtccacataaccacagacctgggtcacacccaatactgggaagccccagagcctatgcctgtgacagaactccatgacacgggaaaatcgaaaacaaaaacataggttttagaatcagacagaccagcattcaagcctcagctctaccatttactaacattgtgaccttgcttttaagttccccaacttttgtgagcttcagtttccttatatctaaaaatggggctaataatacccattctgtgtaatcccagtgctttgggagaccaaggtgggcagatcacttgagtccaggagttcaagaccagtctgggcaacatgctgagatcccgtgtctagctacattagctaggcatggtgttgtgtgcctgtagtcccagctgctcaggaggcttaagtgggaggattacctgagcctggggagatcaaggctgcattgagccgtgaccacaccatggcactccagcctgggcaacagagcaagaccctgtctcaataaataaataaataaataagtaatacctgctctgtatacctcagagggttgttggtaggactgagtgaagagaatggagaatggatgtagaagttatctgtgaagcactaggttggaatagggtattgtgtaagaaacgtgaagtgttggtattgttgagaagcttttgatacaggctctctttctctgttctggagtgaaagatcaaatctgaatttttttgtcacttgagagttcccagaaccaacagtgaataggggcctgagaatgacagttagattttaaccaatagagtagccgcatttcttgacatgttcattatagagtataggagtgaattgtatcagat

SEQ ID NO: 50859 - DNA, 1032 bp, Homo sapiens
aatctcctttggcaacaccctcacagacacacccaggaacaatactttgcacccttcaatctaatcaagttgacattcagtattaaccattacaaaccccattctgctccctccagtggctgccaggatgctagatttcaccatgaatgtgggctgttagttttcaaaagtacttcagaactggagaggaggaatgagaatagggaagttaaaatgccacaacgctcactgttcctactgacattcagccattttcttgaataaatgcttctcggattgctgcaaatacttttattaaattccagagctccaaagaagttggttctgaatgtttttgccaattttctcattgcttttatggaggagcacttaaaacactgtccagcacatagtaggtgatgaattaatatgttattcattaatgccattttatttatttataaataatttaatttataatgtacttataaattattattttcagattattttggatgttagtgtagagcagagattatggtatcaggaccctttacattcttaaaagctatacaggaccccaaagagatgtcgatggagttatatctattgttatttgctgtattagacattaaaactaggaatattaaaagtatttacttactaattcatttaaagttaataataaaggaatcagacactcatatgtgttttttcaagatatgctttccaaaataaaatactttagtggaaagaataccattgttttacatttttgcaaatctctttaattttttccttaatggtagacagctggattctcgtatcttcttctgcactcaatctggtttgactgaggaaaatttggtctcacaaatatatacagttggaagaagaactgtgtcctaatacccttttttgacaattagggatattttctctgatactgtacaagaagttggcaagtgatactttcttaaaggttagttacaatatggaagctgcaaacgtatcaattgacttttcattttctgttatgttaaaatctatctt

SEQ ID NO: 50860 - DNA, 1030 bp, Homo sapiens
tctcctgcctcggcctcccaagtagttgggattacaggcatctgccaccatgcctggctaatttttgtatttttgtagagacagagtttcaccacgttggccaggctggtcttgacctcctgacctcaggtaatccacccgcctcagcctcccaaagtgctgggattacaggcgtgagccaccgcgcccggcctcaaagatagtatgatcttaactcttgtaatattatctcagcgtttacaaatatacatttccaaatatctcatataattttcaaaatagagaaaaaaagtaagttaaaattctttttttctgattttaaattcaatatatgctttaaaagaaaatttgaaaatgcagaatattaaaaaaaaacataaaagtcactcataattctccccaaagataacagtggttcaatggttaatatgttggtgtatttctctccagtctttttttctgtgtgtgtttgtgtatgtattatagtctgcattatgtaatatgtactgctttgaaactcgcttttcccactatttactgtcaacactatttattgtgaacattctagttcagtaaattttttataaaacctatttttttatggctgtatagccttcgttacatgaatatagagtaatttgttttgagttaatcatcttagattgtttctgacttttgcaattagagctcatgctataattaacattctggtgcataaatatttgggtgcatttctgattcttttattagaataaattcttagaatttcagcactactaggccacagaaacatgtataaagttgtaaaaattctttgatgcatttccaaattgcactttgagaagtgtttctgtttagtcccaatagcagggtgtgagaagagaatggttggcattatccttgttttatagatgcaagggtttaggtgtagagagattcaagacttgtctaaggtcacatgatgatattacttatcctttggttttctgagccagttctatattctttccactttaccactgttgtagta

SEQ ID NO: 50861 - DNA, 1053 bp, Homo sapiens
ttttaggtcaggggtatgttaaggaatctcacgaataaaagactacaactttttttttttttttgagatggagtctcactctgtcgcccaggctggagtgcagtggtgcgatctcggctcactgcaagctccgcctcccgggttcaagcgattctccttcctcggcctcccgagtagctgggactacaggcgcccgccaccacgcccagctaatttttttgtatttttagtagagatggggtttcaccgtttgttagccaggatggtctcgtgttagccaggatggtctcgatctcctgacctggtgatctgcccgcctcggcctcccaaagtgctgggattacaggcgtgagccaccgtgcccggccaacttttaaaaataaaaaagtaatcataccagattctagagagccaggcaccttttgcagacggaaatgaaaacgtgccttgcaggtagcaggcacttaatacagttttgaatggctagctcctagaggtgagtagggaagaatgagagcttgactgtaaatggatacaactgagtggctgtatgtatactggaagaatctggaaatcaggtgttaccttattacatcaaatctgttttaatggatatttatatattgctcagatatatcaaagttctagctgtcagacctctgttgactgtgaaaatgcatctattacaagtaatttgcactaacctgtgactctggacatttaatcgagttcaatttacctcttttatcaaaattacaagttgcctttttaatatctatattttaatttaatacacagtttacctcctacatgtagaaggcatgttcacaggcacatttgatgcaaacttaatttcttatgttttgaagtcaattttgggctgcatattaatgcagcctatcctcccttctttccctaataatggcagagatatcttgattcttgtcacttgcattttttttcttctttaccacttagaaaaagaacactgcagactttaggaaatagaatggttttgagttttgtccgtgatgttgtgggtatcagcattct

SEQ ID NO: 50862 - DNA, 1034 bp, Homo sapiens
agtgccaaagggaatattttaattcctgtgtttcatgtactggagcggaaccccttagggtttccagggacaacaggccagaattgcactctctgctgcctcccaatgtgcagaaagagccagtcctttccgtagttcactagggaagtgagtgtaattggtggttccagaggagtgaccctgagcagtctgcctaggaaattgtgttctccctttcagcgttccagaggtcaaggaacaccaagctccaggcccagtctggttaagctacctcaaacaaaagacctgaatcctgctgtcatattgcaggcttgaatttgccgatttgccggggcggtggcaggggggcggaggggggacggtatttttggttagatgcctcaaacactttaatttttctgttactgtcagccagctatttagtgagcacttactgtgtgtcaggcactgctgggtagtttcagacatgcacatggtagtctattcagctaaattcctcaaacattgacgtcagtctgtctatggacatgatctccgtgttatttttatttctcaattaagggctcatggaagaaatgctttgctttagattgtgtttcaattatatttcacaaataatccacatttggagtgtggtttagttcattgttttgtttttgtccctatccatataaatcactctatagaaaaacatcagattctgttttcacagaagtcagggaaataagttgtttacacatcaccatttgactcccttcacccctgtcctcattacaaacatctcagccacccaatgaagtttatttaaactcccaagccatccatgcaaataagacccctacagctacggagtttggaggaagaaaggactaggattgtctgccacttccttattctctctactgggttcagaacatttcttttcatgagttaatttactacccagaggcttggctttagttgtgtgtcctttttcagttttgtaaattagggaggtggttccatagaatcacagcatatcagagttgtcaggg

SEQ ID NO: 50863 - DNA, 1094 bp, Homo sapiens
aacaaaaagaaagaaacaatacagaactatatggaaaaccagtggaacagaatcaagaacccaaaaatgaacccaaacatatgtggtcaactaattttccacaagggcaccaaaaaggacacaatggagaaagaatagtcttttcaataaatggtgctgagagaacaggatttccacatgcaaaagaattaaattggacccttatcttatactgtacataaaaatcaacttaaaatggatgaagacctaaaagtaagacctgaaaccataaaccttttagaagaaaacataggggaaaagctccttggcattgaccttggcaatgattttatggatatcacaccaaaagctcaggctacaaaagcaaaaataagtaaatgggactacatcaaactaaaaagcttctgcacagcaaaggaaacaatcagcaaaatgaaaaggcaacctacagattgggaaaatggttgcaaatatttacaaaccttatatctgataaggggttaatatccaagatttataaagaactcatacaactcaataggaagaaaacatataacttgatttaaaaatgggcaaaggacttgaatagatatttctccaaagatgacataaaaatagccaacaggtacctgaaaaaatgctaaacatcactaatcatcaggaattgcaaatgaaagccaccatgaggtaccacctcacacctgttaagatagctgttatcaaaaagacaagagataacaagtgttgacaagggtgtagggaaaagggaacccttgcacactgctgatggaaatgtagattggtgcaaccattatggaaaacagtatggaggttcctaaggaaattaaaattaggactaccatgtgacccatatgacccagcaatcccagcaatttttagcacgtatatacccctcaaaatgaaatcagtctgtctaagagatatctgcactcccaatgttcattgctgcattattcacaatagccaagatatggaaacaacctggttgtccaaatggatgaattgataaagaaactgtttcatgaatagaaacatgaatagaaaatgtttcatgcaacattattcagccttta

SEQ ID NO: 50864 - DNA, 1091 bp, Homo sapiens
agcagtgagttaggacatctaatgcttttaaagatagatgtatatgtcgcaacgatagtgtaagaatcagctgaagctaccggtgaggttttggttattttctttcagtcatctgagtccatttccaataaaggttgtttttttgtttcgttttttgtttttttttaatggggacaatgaatgagacttgtaatatgcagcaggaagaagtttcaccaagactttgaaactggcaagaatgatccagatgtccaattgcctctacttaaccttattcgtctaccttcagaagtaattagattctcttccacactaattcgtatcccccatcgctctgcttttcacccactacgttgttccaagattcatcctcaggggaaaaaattgagagccacactttcggctccacctgcagctcctggaaatcaaatggtgaagttataagaagtaccttaacttggagtgaagtggcctagtcataagttttgccctattccttgccagggggtggggcggggcttccttcagtcatccagtctttattcacccgcaggtacccccagatcgatcccccttcattgactccgaggggatacagcagcaattcatgttttgaagtgttctaaatggttcaaaacgtgaggcgctgctataccccctcgtggggaaggtagaaggtggggtctgccggacgcgtgttcctgccaccaggtgcccgctccccgcgaggccggctcaggagcaggtaggtgggcgggggctcgcgtctctgtttccggcgggtcctcgcccttgtccacgcagcagggctgtagtccggggagggcagtattcctggctaggctggggcgcataggcggtgcgagtcgaggagagacgcggtgcccgcgctcagccgtgccctagcagcgggaacagttctgcagtgagcgatcggtgctctggggtattgtttccgctgccagggtaagtctgggactgccgttcgggcctacccagcaggtaagtcttaggccatcgcctgcggtgtcggccccgggagcagcgagacccaagattgcatcaaacgtttgccccgtctctgcatatgt

SEQ ID NO: 50865 - DNA, 1027 bp, Homo sapiens
ttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaatatgttgggcatttttatttaatagacacatacctcatttttagtatgggccagacattgttctaagtggtttgcaaacattggtgcctggtcccttctctctaggatgacttccctctctgtcaagttcctctaagaaagccttctgcaattgaccctctgtctatatccccatttcccttacactctgcaccactaacttagtactcagccacatcgtttcttagttcaatctacaactgtgtcactttttatccacaaaaagcataggttgcactggtgatttataaaccatcaatggttctaagaagcactcacgtcactacccaccagctagacagcaaattcctgatgccgagagccagagcttatgcttta

SEQ ID NO: 50866 - DNA, 1032 bp, Homo sapiens
aatgcttagaaagtaattcccaaagttagttagcgccgtcttattccaagtctctcttggtacatcaaagccactcaactactagactatcctgcctcaaaccctccaggacctcattgcttccaaacttctttccctagactttcttctcacctttttttctgtccttataagtctgtccaaatacattgcactcatttctgtcctatgagtgagctaagtcattgtcttctccataaccttgccttttctcctcacccaaatcacttcttatctccaatatccaattagacagatctggaagttccaaggatgtgtccatatagggaaatcagaacaagaatactactaacaccaagttttcagtcacccttctaggttcacagaatcttaagaagtcagcaaaaccataagcccttgtacttaaaaataatcaatactacttaaaacttggtatttattttattttatcttattttatttacaaacactatggtgactttaaaacttagtttaaaaaaatactccccgaggtctgtaatctcccacatacaaaatctctaaaggagaggcttaaaagagaagtactcctccctgaaaatcagactattttataaataatgataaggtggcccttttgaaagtattgcttatttagaggctggggatttaaacttagatcactagtgagggtgtgttccaattaccatatccctagataaacatgaccttctttaatcagctctttgctccctagtttcttagcagaactgccaatgagccagggcagctgccattttgtgccagagtttctttttccattttccaaggaagcaaagaataaggaatgcctcacttccctccccattccctgtttggagtcatgccctctgagaacttattctatttcagcttctacctctatgcagtcagaaaaatgattccgaacaacccatagaatgagcacctgcttcagttattgtcccaatgtgaaaatgctaatccctgggtttaggcgaggtttgctttcca

SEQ ID NO: 50867 - DNA, 1916 bp, Homo sapiens
cacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttggaataataggaagttttgtgaaatgctggccttgtgtatatcttagaatgcaaatttaataaagtgtgtatacatgcataaaatttactagtgttttaaaagtctgtcctttgttcttaataataattattttctgcccctatatcccagtagtttattctctgtgtctaattgcaggtcaagtttgaataaaaggatatcagaaacacaaaagaacgaatagctatgttgaagttggggctgtttgccaaaacgaagtgaaacctctccacataatcaaattttcaagag

SEQ ID NO: 50868 - DNA, 1025 bp, Homo sapiens
gacaacgggtattgagaccacaagtgtagattattcattgtagaagcttaactggagaataactgaagggatcaaagaaagggactcttctagaaatagacctttgggttttgaaagcaagaagaaaggaaatagtgtaaggaattataaatggcatagaattggagggggaaatcatttaaaaaatgtgtttgaattgaaggccctttgggaatggggaagtgataactctaggggagttgaaagactttgttttagagtagaggaactatgaggcagtgtacttgatcgaacacctctgatagtccgagtatggttacctcaataagtaaccattcctcttgctccaagcctgatgggaaggtaaacataagaatagaaatttcttgagctgaagtgaagtgaaggaactccctcccgaaaaccatggcatgtcacgaggaacgtttattgtaggttaggcggtctggtgcctctaggggggacaatcaaatgatacaggacctcgaagagtcttactttggatttctgtggctttataatgtagtatattatgtagttcattgctgtggctttatgcttttttattatttacaagtgatttactgatttgtgagctcttgaaactgtgtcattgcatgttatgtttaccctgatagttgcatttgcttataattctttttgctttgtcttcagttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgacctta

SEQ ID NO: 50869 - DNA, 1033 bp, Homo sapiens
cgaaaattcccaagtctttgccaaccaaatctggaggacattatcaaccacaaggcaggaattatgtcattctgtatttagtccttatggacatcaaaatttgagcataactcagaagtctacctttgattctttctgcacactgggagctcttaatctgctcttcattcttttgggggtgagactgtgtgtgtctgcagcatactatataaaataaaggagttttcagggctgctggccatacggtgatgattaaatgatagtctttcttttttatgaacggaaaacttacaaatttccttaccccgtgcttcagtgttaatgtgatagttttaacacattttttgttaaatttgtcttagtggttctaacactatttttaatgttatatgtgtcatgtcaaaatttcatcatgaatatgtgacaagtacaaaacataagttttaatcattaattaacaggaatgtgtatgtctgtacacatctctaaagtacatgtgtatacacacacacacacacacacactttagagatgtttatgtgagcaacttagacatctgtgctgatagtttaaaactcctgtctaccttcaccataaaaatgagcaagttaaaacagaaaaaacaacaaaaacactcctgtcctcagcatgactgcagactgatatttaaatatgtgatcttaaaaacttagaggttattcagaaggataatactgggacccttaagataagatagtagagaccagagaacatgccatatatatcagtttaacccagagcaaggggtgtggggatgccctatagtcataccttataccaaaatttgtgctaggcttgatagggctgtgactaatttctagtgcatttacctgcccgtcattaatctgataggacccggcttattgactagacaaggcacaaagtggctcagccagatggggtgatagcatgaatcacactggacatcctacctttgttattactttatcattggactgttttaatgagttgctcatacttcatccttagtttt

SEQ ID NO: 50870 - DNA, 1017 bp, Homo sapiens
atgtggaagcatatttcttccatgttaaagcacatgggaaaatagttttaagaagtggtttgaagaagtattctgagctttggttaaacaaaggtcatcatatgttagcaccacgcctgtatttgtaaaattgttttatagtagcatcatctctttctgttttaggtgaaatggagacagaaagtcagcccaagagactcttccaaggcactaccaatatgttatctccagatgccgcgcaactgtctgatctcagttcatggtaaaaaaatgaaataaaatgaaaagtatattagagtataatccattttaaaagagccacattgaaagtatattgggataatttaaaatatttttttttgaattttgttaatatttattttttatatcattattttggggatgtgacaatattataaaacagatacctgacaaaactcaaaacaccattgcaaagagattagaaagagttgatacaggtgcttcgttaatagcaaatgaatctgaatagcagttgacttagatttttatcaagtcatagtaaatggcattctctaggaatccagaaatgtggtcctaaaacatggtgacttggtaactaacagatttttaaaaattattacagtgaatgaagaagcttctcttcttttaagttttaaaattttttcatcacctcaagtctgaagaagcttcacttgaggtgtttagctcaataaaattatgctttctgccccccagctccttaccatcaaaattgtccaaagattctaatttaaaatattttcaacttcttatccatgcccccatgaaggggaaatctctatggaggataatgtgaaaaaacagattatttcaaagtcaacagtatttcatttggaaatatatatgtctttctgacaccttcgctttcgttcccagctcctgttaggtcagcctgtcattagttgccaatggtgtggcagtgccaactgctggctggtgtgagaaagagtctctgggtggctgtgggtaatgtgt

SEQ ID NO: 50871 - DNA, 1086 bp, Homo sapiens
ggtgaaagaagatagatccctaaatggcagaactagatttccatagtctgtgcacagaggttcatcggtttatttataggagagcctctgacctctgaatcatctaaaatgtatgcacaattataataagcttccaatccaatagtgtgtgagaagcagcaaattagaagagatgcattttggttaaaagtatactaatagctgctagcaagggaggagagggaaaaactgaaaaacagatgtttttaaaaaattagtttgtggctaattagtataagggctaagagcctgttagtacaccccaagcgtgtcactggtgtagaatcatataataatttacgttcttaaggatacctgggtcattaacttattcataaattctagtaatacctacacttgcatagtattttacgtattacaaagtactttcacacatttaattgtcataacagcccctatgaaatagggagggcaaagatatttttcccaattaaaagaagcagcagctaaaactcaagacgttagaagtcacttgctcagaatcgcacaattagtaagtggtagaactgggattagaatagagatctcccagtgcaattctgtttggtataatttgtttaagaaagggaaaaatagaacacattgtagaaagatttccaactgaaatggctgaaaatacttacagggggaaatgttagctatctggaggtttcattcatttcacctccttctctgaggacactggaaaatattacttatttttgctggatatatgaaaaaatgtttatacatgttatacagccatgctcctgataacagtagcatagcaaagaagggaaagtgaatttgcctctctacacttcacttacctcttttgtaagatgagaagattcttatcaaccatggtctaggttcatctctcactgaaatacctagttttctgaaagggccatggtgactcactgctctttgttgatccttatcatcttttcattcctacccctctcctttctagctttttggtcttccaaaactcagtttaatccttatatctcctttgggcaggcttccacaactatcataata

SEQ ID NO: 50872 - DNA, 1045 bp, Homo sapiens
tctatctgtaaaaaaaggggaaagataggactcgtggaccaagtgggtggtggagaatggtactctgccagtctacctgcaccatgaaggggaggacatttacttgtcaggagtccaggaaggcataggctaacaatgaaagtaatacatacattgatgcaccttcaaatcttcacccagtcaggcactgttggccagttctttgctttgcggacattgctgggaccacatatcatgtctcattcccagtttccagtatctgagtctgaaagtcccatggccctttctcactatcatctttgagcctcagtttcctcatatgcacaatgggattcataccatggtttcagggatattgtagaatcaagtgtgatcatccttgataagggcctagcacacaagagatggttaaggaattagtatcttacttcctaaatccatatattggagaacatgagggtgcttggtttcactcccttcctatcactgcttccccactcctgtccaatctgtttgactttgccataatgtcatttaaatgtttgtttgccttcccagggccagcaagcttcctcagggattactgaggcatctccttggaaaccatacctcattaatcctgctgtgaagtaagaggcagccaggaccccaagcttttcctttttctgagccacattctgttctggccagctcggacaccttacatggaggctgacagggctcaacacccagcacccatcaggactcactaccgtctgtaaactgagcagcctggagggagcctgttgactagcagtgccagagaggtctcttctctttctttgcctatgtaaagtaatttcttttaggtgtggtgattaatttattgaaattcaggtgaagacatttgacaatttgacagagagaagaaaagtgctagatggaaatatgcactcttctcaaatgttctcaaagagacttttaacctttagtcccagtagatacttctcgtttggtttctctacctttctcttgacacaattttcattcagaaggtggcatcaca

SEQ ID NO: 50873 - DNA, 1064 bp, Homo sapiens
ttatggaatgaagaacttgtattacatacccgttgcccatagtatcctaaaggtatacttgccaattaagagcaaatctcccagatttacattgtattaccaactgtccgatttttgccattgttttctccaaaaaaaaaaaaaaaaaaaaactatgttcaatgtcagatgataataacgttacttagcataaggaattctttatgaaactgttctaaatgatgttaacttcattttaatttaagaaattttctaagttatgttactgattactgacagtaacacaccaaaagtacagttctattatgtgcatttcatggtcttcagtgccagtattcagtaacatactgaatactcagctgaaatccatttggaaatttattatgcataatattgcacggtatgagtgtcactaatcagtaacaaagtgaggaaaaccaaagatttgttacccatagttttgcataaatcaattgccttgtcactgaagaataacaacataaaaggactcctctgaaactccccttctagcaaaaaaaaaaggggggtattgtgtcttggcataatattttataatttccctgtgatgtttacttaaagcaagaagacctatggtatcctttggcaggggcaatcaggcctctgaaaagcagtgttaattgtccttatgcagtctcagtcttacaccgaggctcagtgtaagttacctttcactctttcagcctacctggcacaggatacatgattgagtactcagtccccatcaggtattttcagaaggacttctacataagggaatgaggatgagtagcccagccacctatcgtatgaatttccaagtacatacttacagtggtgctgggttgtccacccataggcaagtctccttgtagatttatacagccactatctccttcaggacctgtggtgggaatgtccaggactggtcagcctgtgagcctgtaacatggatacagtggagccagaacaaactgtccagaacagccagacaagtaagagcaaccttatcttgtatgaagtgataggtattgggtggagggcac

SEQ ID NO: 50874 - DNA, 1098 bp, Homo sapiens
agtggatggaaattaaacaacatgctcttaaataactaatgggtcaatgaggaaattaaaagcgaagtgttaacatttcttgagatgaaggaaactgaaggcacaacatacaaaaacccatgaaatacagcaaaagcaattctaaaagtgaagtttacatcaataaagcctacctcaaaagaaaagatacatcttaaataaacaacctcacactccaccttgaataactagaaaaaaaaagaaaaaaatgcaatccaaagtaggaggacagaaatcataaacgtaagagcagaaatcaatcaaatagacatgagaagaacaatacaaatatcaatgaaacaatcagttgttttcttgaagaggtaaaccaaatcaacaaaattttagctagactaaaagaaaaaagggagaatattcaagtaaataaaatcaaagatgaaaaaggagatagtacaactgacatcaccaaaataaaacggatcataaggactattgtaacaatcatctgcctacaaataggacaagctagaagaaatggatacattcctggacacatacagcctaccgagatgtaatagtgaagaaatggaaaatctgttcagacaattaacaagtaaggaaggtgattcagtaataaaaaaaaatcccccatcaatgaaaagtctaagagagaatggcttcccttcctaatactaccaaaatttctatataaagaagaagaattaatagctatacttttaaaactctttcaaaaaaacagacaagaaaggaacacatccaaatgcattctatcacatcatattaccctgctagaaaacccagacaaagaaacacaaagaagagaaaactgaaaaaaaagaagtgccaaaattcctgatgaacatagttgcgaaaatctttaagaaagtattagtaaaccaaattcaacagcacattaaaaacatcattcaccgtgatctagagggattcatccctgggatgtaaggaagtttcaacatacacaaatcaataaatgtgacatatcgcatgaacagaatgaagcacaaaagccataggatcattccaatttaagcagtaaaagcatttaaccaaattcca

SEQ ID NO: 50875 - DNA, 1050 bp, Homo sapiens
ttcattcagctactctatgtcttttgattgaagagtttagccaatttacattcattgttattattgataaataggaacttacttctgcaattttgttatttgttttctggttgttttgtggtcttctcttccttctttctttccttcctgtcttcctcttagtgaaggtgattttctctggtgtatgttttaatttcttgcattttatttttgtgtatgtgttatatgttttttgatttgaggttaccatgaggctcaaaaatactatcttataacccattattttgaactgatgagaacttaatactgattgcataaacaagcaagcatgcaaaaagaaaactaataataattcaacactttaacttcatccctctgctttttaagtttttattgtttcttgttatgtcttattctactgtccctgtcttgaaaagttgttgcagttattattttctttcattcatcatttagtctttctacttatgtcaactgtagtttacataacacaattacggtgctatagtagtctatgtttttctgtgagcttactaataccagtgagttttgtacctgctgatgttttcttcttgctcattaccatcattttctttcagattgaagaactctgtttagtatttcctgtagtagaggcctggtgtttatgaagtctctcagcttttgtttgtctgggaaggtctttatttcttcttcatgcttaaaggacagttttgcctatgtgcttttattctagggtaaaactttatttcctttaccactttaaatatgtcatgccactgtctcctggcctataaggtttccatcgaaaagtctgcttccagatgtattggcactccattgtacgttatttgtttcttttctcttgctgtgtataggatcccttctttatatttgacctctgagagcttgattattaaatgctttgaggtagtcttctttaggttaaacctgcttggtgttctatagccttcttgtacttggatgttgacattcttctctacctttgagaaattctctgatattacccct

SEQ ID NO: 50876 - DNA, 1029 bp, Homo sapiens
attctgcccaaggagacccagaactgggtgcagaagcatcatccacagaatgtcaaacaggctctggtcctggtggaattcttgcagagggagcctgatggaacaaagaatgaggtaagaagaaagattgcctacatgtacaatgaagtaggataaaagtggatatatcagaatggaggagttatcagagaattagacagattaagtcgctcttctgttgctcctttaggacagctagcaaggatctgaaatgacatacatgcatcaatagtccacaggtttcaagatttctggcagagcctttccttgtcttagagaaaataaatgcattttgtcttctctagggccagggtgaattgatggtggtgggcctagtctggcatgggcaaggacaagagttgagttcttagaaaaagagaaataaagggcaagaaagagttgggaaaggggagaagatccacaagatgggcagcacttacagagaccaaaggagagagaggttagcaaacagaagtatgaatcaagcggctctggggagactgcaaagaaagagaacaaaatggaaagaaaaaaaggaaacaaggatatggaaagacgacaattgccaacagagaagtggagggaatcaggatgctaaggggtagtatcttctatagcagaaacacacatctctgggctgggaggaaagagcctccattgccctcacttagtggcttgtcattggcccttctggtgagtgggaaaccaaggtttgtccttggaagatggcagcacactttcttttttcaggagcctaccttgaaaaatccagggcaggccatatttttggtgtcttattactaccaaatcatgtgaagagagattagagcccaactcttctccccatttattcttccatccatctccattccctgtgaaattctttcctggaggattggaaactggctaacaggaaagtttatttcactcaattccttttcttttacagaaaaccaaaagataaaaattcactaaaacaaggatccaagt

SEQ ID NO: 50877 - DNA, 1034 bp, Homo sapiens
ctataagttgtagtgaatcagggatggggatttggggcagtaatgtctaccaccacactcagcgaaacttcctgatttttgatggcttatgaacataacaccaaagaaagggtcatttcaacattaaagacaatggcttctgctgacaaaaaaatgtaagaagtgttcctgtacctcctgagcctgaatggtcagcaaggagccaaccatttttttgaatacctgtggcatccttgaaagaattttgttactgtttctgctggatcacctcagggaaaatcagttttgaggacatgttaagtcaggagaaaggttaccattactaagacccttcccatctataaagaaccttaatcatcaccatctctctttcttttttgtttttaaccacctgacatttgtatatatgtaaaggaagaccatctgtaaatttttccagttaaagtaaacaaaaaatttaatacgcaagtacaaacctgtgcagtgccctttataagtctttcgaagaagtactacaccctgccacatcaaatgttgatgatctgcttgcttagcgggagggcatttgcttactttttctctaattactttacttctactctgatcttgctgtctcagttctcctaccagcattgatacagtataaaagggaatattaagagttccatttagtaaaaggcttcaatctaaatgagatgaagggatatagaaactgtttttcctctgactaaagaaaaatgattgggatgatctgttaaagtttcgagaaactcaaataggccctatttgccaatataggacaggaaacccacagattaagtattggataatctcaaagctccttttggccaattggtgccagttttctcacccaccaatctttcctcaactgttaaaaaaaaaaacaggaaatacattgattgacatttgtcttctcttagctgtgctttgtttcaaagttgaaaaacaaagaaaaggagagaaacttacctcctgagtaatctaatcatgaatgttctaattcttggcagttg

SEQ ID NO: 50878 - DNA, 1069 bp, Homo sapiens
ccaagggtaggatgaaaagtcttgagggtatttagccaccaaataaccaaccatacttcttaaaggacttcccccaggggtgatataaatctctgtcacctccagttggccttgggtcaagtccagcatgctctaagggtgagacaaaaggcctccaaggcagagagtcatggcaattgccataagcaaccttgtagatgcaaaggtgagacatagctccgcagggccagagtctaaatatgtaagtcagtgtcagaatctttttggcactgtctattccttaaataagtcaatactcaccatttgtgaaaatcttcattgaactggagctacatttcctctctataggtagcatgttttaaatgttttatcaattatcaattttaattggaaactggttgtaggaactctgtcccagagagttgtgagatgcatggttagccgtcgaaggaacatttgcattgtagacatcaaaatcttccccctggggaaaagaaagcaggatttttgtagtgtgtcctgcttgcagatgtgccatgctgggtgttgggcacaggtctctccctgggatttcatggagatctttggctgcatttgtcagaaactctattcttaccattcaggctacaggggcccaagttgcagtgtctcacctcttgttgagaggttcctcagcacgtggaatacaaacctcctcctctccaggtctcccatagcagctggaactttattcatgttcctatcattatattctctatggaataggatgagttgctggttagcttgcttccacccacctatgcccatccaggcccacgctcagcacactgtccccatagtgggtgcccctatccccagggattcttggaaatgctgttctgggtggtgactccatttcagcactgacatagtcactggcagccagagatggccttctcaagcttatgttgggagtctagtaatgaatcctttttgttacagttcagatgggacttgcaatgcccagctccactggtgttgctgtttgtttttcttctatctccagtcttacaaatcagtgattattgat

SEQ ID NO: 50879 - DNA, 1029 bp, Homo sapiens
agcctcacagggcatcaaaggcctagccacgattttccctgctctcatcagatatgctccctaccaagtgggaaaagctcacccagctacatcccctatcagccagatcagctgcatatcccctggtattcaaccaaaaagactgattctctaccagctggtacagccactgtttgatcctgaactgcagcaaaatagtaaccaacagaggagtatccaggcagctttcccaccaagagtgcacccaagaggcccctctacctggatgtcctctaaaccctccccttccaacctacagtcagttgcatcctctgaggagaggcttgtggttctattttggcaatgctgaatcagagcagggaaagcaaagttgacagggacagggaggagagttaaatggacatagaggagttaaattttctatctaatacagatccagaagagacctggctaagggtagagagaataacagccccttagatgtaggtgggggaggggacacaggaaggggacttgggaaatgctggacaggttgtgagagcacagggaattgggaaggagaggtggaggggacagaaggactgcttgcaggcttattttgcagcttacgttaaaggacaagagaaatgcttggaatttgttatggttttaatggttccttttatgttaatttcatcttattcctaacttaagcttgcccatatccaccatggctctgacctctttgctctccctgtcccctcttcagctttagctctcacttctcagtcaccaattgtgcacatagttcccatttcaggtttcttggagtatctgacttgctcaggatatttcttagggacagaggtttttcaatgggaaccatctcatatgtcttgttggactattgggtggcttcacttcaggaaaattaattatctttgattggctgtggcctgaaggtttgtttgacatgacacaaaaaagccatcagggcattccactttcctggggacactgaatagagcagttgcccctggaaggctctgt

SEQ ID NO: 50880 - DNA, 1370 bp, Homo sapiens
cttagcccactgctgccaccagtggggtccaaagactggcatacttggtgtaccagtcccccgcaaaactgtttcacagcctccaccaataacttcaccataagccagcaaggaaaccttagataccactgacactgtttatagccaaagaaatcatacagagactacactacttcatgcacccagaataacagccaaagtgccctactcaaccaatactatagatagatcttcaggaaaaagccctcctctaacaaagcaaattcaaaaaattgaaagaagtgactgatacaccagataggcaagtatcaatgtaaggacgcaggaaacacgaaaaagcaaggaaacatgacacctccaaaaggaacaaaataattatccaaaaccagatttcaatcaaaaagaaattcattaaatcctggaaaaataattcaaattatcaattctaaagaagttcagtgagatagaagaaaattctaaaaaatgataaaaagaaatcaggaaaacaatttaggacatgaatgagaaagaaatatctatcattaaaaaaaattctggaactgaagactacattgaactgcaaaatgcacttgaaaaactccaacaatagactagatcaagcagaagaaagaatctaagatcttgaagaaaggtttttagaaataacctggacaaaaataaaaaagaatgaacaaagcctttgtgatatatgggacaccataaagtaaccaaatatacaaattattggtgtcccaaaaggcaaagagagaacaaaagattttgaaaacctatttaatgaaataatagatgaaaaatttccaggtctaccaagaggtttggacattcacatacaggaagcccagggatcctcaaacatacaatgcaaaaagatcttccccatggtacattatatttacaatgtctaaagtcaatgacaaataattctaaaaaagcatctagttacctataaaggaacccttatgagactaacagcagatttccccacagatatattataggccagagagaatgaaatcatatattcaacgtgctaaaaggaaaaaaaatctgctagccaaggataccatttttggcaaaattatatttcataaatggaggagaaataaagtctttcccagatgagcaaaagctgggggaattcatcatcactagactgcccctacaagaaatgctcaagggagtcataaacctagaagcaaaaggacaacatttaccaccatgaaaacaaaatgttaagtattaagctgaatggtaatgcaaacatacagatgagaaagaaaaagtgctcaactgataccactacaggtaatttccaaaccacagtgacaaacgataagggaaaaaaagga

SEQ ID NO: 50881 - DNA, 1065 bp, Homo sapiens
tctcctgcctcagcttttcaagtagctgggattacaggtgcatgccaccatgcccagctaatttttgtacttttagtagagacagggtttcaccatgttagccaggctggtctcaaactcctgacctcgtggcctgcctgccttggcctcccaaagtgctgggattacaggcatgagccacctcacccagccaagatcctcttttaaggttctgaaattatatcatttttgttatatatgtcaaaaatctgacaaatgtctgtttggaaattgcaaagataatttttaaaactaagaaacagtaggtagaatattaaaatatttagagaatgccaaaaagattctcacactggcttatctattttgactctcatccttcaaaactaaacactatggtataatgaaaaacaccactgactaagagacaaaagttctacttcaggtttgaccaagaattaactgtgtgcccattacttccatttcaggtcctcatgacttctgaactgatcttttgcagaaccatattggccccccaactttgccttatccttagacatttcagtaaatttccctaatcacctccacaatcattcaaaatgtatttgtggcctcatgtaatggccaaaaaagaccactcctcataggaagatgttagattacccactacatttcttacctttattacaaaggagagagtttctaccctggcctggaagcctctatgcccctgctgccaatattttgtcctcaatgcaccagatgacatacttcagagctctgctgtggtacacttgataaagcacattgcagaaccacacacttctttgataatgcttatatttgttgcatgtaatacaaagtgggaacttctacaacaaaataattaattagaagaacataagtactttacagaatccaagaaaccaaagcagcaagcatgcttcgcaaggacagaaacaagggtagctcaagagaactcaatagtaggtattctaaataatgttctctatacagaaatggcagtaatgaaacttagaggaaaaacactgagttttggggtctagt

SEQ ID NO: 50882 - DNA, 1045 bp, Homo sapiens
ttctgtgtaggcatgtgcttgtaagtcacgtgattttttttggcaaaggccagctccaccctggcattgctcgtgtcagcatccacaaccactttgtcagatccacatcatttctgtgcctccccagttgtctaccgagtaaaaaactcagcacattgttgggggacatgttggactttaagtattcatctgccttcctcctgatatttggtgcaggtgtgctgggactgacttcagagagtcctttgtccgtgactggtagactccacgttgcctcagaaagacagcacaaccaagaaagcctggtaaaaatgatgaaatcaagataaccaagtggacccaggggtcttttcctcactgtccactatcacatccctatcacatcacccccacacacgcacacccatacccacacagacacatactaacacactctgctaccagcagcagtcataagagattgctttgggccatgatctgatttaaaatgccaacgatactatttctttcattctgtcatacacacgggtctgtatctagaatctgctctgttttattgaggcaattttcatccctgttttaatttctaaatctattatgtaggttttcatgtcttgtaggccaagctccctatcaaggttattcccatatgtgttcttgtccttttaattgaataatcagctcattttgtttcatgtcaaattcatatggaggttcatgactgtgcttgcactgagttcacagattaaaatggtggcagaaatgatatagtaattaatttttcaatctagaaataatggtataatagtgtcaaacaggaaacatataaaaatgtttcatgaataattctcagtatttaaaaaaatcatattcaggtatatctgatggccagtgtgaactggatatattattcctattatttcataatttattcttagaggagcatacaatatcttcttttatgtgtttagcttgtgtctaccttacatttttgtcaaactgggtgatttccttggttgacagaggcaatttttctgaattccta

SEQ ID NO: 50883 - DNA, 1029 bp, Homo sapiens
tttatccatgtgtaactatgcatcctaatttctgtctcttcagttgtgtggccatggggtataggaggttggctgttatcggcctctgctcctgtgggttttactccttcttggcctacctgctgctctttcagtctccattccccaccttttctcctcctcgcagccactgtttgatgctggactgcaggaaaatagtcaccgatgcaggagtgtccaggcagtgttcccaccaacagtgcacccaggaggcccttctaccttgtagtctctaacccctccccatttcatcctacagccagctgcatcctctgaagagaggctggtggctattttttggcaatattgaatcagagcagggacagagaaggcgacagggacagagaggagggtgaaaaggacatggaagggttaaattttctacctaacacaaatctggaagaaacctggctaaggggagagacagtaacagcgccttagatgtaggtggaggtggagagacaggaagaggccttggggagtgctggacaggttgtgaggacccagagaatttgggaggagaggaagagggcacagaaggactgcttgcaggcttattttgcagctcacaggaaaggacaagagaaatgcttggaatttgcaatggctttaatggttgaccttatgttaatttcatcttactcctaacttaagcttgcccatatccaccatggctctgacctctttgcaatccctgtcccctcttcagcttgagctctcacttctcagtgaccaattgcctacataattctcatttcacttgtctcagagcgaatacctgtatttcccagtcctttagcttttttttcctggaagccatgtcacagtcttgttatcctctggtttagttccacttcagtcaaatgaattctcttcaattggctgtggcctaaacagatttatttcagatggcacaaataagtgcacctggggattctacttctttggggacaatgagaagaacaactgcttttagaaggatctgaaagt

SEQ ID NO: 50884 - DNA, 1045 bp, Homo sapiens
cgacccggtcagtgattcttaaacctggctgtgtggggagaatttgtagggagagcttgttaaaaagtcgtatttcggggctccacccgctaccctgacgcattgaatctcacaggaacccggggattcgcattttaataaaccatcctggagattttgactccggtcgtccgcctgcagttcacagtggctttggatttgctttttagtatccccatcttcaagacctaagcttcgatctagcgaacccgcccattaccctctgccttcaacagccacggaggtctctggggttaaggtttgcctgcgggccccgcctcttgtctttcaattggtccctcgctggtcccgtcctggagccaaattttcttttctgattggtcagctgcgaattgtggctagacctgatccaatggccgcttgatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagttt

SEQ ID NO: 50885 - DNA, 2054 bp, Homo sapiens
tattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgtttttggtagtgttttttgggctttttttttttggacttttaatctcatttcttctgcttttctgtccccagaaaaatgtaagagctaattttatgactgtatttttctactgtgatgctgttttactgaattcaatggataatttaattgtacatgtaaaatcttactgcagttttatgtttttaatagtcaaaatagaatgtataatcttgatgatgtttataaatcatcaaatgccctttggggtgtaaaaatgggttcttgagcagcagtgtctaatgattccatcacaaatttgttataaagccaaactcccattgaaagtgtcactttatacttaataggaaatcgttatgattaaagcatcaaggaagcaaatataaagtttaatgaaaatccaaggggaagttctaaattgcaaaacttggcacttatctacagtattttgaaaaataacaccaccggtattcaaacctacctaggaatatctcaaaataacctgttaattaagtgttcttagaaaggggagtgggggcaagaaagatgatgtatgcacatggcgaaaagatcagatggtacagaaaggtataaaaacttggtcccttccctcctaccctaatactcctctccaaaagtaaccagtttcaagtgtcttgtactcacaggaaaacaattttttattttttatcagcaaatttgtactttaaaaatttcacattaatagaatcagactatatatactcttctgtaccttgctttttttgctacctgtgttttatgagatctttctgtatcagtatatataaaaatacctcattatttttagcggctgtgtggtattctaatgtttgaatgtgttacaaatgttcaaacactgataggctctttaggttgtttccaatattaaatcacattgtggtgaatatacttgtacatataatgagtttttattctacagtgtacctagcaatacaattgctggatcagagggtattttttattttcagttcagtagttactgccaaattgtcctctagaaatctttgcccagtatgcttccacatataatgtatgagaatgattatttaccaaacccatgccaatactgggtactaaacttttgaagtctgatcatgtgaaagtgaataaatggtatcttgcgttttaatgaagttctaatgcattttaatgaaggtctggtacattttaatgaaggagatggaacacattttcatgtttattgattactgatatttcctgtgaaatgtgtagtcatgttctgttttctattaggtggtatgtgttttattgatttgtatgagctttttgtaagctaagaaaattggtccattgtcatgtttaataatattttcctaagttttatttatgtagttaaacttagtctttacagcttctgagattttgccttgcttagaaaggccacctttgcatttaagaataaatttaatgtatttttccagtattttaaaggtttttttttcaacttttaaatctttgattcatttggaatttgtctaggtagtaagagtgaggagaggattcaacatttttctctccaatagcaatctattctaaccccatttattaactttttcaacactgattggaaaaaccatca

SEQ ID NO: 50886 - DNA, 1042 bp, Homo sapiens
gtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataa

SEQ ID NO: 50887 - DNA, 1065 bp, Homo sapiens
aatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagcctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacagaatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattc

SEQ ID NO: 50888 - DNA, 1063 bp, Homo sapiens
tagtagcagtaattgccatttgagaaaacactatttgtccatatttttcctgccagtggatgttgaacaggaaagtcaggtcctctactaggtgctggggatgaaggggtgaaaagacatggcctcagcttgaaggagccatagccagtgggaagacaaacatatgagcaaaccataatactgccacaagatgattgggttgaaagaagtttggtgaaaatacaatgagaacatagcagtaagagcccctcagtctgccttagggcattgaggaaagccgaagatagaaggtaatattagaggtaagatgaggcagggcagtggctcacgcctgtaatcccagcactttgggaggccgaggtgggcggatcacgaggtcaggaaatcgagaccatcctggctaacacggtgaaaccccgtctctactaaaaatacaaaaaattagccaggcgtggtggcgggcgcctgtagtcccagctacttgggaagctgaggcaggagaatggcgtgaaccctggaggtggagcttgcagtgagtggagatcgtgccactgcactccagcctgggcaacagagcgagattcccgtctcaaaaaaaagaaaaattagaggtaagacgaaatgcacaaacagaattgtctaggtgagtgatcaggggaggggtgaaaatctggagcagtcttatctctggtcattattctttcctagcaaaggaaaaaggacagattccttaaacgtagcctcttggtgcctcaagggcagggtgagtgtgtgtgctgagcagtggcctgggacatggcttgggaaactctgtgactgctgggcctgcctcccaggagtactgctgcttgactcttcctgccttcaggcaggcagtacccactccccatcccatcaggatcatagccttcactttttcttgaattctttattgaaactccatatttaattgtgtaattttttttcctagccattctaaatggcacaggctcacctaccaaatttaaaatgccgttcaacaatgccaagaaaatgacacacaagctggtatttctagaagatg

SEQ ID NO: 50889 - DNA, 1067 bp, Homo sapiens
ctgacttgacactttatcaggggatgagaaccagattataaagttcagatggaacccagagcaaaaatctctgtctctgagaaagaagacatgagcagattctctggctgcattttattttttattttatttatttatttattaattttgagatggagtttcactcttctcagccaggctggagtgcaatggcacaatcttggctcactgcaacctctgcctcccaggttcaagccattctcctgcctcagcctcccaagtagctgggattacaggcatctgacaccacgctcagctcagttttgtatttttggtagagatggggttttaccatgttggccaggctggtcttgaactcctgacctcaggtgatccgcccgcctcagcttcccaaagtgctaggattacaggtgtaagccactgcgcccaacctctggctgcatttttatgttacagtctctattacccagtaccactgcaggtcattgtcagccaccctcagaaaaccatagaatgttttcctagtgaaataagcagaaaacagcaaattgtagattagtagtccttaatttgaaatccaaattgctttaacagattccacatcctacattggtttcccccatcttgcattctgtggtaccatatacaactccatcaactggaccttacacccctgtaacagataagataaaccatacatacttctacaagtttaaaatcattaactgaagaatgtctcatctatctaaagtcaagtcactgggtaaataaatgcccaaactgagctcagactatactcagtttgaattattaccatagcccaatttatatttccagtttttagtgtattattcaccagcattggtcatatgttttatatatgattgtttatgcttgcatttctcaggagggtgccttcaagaatcctctcagtgcttttgagaaatgtcaggctgttggctcctgttactgtgttaatggatagctccacagtcacatactttgaattaggatggtgtgatgttcataacaatgaccctgtggtcctgaatcctcaggataacatt

SEQ ID NO: 50890 - DNA, 1103 bp, Homo sapiens
gcatagcatttacattgtattaggtatgataagtaatctagatatgatttaaagtgtatgggaagatgtgcattggttatatgcaaatactatgccattttatgttaaggacttgagcatctgtggattttggtatccatgggggtccttgaaccaataccccatggataccgagggagggaagactgcatagtttacaatggagtatacttgaagtttgctaagagtgtagatttccaccacacacatacaaaaggtaactatgtgaggagatggatatgttaattagcttgattatggtaaccacttcacaatgtatacatatatcaagacatcacattgtacagctttgtcaattatccctcaacaaagctagaaaaagaaaaacttagtgacgggccctagtctcttgtgttttgttcacccaagctgggaagtgagtagaaaaggaggagggaagtatagaaaaggtgtaatgacattgcatttagctaagcatgtgtggtggtggttgttcttccatcaaagtcaagaagatggaaaccatttagagcagtaccattcccaatcagctagaaagtccactgtttttcaggatctgtatttttataaagtggcttttattgttaagtattttaacagtacctcagtgcaagccatttgtctctgaattttatctttattttctaggagccttgttgatactgtttacgccttgaaggacgaggtcagagaactgaagcaggtaataaaatataaaatcattttctcgggtaatagaaccattctctttttcttgcctcacgctgctcatgctttcagggaaggcctaggagcaaggtagcgaggggggatttttgttttccttgtgtcatcaaggtaggttttgttgattttatcatgtaagccttgaatttaaatttccgaggcttgcttgtatttctatgtagtagttcacaatagagtcccaaagttagttacaactttcctgttctctgacatccataaacagactttaagaaaagactagtcattcatgagtgtgtaagtgtaaagagaaccattcatcatggtttgtgggcttttctgccgatgtggcctag

SEQ ID NO: 50891 - DNA, 1036 bp, Homo sapiens
agacagtaaatattttagactttgcagtccatatggtctctgttgctactactcaactctgatgttataacatgaaagcagccaaagacagtatgtaaacaaatgagcatggccatgttccaataaagtcatatttatcaaaacaggcagtgggctggatttggcacgttgtccataatttgctgatccctggtttagagtacagatgctcctcaactttgttagtcaaaaatgcattaaatacacctagcctagtgaacattatcgcttagcctagcctatcttaaacatgctcagaacacttatattagcttacagttgtgcaaactcatctggcaacattgtacactgtagaggattggttgtttaccctcgtgattgcctggctgagtgggagctgcagcttgctgcccctgcccaacatcacaagagagtatcatattacatatcacttccccaggaaaagatcaaaatttaatattcaaagtgtagtttctactgaatgtgtatcacttttgcaccattataaagtcaaaaaattctaagtggagccatcataagtcagggactgtctgcatatactgcatcttgaaggatagtgccccatcctcacggggattgtttcaaagctggtgcttcatctgtgcctttaaagtgcctttttttttttgagacagagttttgctcttgtagcccaggctggagtttaatggcacaatcttggctcactgcaacctctgcctctcgggttcaagagattctcctgcctcaacttcctgagtagctgggattacagacgcccgccaccatgcccggctaatttttatatttttagtggagacagggtttcaccatgttggccaggctggtctcgaactcctgacctcacgtgatccgccggcctcagcctcccaaagtgctgggattgattacaggtgtgagccactgcaaccagccctaaagtgcccttctatcactctattacaccagcagcctctgaatggtgcacaatgttgtagggccaatgaatttcatt

SEQ ID NO: 50892 - DNA, 1044 bp, Homo sapiens
tgagaaagaataaagtaggagaaattactctacttgatgttaaaggctaatacataaatcctataatctggacaatgtggtattggttgaggggtagccagccataaagattaacaggacagaatagacaacccagaaatagacccacacaaatatgcctaagacatttgttgttttttgtttttgaggcagagtttcgctcttgttgcctaggatggagcgcaatggcatgatcttggctcactgcaacctccgcctcccgggttcaagtgattcttctgcctcagcctcccgagtagctgggactacaggcatgcaccaccacacctggcttgttttttagtagagatggggttttgccatgtgggccaggctggtcttggactcctgacctcaagggatccgcctgcctcagcctcccaaagtgctgggattacagacatgagccaccacgcctagctgcctaaaagatttttgacaatggcataaaagtaactcaagggaggaagaatagcatttttaacaaacagtgctagaacaattggacatctaggttaaaaataaaaaaagctaatcttaacctaaacctcatgacttatacaaaattaattccaaatggatctcatatttaaatattaagtgtaaaattataaaacttttgggaaaaaaagtatgacaaaatctgttggacctaaagacaggtgaagagtttttggatttgacaccaaagtgcaatccacaaaggaaacaaaatggataaattgaacttcatcaaaataaaaaaattttgatctgcaaaagaccttgttaagagaataaaaagactaggccaagactgagaaaatatttgcaaaccacatatctgacaaaagccctggatctataatatataaagagctctcaaaattcaacagttaaaaaaacaagcatttcaattagaaattgagctaaagagggccgggtgtggtggctcacacctgtaatcccagtactttgggaggccgaggtgggtgaatcacctgaggtcaggagttcgagaccagt

SEQ ID NO: 50893 - DNA, 1085 bp, Homo sapiens
agaaactgagaaacagaagggacagaaaaaaaataaatggcaaacataagccctaacacatcaataattattatgaattttaatgatctgaatacactaattgtaatacaaattggaagagtagatacagaatgtaatccaactatgtgctatgtacagtaagctgacttcaaaacatggttgacataggtaagttgaaagtaaaaggatagaaaaagatgtgtcatagaagtattaatatactaatgaaataatcaggagtgtattaatatcagatgcagtagacttcaaagcaaagaaaattactagggataaagaggggcattatttattgatgaaaggatcaatctaaagaagacataatgatccttacttttgtatgcaccaaacaacaaagcttaagctacataaataaaaactgatagaattaagaagaaatttaaaaatccataattgtagatgggatttcagtatccacacccagtattgacagactactgtaaatataatcagcaaagatatagaagaactgaagaatgtcatcaactaagaggatccaattgacatttatagaacactttacccaacaacagaatacacgttactttcaagtgtccataaactattcaccaagatagaaccatatcctgggtcataaaactcaattaaagaaaaattcaactcagagcatattcattttctgttgctgctataacaaattaccacatatttagtggtttagataattacaaatatcttacatttctgtaagtcaggtgtctgacatgggtctcaggttaaaatcaaggcaccagaagagctgcattcctttctttttttttttgagatggagttttgctcttcttgcccagactggactgcaatggtgcgatctcggctcaccacaacctctgcctcccgggttcaagcgattctcctgcctcagcctccggagtagctgggattatgggcatgccccaccatgcccagctaattttgtatttttagtagagatggggtttctccatgttggtcaggctggtctcgaactcctaacctcaggtgatccacctgcctcagtctcc

SEQ ID NO: 50894 - DNA, 1110 bp, Homo sapiens
tgttctaagtacttttcattaacatatttgctcctcacaggaactcatcaggtaaatactattattttcctcattgaatgcgtgaggaaattgttacatagataaataatgcaaggtcacatacctatatactgatagacttagatttcaagtcgtgttgttccagaaatcatgtttctaactagtatgctacactgcctgtcatgtatgttaatacatgtaatactttatgaatcatttaaggtgacttttagtcatccacacagaaatgtcacatgtagaattaggtgtaagtaatgaggttgctggagttgtatgggttggaggtaaatttgggagtcataagcatgtggatggcactataaggtatgaatatcgaagtggatgagatcactcaggaagagtgtaactagagaagtccaaggactgaatgctggcatgctctaacgttttagaggcccacgaggtgagaatgtagcatgaaatctaaaaaggaatgggctcagaggtaggaggaaaatcaggatagtgtggtttctaggaagccaagagaaagttgcaagaatgactgttgaatgctgctcagaggtgaagaaaaaggagtgagcattcgacacaacatgctacatgcgttgggcatactaacacacagttaacaaaagccatttcagggggatggaaggcgcacaaccctatttgaagtgggttgaggagagaatggcacagaaggaaagacaagaactagagtgagctatttcgagaaatgttgctgtggtgaaggacagaagagtaggaggatgtggggtcaagggaggtatttttttaaaatgggagatactagaatgtcttatttatttatttattttgagatggagtttcgctcttgttgcccaggctggagtgcaatggcgtgatctcggctcactgcaatctctgcctcccgggttcaagtgattctcctacctcagcctcccgtagctgggattacaggtgcacgccaccacgcccagctaattttgtatttttagtatagccagtgtttctccgtgttgatcaggctggtctcgaactcgtgacctcatgtgatctgcccacctcggcctcccaaag

SEQ ID NO: 50895 - DNA, 1049 bp, Homo sapiens
caatgagagagaagtaaatgctcgaaggtaaattgatgtaccatgagaaggtagaatggatatgggacagtaaaatcaacagtaatggccatgcccagtggctcatgcctgtaatcccagcactttgggaggccaagtcaggtggatcacctgagatcaggagtttgagaccagcctggccaacgtggtgaaaccctgtctctatcaaaaatacaaaaattagccaggcatggtggtgggtgcctgtaatcccagctactcaggaggctgaggcaggagaattgcttcagcccgggaggcggatgttgcagtgaaccaagattgcacccttgtactccggcttgggcgacagagccagactctgtctcgaaaaaaaaaaaatagtaactatgctctacactacgcagtccacttactatcccagttccttattctcctttgctgcaaaatgtcttgaaagagttatttatgcctgctgtctgcagttcctcttcccacattctgtttaattcatttcagtcaaggtttcactctcagtattttactgaaactgctcttgtcaaggtcaccagtgacctgcacattgttagattcactccaggttttcctcttacctccatatttgactccattgattactccttccctgataataatttctttatgttaattttaggatactacacttcctttttgttttaccccactgatcactacctccattctcttgctgatcttcttccgtgcctttttttttttctttttcttctttttgagaagggggtctcactgtcaccctggcaggagtgcagtggtgtgatctctgctcattgcaacctccgcctcctgggctcaagtgattctcatgactcagccccctgagtggctgggattataggtgtgtgccaccacggccgactaatttttgtatttttagtacagatgcagtttcaccatgttggccaggctggttttgaattcctgatctcaaatgatgtgctcatctgggcctcccaatgtgctggggttacaggcgtgagccaccacac

SEQ ID NO: 50896 - DNA, 1026 bp, Homo sapiens
gagagtcatttgaaaagttggaaagtgaacaaactggagaagtatttggtatttttgagtcccatttgagatttgtatcataaatttatagagaaaccagttaagcatgcttatgtatttttctctagcagtacttacagcttgaatgcaggtgttgatcccacaaagcaagtatacaataagggagaagtaaatgctcgaaggtaaattgatgtaccatgagaaggtagaatggatatgggacagtaaaatcaacaataactatgcactacactatgctgtccacatactaccccagttccttattctcctttgtggccaaatgtcttaaaagagtcacttatgcctgctatctgtaattcctcttcccacattctgtttaattcatttcagttaagttttcactctcatcattccactgaaactgctcttgtcaaggtcaccggtgacctgcacattgttagattcaatccaaattttcctcttccatattcgattccattagtcactttttccctgatagaatatctttatttgaattttatgatactacactttcttttcttttcttttgagatggagtcttaactatttcccaggctggagtgcagtggcatgatctcggctcactgcaacctccgcctaccgggttcaagtgattctcctgcctgagcctcccaagtagctgggactacaggcgcccgccactacccctagctaatgttttgtaattttggtagagaagcggttttgtcacgttggccaggctggtctcgacctcccaacctcaggtgatccagtaacctcggcctcccagcgtgctgggattataggcgagagacaccgtgcccagcccactttctttttcctttaccccactgatcactcctagtctcttactgatcctcttgcctaacctccatttttttttttttctttgagacagagtctcactctgtcacccaggcaggagtgcagtggtgtgatctctgctcacagcaacctttgcctcccgggctcaagtga

SEQ ID NO: 50897 - DNA, 1469 bp, Homo sapiens
gaccttgagtgatctgcctgtctcggcctcccagtgttgggattacaagcgtgagccactgcgcctgcttgctttttaaagcagttacttttattttcagctaaagcaacaaaaaagtatatatttaaatgatagtttggggggaagtactttacagtaaaacaaatactatgtaacaggatcccatgtttttcattttacagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcatctttttttgtggcaaggggctcttctttacttagaaatt

SEQ ID NO: 50898 - DNA, 1332 bp, Homo sapiens
accaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaaggtaagtgttgaaagcaatggcctttgaaggtttaaatgttgtgtaactaccatttagtttagctgtgacattggcaagttattgtggtcctcacttcatctgtaaaagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactagaaaaaaaaaaaaaaaaaaaaacaccgggcgtggtggtgtgcgcctgtaatcccagctactggggaggctgaggcagaattgcttgaacccaggaggcagaggttgcagtgagccgagatcacgccattgcactccagcctgggcaacagcaagaccctgtc

SEQ ID NO: 50899 - DNA, 1470 bp, Homo sapiens
tttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacaggtaatagaaaagtgcagctttttaaattaataattaaggttgaaggaaagcttatcaaaagcataaaccaaaacttttgctttgtagctattcaagcagagattacccaagttctcgtgatactagagattatgcaccaccaccacgagattatacttaccgtgattatggtcattccagttcacgtgatgactatccatcaagaggatataggtaagtgactttgcttctgtggcttacatgtaagaaaagttgcaatgaaagttgattctctgggacttaaaggtttctctttaatttagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggag

SEQ ID NO: 50900 - DNA, 1077 bp, Homo sapiens
ctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcc

SEQ ID NO: 50901 - DNA, 1041 bp, Homo sapiens
ctttgttttccgtttctgcaaaattggtatagtaggagtatctaccctcatcacattttgacaattagaagagttaatggaaaagtaaaagtaaagttttgcaccgtgcccggcccactaggacgctcaataaacttcagttctttattaaaggaagcctgtgcaccattttagcgtaaagcaaaaaaagcgcgtttgtaaagaacgggtgggggtagagaaaacggttagaaaggtctgtcgacccaacaccgagggcccgggaaaaagggaggagagaagggtgaatgacagaggagccagccaatggggagactgggaactacttcccccctccctttgcgtttcaaattctaagctccgtttccatccgggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccggtacgtgtctcctttcctcagtccgtttttcgtgacactctccccgtgttaggactggggattatatctccctggagatgggggtggcgggcgccattttaagaacccaaaggttccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggttt

SEQ ID NO: 50902 - DNA, 1050 bp, Homo sapiens
agaagacatgcaaatggtcaataagcacatgaaaagatgctcaatatcattagtcatcagggaaatgcaaattaaaactataaaataggcggtgcaccctgggatagggagcgatctccaagcgaggcggcaagatggactcaggattcttccaccgatcaagtgcagaacagtataatcggttcagcaacaaacagaagaaactactgaagcagctgaaatttgcagaatgcctagaaaaaaaggtggacacgagcaaagtaaatttggaagttataaagccttggataacaaaaagagtaacaaaaatccttgggtttgaagatgatgttgtgattgagtttatattcaaccagctgtaagtgaagaatccagactccaaaatgatgcaaatcaacctgaatggattttcgaatggaaaaaatgctcgagaatttacgggagaactatggcccctgctgctaagtgcacaagaaaacatctcgggaatctcttctgctttcctagaactgaagaaagaagaaataaaacaaagacagattgaataagaaaaattggcgtctatgaaaaagcaagatgaagacaaagataaaaggcataagttagaaaaagaaagcagcagagaaaaaagggagaggtctcgtagcccaagaagacacaaatcttcttcccctaaaagacaatcttcccctgttagaagagagaaagcacagtcattctcgatctccccaacaaagaaccaagggccagagtccttttcctgctccagaaaagaaggaaaaaactccagagctcccagaaccttcagtgaaagtaaaagaaccttcagtacaacaggccacttctactagtgacattctgaaagtttccaaacctgaacctgtaccagagcctaaagaaccttctccggaaaaaaattccaaaaaagaaaagcagaagaagacccgaccacgatctcagtcacactccaaatcaaaatctcagatgcggtccccactgtccttctcacactccacctagacagcgccatagatcccaatcaagatcgta

SEQ ID NO: 50903 - DNA, 1035 bp, Homo sapiens
gctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatg

SEQ ID NO: 50904 - DNA, 1031 bp, Homo sapiens
aatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaa

SEQ ID NO: 50905 - DNA, 1034 bp, Homo sapiens
catcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaa

SEQ ID NO: 50906 - DNA, 1061 bp, Homo sapiens
tgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactt

SEQ ID NO: 50907 - DNA, 1048 bp, Homo sapiens
atgctaaaactctaaaaaaactgggtatttatggaacatatctcaaaataataagggctatttatgacaaacccctagccaatatcatactaaatggacaaaggctggaagcattcctttgaaaactggaacaacaaaaggatgccctctcccaccactcctattcaacatagtattggaagttctgttcagggcaatcaggcaagaaaaagaaataaagtgtactcaaattggaacacaggaagtcaaattgtctctatttgcagacgacgtgattgtatctttagaaaacctcatcatctcagcccaagaactccttaagctgataaacaacttcagcaaagtctcaggttacaaaatcaatgtgcaaaaatcacaagcattcctatacaccaataatagacaagtagagagccaaatcatgaatgaactcccattcacaattgttacaaagagaataaaatacctaggaataaaacttacaaggtacatgaaggacctcttcaaagagaataacaaaccactgctcaaggaaataagagaggacagaaacaaatggaaaaaaaaatccatgctcatggataggaagagtcaatatcgtgaaaatggccacactggccaaagtaatttatagattcagtgctattccattaagctaccattgactttcttcacagaagtagaaaaaaaaaactacctttagtttcatatggaaccaaaaaagaacccgtatagtcaagacaatcctaagcagaaagaacaaagctggagccatgatgctacatgacttcaaactatactacaaggctacagtaaccaaatcagcatggtactgataccaaaatagatatatagtccaatggaacagaacagaggcttgagaaataacagcacacatctacaatcatctggtcttcagtaaactttacccaaaaaaaagcaatagggaaaggattccctatttaataaatggcgttgggaaaactggctagccgtatccagaaaacagaaagtggattcctttcttacaccttatacaaaaattggc

SEQ ID NO: 50908 - DNA, 1035 bp, Homo sapiens
tatttctcctatctaatccaaactctgtactctttaaccaaccccatcacccctccccagcccctggcaaccagcattctactctctgcttctatgagtttgacatttttagatttcatatataagtgatatcaagcagtattcatctttctgtgtctagcttatttaacttaacatgatgccctccaggttcacccatgttgctgcaaatgacaggaattcattttattttaacactgattattgtttcattgtgtatatagaccacattttatgtatccattcacccactgatggacacttaggttgattccatatcttgagtattgtaaataacgctgcaatgaacatgagagtgcaagtatctctttggcatactggttttatttttttaacgtgtatccagaaatggaattactggatcatatgatagttctatttttaattttttgagcaacctccatactgttttccatgatagctgtactaatttacattcccactgaatgagaacacaatgatattccctacatcctccccaacacttgttatcttgtgataatagtcattctaagaggtatcaagtagtatctcattatgattttaatttgcatttccctgataattaggatgtcgagcattttttcttatacctgttggccatttgtatgccttcttttgggaaatgtctacttaagtgctttgctcattttttcttttggttatttgttttcttgctattgagttgtttgagttccttatatattttgtatactaatcccttaaatgtatggtttgaaatttttttttccattccataggttatctcttcactctgttcattgtttcttttgctgtgcagaagctatttagtttgatgcaatcccaacaccctttaaattatagatgatttatagtatgttttactgtctagtagggctagtacctgctcatagtttatcattttttgtgtgtttcactggctattgttaatttttccatgtgaggttcagtgacaacttgtctaattctaaa

SEQ ID NO: 50909 - DNA, 1032 bp, Homo sapiens
attttatcagcacttgcccttgtcttgcctcacagccaatatccacactcactccagcacatgaaaatcacttgtccacttccacccatgtgctagcaaatttttacttatgagccctagctattttaagatatatattctcagaagcatgtccagctttggaagcagcaagtgtacaatggccccaagactatatctacaaaagggaaagggaagagagcgtacttccactgggccacatcttcagtgacaacactgtgcatagccccttagaagcatgatcacgaaaaccctgtcagatagggttgctactaccatttcacagatcagcaaactaagatgcagaaagagtaagtcacttcaccagtaaatgagaggacttgatttgaacctaatttttctggcttctaaaagccatgccttctcccctccatggcttctccatatgctcagtttcccccctcttgctccataagtgcatttgttatctaaaacaaactgtagtgctaaaaagtgatcttaagtgtaaaggaataaaattctgtctacagtccttcctcagctttgtgacagcaagagtttgtcataagcagaagggactcgactcaggaggtacttgctcattctgtaggcctaagattaggtagagtgcagcactcaaaaggaagagatgaaatgacccttacctttaaggaactgatgacttggtcccggcatacaaagaaataatggagtgattaatgaatacttaaattcgatttgaatgcaatagatctgttcctagataaaagatattaaaagctcacttgtctactctgctttctttaggctagggaatgtgcctttccacctatgtgttagtcagttctcacactgctataaagaaatacttgagactgggtaatttataaagaaaataggtttaagtggctcacagttctgcaggctgtacaagaagcatgatgctggcatctgcttagcttctggggaggcctcaggagacatttaatcatggcagaaggcaatgctgga

SEQ ID NO: 50910 - DNA, 1070 bp, Homo sapiens
gcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcat

SEQ ID NO: 50911 - DNA, 1028 bp, Homo sapiens
aaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaacc

SEQ ID NO: 50912 - DNA, 1090 bp, Homo sapiens
taatcacttttgtggtgtttgcccaatagcaatgttctatctatatcattcattctacatttattaatttgaattctactgtaaaaagatctgcccttcttctccatttatttatttattcaattatttatttttattagtatatactccaaggtatttattttattatatggattgggctctattattatcatcatttaattatccctatatctcatgctatataaaataatgaactccaaaaggaacagctaaataagtgtaaaaatgaaaccacagaaatgctagaagaaaatatgggtgatttcctcttaaggtttgttgtttaaggctttccaactacaacttttcaatttacatgaaattccatatgcaaaaataactaaatacataaaatattgataaattagactacatgaaactaaaacaattgcactataaaacacgataaacaaaattgaaagacaactgataaacaggaagaaaatgtttgcaccatatcacaaaagactaatatcccccaaatataaagaactcctaaatcgacagctaaatgactaaaaacctgatagaaaagggaaaaaaagacatgaacaggaaattcacccacacacttacacacaaacacacacacacacatgtatatatatgtgtatatgtaaagatgtcccataaatataggaaaaatgcctaagctcacttataattagagaaatgcacattaaaacaatagcaagatgctgttttcttcctatgaaactggtgaaaatttaaaaatatgacaacatattcttttggcaaggctgtggggaattactcctccttattgctgatgggaatgcaaaccagtgcaaaaggggactttttcaactatctagcacagatgttatacagatgaaacagaaatgtatttattttctggtgatatttgggagaaggctgcgttacgatgatgtttctggaggtcactggtaatgtaagttatattacataagattatacaactgacatttatagctacttgaaatactttcccaaactttcccttattgattgtctttaaggaaatatagtcatgttcagggagtgt

SEQ ID NO: 50913 - DNA, 1093 bp, Homo sapiens
ccagtattgtcaaataccatgatgaaatattctgacaggtctgcagttttacacatgtgattgaatgttcagactactttctctccatgacaggctaccaaataccatacataatttgagtatttttgacagaagaatgcacatcattttctttctagggaataacatgcttttgaggtttattacccgaatttgaacacattcttatagtggattttccatattgttcttccaccaacaatcattaagggttgtgatgttgtgttcaaatgccatcttatacattaaattaaattcaagttggtgtggttaatgttattggaaaatacctattaggcttgcttgaaaaatgttaggaactgtgattgcatttagaacacagaatcagacttatggaagcaactgagttctattaaagtacctgagtttatgtagaagagcaaagctaaaatgtgactaagtgcaatgcttaaaacacactaataccagttaaatggataagtacctgtagtaattaataaaaaaggaaattcatctagaatataattttaggtgtcaataggaggagtccatcctgcagaagagattcagatagaaattctacttctaacctagataaccatgtattagtatcagtgcttttgtatgcacgttataatctcagctaatcctctcaagagtgctatctcattcatttaaatgggttataatagaaaatggatctgctcattctattctacataataggaaattaaaaaaacaacatcctttgttgtttaagcatacatattatattgctctactgaaggttgtctaagcttctattttcttagacaatctttttttttcttcaatttctattttaagttcaggggtacatgtgtagaatgtgcaggtttattacatagatcaatgtgtgccatggtggtttactgtacagatcatcccatcacccagatagtaagcccagcatccattaggtattcttcctgatgctccccacccccacccccacctccgacaggccccagtatgtgttgttcccccgatgtgtccatgtgttcttatcattcaactcccacttacaagtgag

SEQ ID NO: 50914 - DNA, 1046 bp, Homo sapiens
gaatttaactgggtggcttggtgcaaaatatatattattaaacaattgcttttaattatactgacactaaccagttagaaacaggacaaaatcccattcacaaacaaggtagtaatttaaaaaattacccaggaatagaattaattaggacaatacaattatgacaatacaatctatgtgagattaatcacaacattgtattcaatagaaaaaaaaaaaaaaacaagagctgtagaaggtgagagacataccatgccccctgcatggcaagaattatgttatcttaagcacttaataatattttttaaaacttaagatcatgattctaaagtttctatggaagaacacaggtgctgcaattgttaagggaatcttaggaaaaaagaaaagtgaaggaaaagtgccccgttaggtatgaaatttaatgtaaatgagagtaatattggtccaaatgtggacaagcaaatcagtggaacagaatggagaatacagatccaggtatttgtgggaatctgctgcatgataaaagtattattgaaatcagtagcaaaactgtgactttttcaatatatggtgttagaagaaaataaaaatagaactgcttcttcacaacatgtacaaaggtaaattctagatatattaaaagtaatgtaaaaaagaactactgaagtattagaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactg

SEQ ID NO: 50915 - DNA, 1100 bp, Homo sapiens
actaactttttgaaatatcttcatattagtgtaatgagtgtgtgtgtgtgtgtgtggtgtgaaaacaaaattttcacattaaagcatgtcacattctatttttattatttttaacttatgatttttataaataaccattattaccagtgctaggttccaggatactaaaacaaggcaaagttggaaagaatgtttccatacaaaaaccaatatataacataaagatatgaacagatgaatgaactataaagcaacttctgctaaactggtaattgttagaactaaagcttcagagacttgtaatttataccaactcctggatatgggatattccattgttggattgatggcctaaaataagagaaacatcatttttttcagaagaagttttagaacatggctgaaatccgtcataatgcttaaccttgaactctcagatatcagtgctaattcatattttgtagggcaaatataggacaagagaaactgcacaggcagactgctagtgggtggaaaaatgccctttgactgggaatcaggagacttggctttttgttctagatcagtcactgctttatagggtgacctgagcaagtcactttaatgttgtggatcttactttcctcatttgaaaactacttgtttagtcaaaactattaattataaactatgttctgtagtaataggcttccacagaggtgccacagagatcactgcaggagggactctgcgaccttaatccccaactatgacccaagtagttcttttgtccactggtctatatataggggctattcttggggtttcatttgaataaaaggttctaaggtctgagtaaaatggggcactcccaggctaaatgatcctgacttaggatacacaacctgatcaaggttcttcaggttttaaggttctgtgatatctggataaccaaagtaggtgtttgtgacattctgtaacttatctgtctgtgatatgttagccagttctagggctggaatgatgatggtaatagacatgcccagtgatgaatgacctaccatgctacctaggacatcttacaccttgattattgaatttaaaagagcttctgaatcatc

SEQ ID NO: 50916 - DNA, 1056 bp, Homo sapiens
ttagatccttcctgctttctctcgtgggcatttagtgctacaaatttccttctaaacactgttttaaatgtgtcccagagattctagtatgttgtgtctttgttctcattggtttcaaagaacatctttatttctgtcttcatttcattatttacccagtagtcattcaggagctggttgttcagtttccatgtagttgtgtggttttgggtgagtttcttaatcctgagttttaatttgattgcactgttgtctgagagactgtttgttatgacttccattcttttgcacttcctgaggagtgttttacttccaattatgtgggcaattttagaataagtgcgatgtggtgctgagaagaatgtatattctgttgagttagggtgcagagttctgtagatgtctgttaggtctgcttggttcagagctgaattcaagtcctggatatccttgttaattttctgtctcgttgatctgtctaatattgagtcgggtgttaaagtcccccattattaatgtgtgggagtctcagtctctttgtaggtctctaagaacttgctttatgaatctgggtactcccgttttgggtgcatatgtatttaggatagttagctcttctggttgtattgatccctttaccattatgtaatgcccttctttgtgtcttttgatctttgttggtttaaagtctgttttatgagagatgattgcaacccccctttcttttttctttttcttttttttttttttgctttccgtttgcttggtaaatattcctccatccctttattttgagcctatgtgtgtctttgcacatgagatgggtctcctgagtatagcacatcaatgggtcttgactctttatccaattttccagtgtgtgtcttttaattggggcatttagcccatttacatttaaggttaatattgttatgtgtgaatttgatcctgtcattatgatgttagttggttattttgcccattagttgatgtagtttcttcatagtgtcaatgatctttacagtttggtatgtttttgtagtggctggaactgat

SEQ ID NO: 50917 - DNA, 1095 bp, Homo sapiens
tttgttttgagtttttttttttttttttcttgcaagtaatgctgagtgaatccaactgtagctgactttgttgaatctgcctgggaaaactcttgttcccttgcatcagaagccccaccataaaattggccttggttcaaaattgattatttgcacagattgggatatgttaacaaatagaattccttctcctttctttcctgctcaagttattacttaccaagtcatcaaccgttctctgataggcaagaaacaaactgaactccttaatcttgtttgttctaaagcttaggaagtgattttgaatcactatatagggtttcactgctaagatgtgcaatgggtaaacccccagaggctgggatacagattcaaatcagatcattcgctccaaatgtatcagaactcctaacaatgtcatagctgcccagcatgttttcgaaaacctgccattttgcaggaataacatacttcacgtcagactccaaatggccgcatggatgtgttgcaaagctgaaaattaatgacatgaaacttaacaaggtgttccagaaggtccttgctgcctccctcatgtcaatgctcctctgattccaaataggagagttcactggcaactgtactgttcaactgtggagaaaaatttgaaagccacatgatcataggctttctcagaaattaatctatacaaagatcaagtaaggtataattttcttggctgttgatggaaatatgtttttgtccagcaaataaacaatctagctgggttttggaatcagggcagtgtaaggggcacagacacagaaactgctgtgttaatgatagtgcttttgagacccagataaaacctaggtcttcagctttcccaggaataaagtggtagggccgagaaggtgtggagcattactgagtcaatccaaaacccatcacctgcttctcacaactgaaataactatatcaaacaaggatgactttgctcaatataaccatcaaaacacatggcgtatgtacagtttatcgaaagattttgggttcacaaagcaaattctggaaaatggcatgaaggcagagaatctgatcaaagagtaaatattt

SEQ ID NO: 50918 - DNA, 1045 bp, Homo sapiens
ttttagtggtcaaaagtgacctcatctctgctgattgatctctgaagctgctggaatgaggcaagaatgtgtgatgtgtgcaattcctttggctgcttcttgtccctacagcatcttactctgctccctgagcgagggcttttgggttttgaaaggatctggaactttttttcagaaacaagtctctgctttgtcaggtagttccaaccccatctgtaggatcttcctgaaggctgagcacaccaacatccagctgttggaaacaacagcttcctcaattaaagaagaggcagacaactatctgaaaggaagctgggaacaaaggttatcctcaggagattgctcaggaggccagccagagggcatgaatgtttggtgacagcatatatttgggggcaatttgtactttgctgtttcaagacagagctctgctggctaggagagcacattttttcttcccttactccactaattggcagcgccatttagggctgtcacagcaacagtcttacagatcttgtggtccagacccgtcactgtgtagataaaaagctaaagaccagaaaggaggagtgtctcatccagagtcacatagcagagtgggagtcaagcctgcatcaagactcaggacttttgatggaacgtcccaggctgggaaactttatttggccctcagtttagactaccctttttatcagttatcttttctatggaatatgttctttattttcagttagtccttaagtgccttgaagactgaaaacatattttgtaattgatttttggctctctaccatgatttgtacatataggggtttgttggtcaggtcagccctctcctcttctgactcttattaaacatgactcctattatctctgtatggccttgcccttgccactatgcagccctcaactgtatgcaactcctctcacctggatatggctcctaagtgtgctgaacctcagcttttccacagccagtagctccattagctctagttccttgaagtccattccaaactctgtttctaattcatgtaggttt

SEQ ID NO: 50919 - DNA, 1594 bp, Homo sapiens
tcatgataaataaccagttgcttttgtttcagggaaagccatcttaaaggagcaagtcacaatatgcttctactctcacaaccataattttaggcattaacttactctataagcattattaccaggggccaggtgcctcttataatagtggctagcatgttgccactcttcatcacacgttatcatacttgtcaatttacttgttcacacccctcctccctactttattgtgtactccttaaggacaggactgtgtcttaatcacttttatatccccagggtctcatacatattaaaagtatgaaacaatgaaaaaaaaatagcatagctttggcacaaaggataattacaagcttctgaagccttccggagatatccggaggctcgctttcctcatctgttcagtgggggtaatagtggccttacagagatgctgatcagacactcttgctttcttccccctagtttcttagaatcttcttggtctcctctctggccctcatggcactggttgcataggcaaatctagactcttacacacttggctatgaagagtttaaaacccctttgtaaagaatgtcaaaactacatttgaactttatgtagtattttcattggtacatttggaatcctaactagatcttagaagtcactgtctttgctcacatattctctgagcttaagcacaagaaaatgattcattaaaatatttaaatcagctactagaaacaataatgaggataaacatctcggaggcccaaatccattattctgtgctcccattccatctgtgaaggctggtactctatccagcactaaaaatttataaatgcagggtcagtaagaccatagtcagcaggaaattgcaaaactctgggctcctgcaagcaaagcccaacttttcttcagaaattcatgacattggaatggaacaaaactatgcagaaggtatagtgacaagagtaacactgaactttaaacgccaactctgtggctgcccagctggatggccttgggtaagtcacccaacttttctgtggctctgttgagtcatttgacaaatgagcataatcaatcttgactgcctctgtggagttgccaggaggcttaagggcgcctctgtgtgtggaatgtgctctgtcagctggaagatgcctgtcatgtacatgggagggactcattttaggatggctactcagagatttttgcattagaagcacaggtttgctttagcctcagtttgcaaatgtacaggattagcattcccatgcagtgtcactctatctctggaatgctgctattgccaacagaagtcaaccaaatgcctctccacaatctgtatcaagcataccatatgtttttacacaatggaagtgatcttaaagaattgaataatattttcttgagggaagtttactttttgcaggaaacctgtgatgaattatttggtaagagaaaaaagccctattgtaatctcttctaatctatcaattctaaaagtttaggttcttttatgtaattttttctagacatgccagccaggaatgcattctaaagtattgtagtgttaacataatgtattctaaaaagatga

SEQ ID NO: 50920 - DNA, 1068 bp, Homo sapiens
atataatggactttagagactcagaacggggagggtgggggggcagggataaataactatacattagttacagtgtacactactcaggtgacaggtgcactaatatctcagaattcaccactatagaattcatccacgtaaccaaaagccacgtgtacaccaaaagctatttaaataaaaaaatatattgaaaaaacaacactcatacttcagatagaaagcccaacatgtaagcatataattacaatacaatgagtgatgttagtgcagagggcaagggtagccctgaagagtagccctggggatctgggagaggtttttggaagagttaacacttgttaaatcttgaaaggtaattagaagttaactatctgaagtgggaagaaaagagattatatacctttaaagtataacatgctcttctaaataattttagatttaactcaccgctttcttttttttagcattatttaattttattttgaaattttgacatgatgaaggacgtgataggactgatgaagacgtacagagacagaacccccatagggtggcagttgagtggatcactgtgcagatatgaaagtggaagtaaaaacaattctttgagcccccaaatattaggaattggcagtgatgcttttagcacctccatatactatcagtcattttaaacatctaagactcccattgcagaaacatggcacatagagtcaggaaactaaggttgtatagatatttgcaatctgtaactgtcctagtgtcaagcacaagaaattcagtaggtgcctcacataaccaagcactgatcattgataccaagaccagatatgtgatctaaattagcaaagacacactccatgctgctttgaaaagaattaccatagatattatgcttttacatgatcatctctttcagcaacaccaaattgctctatcacccttcaattcagatctccgcagtaaaatgtttttaaagcaatttgcagcatttcactttctgtggaccacaccctgcctggacagtcacttttacaatcatcactttcttatggagctaaacaggtg

SEQ ID NO: 50921 - DNA, 1771 bp, Homo sapiens
atagaagcagggagcagcctgttgcagtagatacattaggagactggaagaaagctgatggtgttctggaaatgaatatgggcctggagatggagaggtgtgggaatatcagatagttagttagaacacagagctgacccacaggactttgccgatgggtagcatgtcaggaatgagggtgagggaggagtcaaggatgacttctgggtgtctggctggagcactggggtgatgtcatttattgggaccactaggcacatactagtttggtggtgaggtgagtgaatgactccactttgaactgggtttgatttggaaattcctatgaaatgtgaaaggggagaaacagagtagatcattggatatatgagtctggatttcagatgtttgacccaggctggagatgtagatttaaaggttaatgaggaggaagatatgaatgggaaatgaagtcctggattatggatgatcttgttgaagagtagagtgagaggagaaaaagatatgaactaagttgagtaacacctcttttaaaggttgagaggagtagaatcagtaagagacatagaaacagaatatttaaagacatagaaggaaaatcaagagggcatgcttcagacaagccatgtatagggtgtttcaaatagtaattgtcaatagcaatcaccatactctcttgcctctgtgcctttgtacgcatttttctcagtacctagacttcccttctacccttctctgtgtttttctcttacggtatgctttatttttcctttcatgcctagcaactagtatattgcttagcatgtagttctaagtaggtatttgttgagtaaatgaatggatgaatctataatggacccataaagatgacaggtcttactacatttaggttacctttttctttaaggtatatttgaatcattttaagataagtagaacaaataaattttccccgctttcaatccatcaccattgtgcaatcctgaaagcttgaacattcttggtacctttaactggatgccttcctttgtgtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaaaaaaaaaaaaaagataaataacaagtgtgagctggtatagacaaactggtttagaatcaaaagacctgggtcagagtccacgctgtgtctcgtacagattgtgtgatattggcaagtcattggacatccttgaacctcagtttcctcaaatcagaagtgagaatcattttaaaaaggttgcc

SEQ ID NO: 50922 - DNA, 1033 bp, Homo sapiens
actactgcttgatatgggaaaataacttctaatttaactagctgctagacagtcattcagatcttgctaacagtttttctttatatttgacataattaataatgggctgaataatgttattagaattaaatgataacatataaactgaagatcaaatataaaccacattgacaaggcagccagtggcagccacctctgccatttaacttttagaatgggcgatcaatggagagaaagtttccaatcacagtcatctattcaccgtagttttctagtactgatctggcacacattttgtatgtctactatgaagtcaaggtcagtgttactagtatgatacccaagaaaacacaacaggagaaattaaataacaagctgtaagattttgttgggtaaggttgagctctcgagagccaaaaaccattgtaatatgtaagttttttttttttcttccctcccaaagaaccaacttcaaccctttggagactgtattgaccctttgagaatgcgtggcttatctgattgtgtcctcttaggagtcttaacttcctaacatacggggcccaggagagctaagtattaaaaggatatggacagagtatgagaaaagattcagtcatgagacattgctgtgggtgtagcaccctttgtgggccgctgaaacaagtggcctaggctactagcatgaggttactacagtaatggagtcaaagcagaattaggggctgctccttggagttcttgtatctcttaggttcactgcatctcagtgcttatcatacaatgagtagttggtattttataagttgtctggtctatcagctctgtgcaggcattggctgtttctatcttgttcctattgccagttatctagcacagtgcctggcacatagaaagggctcagtaaatatttgttgataggatagagagaaggcactgcaggtggactcagcctacttcacaggctagatgagggctagatacaataacaggaaaaagaagattcactatttgaaaagaatcccaagccacc

SEQ ID NO: 50923 - DNA, 1082 bp, Homo sapiens
ccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggaga

SEQ ID NO: 50924 - DNA, 1020 bp, Homo sapiens
ataagaaaaaacagaagaatcaatcgactcatagatacatgatctaccaaaaggaaaattaacttccatattgtaggggggaaatatgcttctttcagtaaaaaggaagaatattttcacaataatcttccaaagctgaatatatcttcagacttcctctgtcaaaattaacacatcaagaaaaacagcaatctaatcattcatcaaacatttcctgagtatctgctgtgtgccagacactattactagctgctggagatagaaggtaaataaaatgttcctgttttcaaggacctcccagcctagaggagaagggatcacagcaagctaaacctctgctatggtaaataatcccagaggtagaaagtattaggagaaccctggaacaatccaaaagcaaaaagcaagcctgaatctattcagctgacaaatgaagaaaggattaaaatctggttatagtgtcactctttttttcccctgcatgtgaataaaacttggcactttgttaagacagttgctttactctcataacaaaatttactacttatttctgaaaatgcttaacagatggtttcacattattaaaataagccttttaaatctgtatattttacatttttcagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattt

SEQ ID NO: 50925 - DNA, 1054 bp, Homo sapiens
gttaaacatttttcagagccaaatgttgatacagcatatttaatttgtaaggggcaagttgtcatggcaaggccaccatgtgaaaatgtttgttaatattgatcaggaaatataactttgatttataaagatcatttggaaaactaaaagtaaatattccaaaattgcatctgtataatatcaagccaatttagcattgcatgttctcttgggaattatgtgaaaataactaaatgtgtttgtaccttcatgtgctgtgtctgtgtgtttgcaggtactgtatacacttatgtccttgtaaatgtctgatctccaaatatatatcaatgaaccagtctaatcataacttttttaatgtcaagttttattcaagctaaatgtttcaactttcagaggtaaaatatttcatagccattcagggggatgcttgcctaatgatataaaatgctttataattaatgtttccaaaaatgattaaattcactttataatgtttcatttacccccaaaaatatttgggaggaattgatacgccgtgggagggccccttgaactcagaatgactcctttatgtatagtctgtatttccttcagtgggggcctttaacaactcagacctctggaggtcttttatccatccataggaatttagagtaattaatgaacaaggcttccaagcttgtcagcttggaaacaactctacacagcttaaagcagggccatctttcatgcacacataaaaattaatgatcatcatgaatacaattgtgggttagttcactttgaagctaataattgcgagtccaccttataggcccatttttttcaacagctgtcaactctgccaccctctagcaaagaatacaagttaaattaatggattgactccattggttcttctgtcttcctggagttcatcgcagtctacatctgcactgttattttagaagcagactcattttgccacagttagcatctttttacccatttttgaacaacttacctgagtatgttttcccttagtaatgaatctgcttcacaagtaaccttcaag

SEQ ID NO: 50926 - DNA, 1063 bp, Homo sapiens
ttgcattctatcaatatgtctatcaactttcttcattccaccaactttcttcatttaaggtaaaaacaagaaaaaatgtagttgtcaaaacatgaataaattatttacctttgaaagtttaattgtttattagaatcttctggaaacaaatgttactttagctggtttctttttctaagcccattttaggtcactaagtagacaatatgggtaatctttattagcagagttgttcaagtcatccacattgttgaccactcatcttctgttttgcttgggcaatgccaaaactgagtctgtaaattaccttataatttcaggcacagaatcagaaggaaaaaaataaccttaggtttgccagttaaactttatccattttcacttttctgggtgttttaaggggaaaaaaaataataccttacccaggtaaaatttagcctatctttctaaagaggactctgtaggaaaaacagggaaaccaatcaaattaggttgtaagaaaggaagttaagcattggtcagaggcaaatgggactgaaatgtggtatcaccaaatgttttcccattgttatttttgattaagtttttatcctgcaactgcttaagagcagtcagtcccttcatagtgtatctgtacagttgcataggggagataattacttcaagatagattggtgattggcaatggaccctggacataactctttgaccaatggattttgaacaaatgtaggatagtgaattaatgattagagataagtcttattttaacgagaagcatattttaaagctattttatttaaaatagtcaattttcccattaacaaaataatttcaaattgatatgtagagaaatagtagttggcacgtaataatagactattcctatctctgactctgcttttacttcagaaaataatgtcttcaaaactaacatatcatttcggcttcgaattctcaagttttctttttaaatgtcttacatttgagagattatttactttttttttttttttggtttctgcatttctcttttttctactgcaattttccaccttttgtg

SEQ ID NO: 50927 - DNA, 1023 bp, Homo sapiens
actcccgtctgttgtgtttgagctttcacgacacctttgaaagttttgtagtttgtctacccttcctagctaccccttccctctcctacttcttttcagcttatctgcccccaccagctaggtctccttttgccatcatcttcctggctgccattgcctgaggacttggggcttgggcctcctagatattaccattacttcattccttgcccattccccagtactgagatatctgcagccctacacctactagctacttagcctgatcacacctccagcctgtacgccagtttagaggccttagggcagagctcagctttctcacccttgttctttgaaaaacctgggttctgtttagttcccctcttctctggatccctggcccaagctagatcctttcataggtatcattgtgtactagttatcagatactatagcgtattgcctggtgcaattcgtaaccgtcgtgaaatcttttgtgttgtatcttttcagcttgccttggatacccgattctggacgtggataaatcactttgtgatttggggttctttagccttctatgtatttttctcattcttctggggaggaattatttggtaagcaattgtacatgtgtgagcaatatgtaaatagcaaagtagatacatgtgtatgtacactatatatgtaagcattcattatactttaaaaattttaattatataagatgacacgtctttaatattaatggcctgaaggttatttgttagctggtagtgctactaatttcaggtaagattttaaatacacatatatagactgcacaagtcactcagaagacctccctttggtagcttctgtctgtttgaaggtgttgtaaacatctctctagtgaaactatagttttcagcacaacctctcgtgattttcagaggaaatactcatcctgtgaagtttctacctgatatattgaccaacagatacattattgtccatttggacccttattttctcttgatagtatataaccatgattcatgt

SEQ ID NO: 50928 - DNA, 1927 bp, Homo sapiens
ggcccactttagttatctaggatgatctctcttacttgaaatcaactgcttgtggactttcatcacatccacaaaatacctttacagcatcacttagacaattgtttgattaaataactgggaaatgtggcctcaccaagttgaccttttagaacttgtagtcatctattatgtgcaacttgggtctcaaagatacgattgcaaatcactgttgtgccattattagaggcagttgcttctttagagtgaacaggttgaggaaccagattgatgactccccttatctgagaccaccccctttgttgtttaaaaaaaaaatctggatcctaaacagaaatctgtaataaatccaaacatagcattgtttctctttttcagagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccaggtaactgtgaatattagttaacgttccattctggatacttctatacatatatgtgcaaatgtttatttttttaaaaaattatttcttcttcaaagggccattattactatctaatttcttcctccaaggcttctttctttttgtaatcagactcagaagtctttccccattttgaattaaacttatgctgcaccttgttgtcccctcaatctggctgtcccagttcctcaccttccagacttttttctctgatgagtgctttgtgcctgctgccactgctcctagatcccttatgacattagctctgtgtgttctttctgctcttcttactcccttggcttgcctgcaggtagacctggcccatcccttgtgtagtcttccattctctttctcatttctcctttgctcttgacaccatcagttatatcctccttaaaattatgctttcatggtctctgtgacggtccatggtcctgacattttatttgtcaatgtagtgactttttattttgtgccatcctctattttctccctaattatctgttttttctagggcaaagttttctctccacttttagctttatggtctctctctggataagcaagtctatttctctgactcccattgataaatgtgtgcccctgactttttcttgacattaagtcttctatttctacctgtgtgctagacagctatatatggattccctaccgtcacaaaaattctggtgtccaacacagatcttaaaattttcttcctcagaccagtttggtttttcttttatattgttcttgttaccagtgccacttttctcttgctccctatgtctcaaaactacctttgatccttctcctctccctctatatatagtcgccatgtcctgttggtcctaccttttgtcatagctctcattttgatgccatctttcaaaaccttttactgcccaactagtccaagcctttatgactttacacacagactatttgatttagtctcctcactggtctccttgctttcacccacccatttttaatctctccacactcccaaattaatcttgttaaaacacaactcttcctatcatacattctttttcggacactttcagtagtttcttagtcccttaggatgaagggcagttgagtgaatgtggcgcctggggctccccactgttgtcccttaacatgtctctacaaattttgtactttgtgtccactatcactcctttctctggtgtacattctgcactcctgttggttgttcttccatggtcttccatatgtcatgctcagggcaactttcaaaacttttgtcacatcatttcctcatctggcactctctctgaattcccctggcctaacacaaattttact

SEQ ID NO: 50929 - DNA, 1072 bp, Homo sapiens
cagttttcactcaggtcttttgaatatttactaagctatccatatatttatgcacatattatcaaatagtcttgacatgtttagggaagggtactacagccattgtttgagctggtgcctagacaaaggggtaagattttcagagataggtgagctgaaaggaaatttaaggtagagtgaacaacatgagagcttaatctaacctggttcaacagaccagagtatgtttttgcatgctttattttattttatttttatttttatttatttatttatttttgagacagagtcttgctctgtcgcccaggctggagtgcagtggcacaatctcggctcactgcaacctctgccttctgggttcaagtgattctcacacctcagccaccggggtagctagctggaattacaggcatatgccaccacacccagctaatttgcatatttttagtagaggcggggtttcgccatgttggccaggctggtcttgaactgctggcctcaaataagcttctgtcttgacctccgaaagtgttgggattacaggcatgagccgccgtgcctggcctgcatactttaaaataatatgcttttaacttacaggctgacctttttcagacttgattgcaggacactgccattgatctgcttgaaataataagttttaaattcttaatatttttagaattttctaaatattatatatgaaaattatgagaattaaaaagttacaaacatatgtttagtcacgttaaaaggtattgaaactctaatgaaattcctttagtctaatttcattgttattctgtggccaaaagaaacccagaggaaagtatcgtttttctcttgtcgtctttaagaattataattaaattcacattcaggatgattggcgttcctctttttttggagggtgggtcggggttatacattcaggtagtacatgtgcaggttcgttatgtggttatattgtgtaatgctggggtttgggcttccattgatcccatcacctaagatattaacataatactcaatgggtggtttttcaaccctcactcccctcccgtcttccccc

SEQ ID NO: 50930 - DNA, 1043 bp, Homo sapiens
tttgtatttctagtagagacggggtttcaccatgttggccaggctggtcttgaactcctgagctcaagcaatcctcctgcctcagcctcccaaagtgctgggactacaggcataagccaccgtgcctggccaatagtcacatttttttctattcatcttttacatttgagtagatctaccttagacatgtgatagcattttggtgtctttaaaaatactcatttattcctcatttctttggtaatattgtctctgtaattccctgacatttgacaagaagtcttagaaggggtgatttcctatggatatgaaaatagctttgcgttacagcaaactaaaaattagtcacactgaagaaactaacaatatatgtttgtgtccttgttttaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataaggtgcatttgcattattgttttatataagaaaccaatctgtgtatgcatgttaacattccatagtagaaaataatttttaggtggacacatgacatagacttttgtgtttttgttttttttttttgagatggagtctcactctgttgcccaggctggagtacggtggcatgatctcagctcactgcaacctccgcttcccaggttcaagcgattctcctgcctcagcctcccgagtagctgggattacaggcgcctgccaccatgcctggctaatttttttgtatttttagtagaaacggagtttcaccatgttggtcaggctggtctcaaactcctgacctcaggtaatccaccaccctccgtcccccaaagtgctgggattacaggcatgagccactgtgcccagtgactttagaataactattgttggattcacctttcttgttttactgacacttctgaaatttgtaaatgagtagaatttacaagta

SEQ ID NO: 50931 - DNA, 1071 bp, Homo sapiens
gcatagtggtgggcgcctgtaattccagctactcgggaggctgaggcaatagaattgcttgagcccgggagatggaggttgcagtgagccaagatcacgccactgcactccagcctaggtgacagggtgagtctccatctcaaaaaaaaaaaaaaaaaaaaaaaaaaaaaaagatagggtgtagtttggaaaatgtttgctttataagtaagttataaagcaacattttatgtacatataacaaattataactcatttataattgcaagtgacttaaagtaaatttggccaaatgggggtaacttatttccctcatacactttctggcacagtcggttttcttggccatggtccagagctccacagggcatgaagatgtatcctctctatgctgcctttaaggagggttactcatgtggctcacctctgggtatgtccttggagggctcctctgtttgtttattccatctggagttgaggactacgactcagtatgtaaaaaagaacctttacctgttggatgactaattctgtatttcaaaagcatggtaatgacctgcttttaaccttttcaaaaacaaagttataatttagggaatgtcaagatataaatcaagaaatctacataaagatttcctgatagtgaaaaagttgtttggagtaagaaaactttcagatagtttcttttttcagttaagttgttctgatcaaatcagctaaaagtacagaggttttcaaaatcaggagatagttttaaatatagttcagacattgccgtaatatttcccccaagatgacgacaacagctttcccttctgcctaagtggtgcgctctttgagtctgctttaacccttgtttgatgatttataagtgggttcattggcgcctgccttgagttctggatgaatcaagtgcataatatacactagtagaatattctaattatctgactaatgcaagacacgtcatctccctgccccttgtacaaaatgtatccatattgaacattttcaagatcattaattaagctatttgtgtaatggaactattaatgatttttttcttgctgt

SEQ ID NO: 50932 - DNA, 1046 bp, Homo sapiens
atggtaaaaatacaccattttaaagtgtataatttagtgtcatttagtactttataatgttgtgcaaccgttaactctatctagttccagaacattttcatcacccgaaaaggaaaccctatacccataagcagtcactccacatttctccctcctcccaggccctggcaatactaaccttctttctgtccctatggatgtatgtattctgaatgtttcatatttcttatgtgtcctttttgtctagcttctttcactcagaatgtttttgaggttcatctgcattatagtatatagcagcatttcattccttttgatagctgaataacatttcattttatttattcaccagctgatggacatttgggttgtttctaccttttgggtattatgaattgctatgaacattgaattacagtttttgtttgaacatctgtttttaattctttgaggtatatacctaggaggaaaattgctgggtcatattgtaattacgtgtttaactttttaatgaaccactaaactattttccatagtgcctgtaccattttacattcccatcagcaacataagagacttccaaggtagtagtatttttttttttgacaatctcaggcaattgtttattccagttaatcattgtttattatttacccagtaagaccctgtcaaataacatttttgacttgtccatgtcaaacactaattttttggttctcattagattttttaaattaaaaaattatatttttagagcagttttaggttcacaggaaaattgagtagaaaatatagagagtacccataaacccactgtccccaaacacattttctctggctgtcaacatcccacaccagaatggtacatttgttacaatcagtgaacctattttggcacactatcacccaaagtccatagattatattaggggtcactcttggtgtacattctgtgggttttgttaaatataggatacatatccacatagcctacatttgtatatatgtacatatgtatccatagtagtgtcataccaggatagttt

SEQ ID NO: 50933 - DNA, 1040 bp, Homo sapiens
gtgtgttggcgtatgcctgtaattccagctactcgggacgctgaggcaggagaatcgcttgaacctgggaggcggaggttgcagtgagctgagatcacaccactgcactctagcttgggtgacagagtgagactctgtctcaaaaaaaacaaacaaacaaacaaacaaacaaaaaaaacccaaaaaacaaaaaccacacacaacaaaaattagccaggtgtggtggtgtgtgcctgtagtcccagctactcaggaggctgaggcgggcggattgcttgagcctgggaggcagaggctgcagtgagctgggaacgcgctaccgcactccagcctgggtgacagtgtgagactctgtttcaataaataaataaatactatttactgacgtctccaagcaagaactaacttgtaacaaaaactgaattctcatcattgtgtctaaaaaactgctatacacattttcttcttgtgattaacttttttttttgccatagaggtcatgcttgagataacattgtttttgatttgtagcaactgaccaagctggagaatctactttttagataaacaagttaatttgaataacttgatgtatatggctgtaactcaatttcacttttagttagaaaactctaaaaagtagacttttcttggtctgcattaaaatcttacatttgtattatactaaaaaagatgtgctagaaactaagtttaccttttagttaaaccagtagagtaaatggctagggcacaagttttaataaagatttcttgtatatcttctgtgtgctaaactattgttctaggcacctgtgataaggggacttaggacatgctccatgatctcttaagagctcatgacttgatgaaggagagaagagggcagtcatttcctatgaagggaataatcagaattcctccaggaagcagttcatttaataaaacagtggtcaactaacagttgggacttaaaaacgacaacagcaaaagtattcccttttgatgtgtttatatcacctttcacagatgactctgtaatg

SEQ ID NO: 50934 - DNA, 1126 bp, Homo sapiens
gaataaagacagtagttgataaagatgaatacagtaaaaattaaagtgttgttgcctttaagagtattttatgtataaacttgattgatgtaaacttaattgttcaatgtttaaaagctctaattaatgtagtttatacttagtatgaagcacatcaaggtctccatttcctctactcactggaataattgaactatatattcagacttctctcactgcttcactccctacatatattcccctttacttttctctcaaaaatccctgacttctcctgataaaaataaattgctttaaacatttattgttaataaatgcattaatgaaaaagcagaaacatttgtggtggtttctctagttttttaaagcaaatctctgtaggggttcctaatttagttctgttccacgttgccctctggtcactaaatcaaacacagagccactgctgcttagggagctggcattctagtaaggcaagctagtgctagggcactagctggaagcctgttttgagctgactggaggctatgaaccccctaaagaaagagacagggtcccttgggcctgaggcttatcggtgatgggaggaaatgttgggtccagcccctggggaggtgaggtgcactagagaaactgagaggcaaacaagtgtgtccaccaggacctaatgttgctcacaaccccttaaccacttaatcatctgtcattcttttaagtaaatacctgcttatgctcattttatcgttttgaacattccatcttcagggtgctaacttgacaaatttttggtaaatctgtgcaatattagataaccacaggaacctttttattcaactcccacactttatgaatgggaaaacagactcagagagggggaactgagatagagttggctttctggtaagataagcttcctaatttagcatggggattatgcttatcactgtgtctagctcattccatgttctttaaatatttgtttcaataaaatgggataggcctttggattaggggatctcacaaatacacaggcccctacacacacacagattattgatttgatttggaaagaatgataggagaaggtgaatgtctgaggccaaccatttgcaattctaaatctgtg

SEQ ID NO: 50935 - DNA, 1184 bp, Homo sapiens
ccaccgcgcccagccaagcactttcttttcatttgtgccatatatattgttgaaaattggcatttatatacccttctggctttaaacaattggttccattttccatgtaactagacacaaatgcattatgcaaaattgtgtttgtaaggagagatcatccttcattccgtttcataaaggttttctcttttttactgtttacgtgagggttgaatatgtctgccttctggtaacacattaaggttgcaatatttgtctagttgtaggaatacttagctcttttttgtttgaatttgacataacacatgggtaaatctaatcctgatggaaagttccatttaatttttttataacaacttttaattgacacataatgtatttatggggtatagagtgatatttcaatacatgtatacaatgtgtaatgatcaaatcagggtgattagcatatccatcaccttaaacatttatcatttctttgtgttgagaatattcaacattttctcttggctatttgaaaatatggaataaattattaattgtagtcaccctacagtgctatagaacactgtaacttattcctcctgtctagcagtaattttgaatccaagagccatccctcctgcctatccttcccagcctgtagttgccgctattctgctctctacttctatgagatcagcttatttagaaagctccctttttaaacacataaaaatatttttgtagtgtaaaaccaatatatgtacactgtaaaaaaaagtttgtcttaatcagcttaacatatgtttgaatttaaaaaaaatgtaattatcttaaagtttcagtttctaaaatcaaagtaaagtactaataccagtgcttcctcatgtatactcggttgagtttcttttgggggtgatgaaagtgttttagagttagattgtggtgatggttgcacaatgctgtgaatatgttaaaaaccatggtattattaaatgagtgaattttcatttagtatgtgatttattaataaagctgttttatgaaaagggtactcatatcactatgaatcagctctatcacttagtagctggctgtgtaataaccttggattaagttgctttcatttttttgtgccttggcttcctcatctgtacaatggggataataatatcttttttgttggttggttgtgaggacta

SEQ ID NO: 50936 - DNA, 1030 bp, Homo sapiens
gtgtcatcaattgtttaaatttgaatcaagcatcagtaatggcataccatttgggctgctttgtggccctgatgaatgctattttattttatttattttttattttattttaattttgaggcagagtctccctctgtcatccaggctggagtgcagtggcccagtctcggctcactgcaacctcctccccctgggttcaagtgattctccttccttagcctcccaagtagctgggactacaggtgcgtgccaccacacccagctgatttttgtatttttagtagagattgggtttcgccatgttggccaggctggtctcgaactcctgacctcaagtgatctgcccacctgggcttcccaaagttctgggattacaggtgtgagccaccacacctggcctgtgaatgctattttaatatagttctcaggaatgattaaaaacaaatgtgtttttctaagtggtagaattaatagataaaatcactttgaaattaaagtcctcaggtaacatagaattcttttccctgaacaagtcattatgtagcacatggtataattttggcagacccaactttattaccaacaaaactgtaaagcgagtcctatgtcctgtttgtcttttcttctcgggggtttctgttcttactagaacaaatcaaagtacagtgtgtgttgctggtcttcaagaattattagtttttgttgtaactgtttaatgcagaaacagatgctagagcagttattccccaaggcaccatgtgcctaaggcatttttaaagcactagtatgttttcagtgtgatactgctactctggaagaactgtatacatagtggttcacttttccagtgtggttagaactgacatttctaagatataaagaaatttaaggccaatttggatttgtactctggctctgcttcctgcttaggtggaagactttgagtgatttagttatgctctctgcctctattttctcctcttcaaagtggggatgatgaaacctactttataactttgctgtgaggatt

SEQ ID NO: 50937 - DNA, 1048 bp, Homo sapiens
tattgagtgctttttatattccagtccctatgatgtgcactgtacaggtattatctcacagaactggtagaaaaacctgattgtgccaggcgcggtggctcacgcctgtaatcctagcactttgggagtccgaggtgggtggattacctgaggtcaggagttcgagaccagtctggccaacatggtgaaaccctgtctctgctaaaaatacaaaaaaaaaaaaaaaaaaaaaattagccaggcatggtggcacacgtctgtaatcccaggtactcgggaggctgaggcaggagaattgcttgagcctgggagacggaggttgcagtgagccgagatcgtgccattgcactccagcctgggtgacagagcgagactctgtttaaaaaaaaaaaaaaaacctggttgttttctatattctgtaaataaggaaactgaggtgcagggagataataaatgagttgcccaaattacatagctgcttaggagtagagctggaagtttatccaaacaacctacttgaacctgtactcagtttttgttcttaattggtctcgggtgcatggagttgttggctgcactttaactgctacactgcactgtctttggagccaatcaacttttttttttaatgtttcagaaacaagccaatttacttaaaattttttttttttaaattgtagtaacatacatgtaacgaaatttaccatcttaaccttttttttttttttttttttttgagttggagtctcgctctgttacccagcctggagtgcagtggtgagatcttggctcgctgcagcctctgcctcccaggttcaagcaattctctgcctcagcctcttaagtagctgctattacaggcacccaccaccactcctggctaatttttgtatttttagtagagacctgtttttgccatgttggccaggctggtctccaactcctggcctcaaatgatccgcctgcctcagcctcccaaagtgctgggattacaggcgtgaacccccatgcctggcccatcttaaccatgtttaagtgtactgttctg

SEQ ID NO: 50938 - DNA, 1052 bp, Homo sapiens
cttcaagatactgattttatttcctttctctccggccctcacaggttttctcaggcctacatttatagtctcctgttttgttttgttttgtttttgacatgaggtcttgctctgttaccaggctgaagtacagtggtactatcgtggctcactgtagcctcaaactccccaggctgagcctcctcccagctcagcctcctgagtagctgggactacaagtgtacgctaccatgcctggttactttttgtatttttttgtaggacagagtcttgatatgttgcccaggcttagtctcctttctatgattccccctcccctccccctagtctctgtccgtaccacgctatttataggctgctagatacctcaggtacctcttggtgtttgccagatgcctctaggtattggctcctgttgttccctttctgaagctgccgctcttccattcactggtgaaatcctagacccaactcaaatgtcatttcttctgtggtatgctgccctggatcttccttctctgacgtacctggggtagaacgaattcttcccgtccctgtgttctgtgtccattatagcattttacacttgcttctattgttagcatttttcagtctttggtacctaacagattttttgtaggtgctcaataaatgttctttgaatgaatgaatctatgtaatccatagttaaaggtctttcagggtgtcagattttcttcagaatcaacaaaaatatcttgttttgattttcacacaaagttaaaaacatattaattttattttctgtccgtaactattattgccaatatttggctttactaactttgtgtgataaatatttgctattttggccacattattggtaaaatagacctttgtgggcttttctggctacctgcacaccatttttattatttcaagggtaacaataattattgagtacaacagtgtgccagacattgtgctaagctttgtctgtgcattatttgctgactcatcaccctaatcctttattattttcattttacgtgtcagaaagtaaaacttagaga

SEQ ID NO: 50939 - DNA, 1054 bp, Homo sapiens
cagccttgacttccccgttcaagagatcctcccacctcagcctcctgagtagctgggactacagtcacgtgccaccacgcctggctaaatgtccctggcttctaacatgcacttaaagcacttctcagaaagactgtcccagtagaaaaggtgcacagaaagtaaacaattcactttttcttttttcttttttttttttttgagacagagtcttactctgttgcccaggctggaatgcagtggcgccatctcagctcactgcaacctcctcctcccaggttcaagtaattctcatgcctcagcttcctgagtagctgggattataggtgtgtgccaccatacccagctaatttttgtaatttgagtagagacagggttttgtcatgttttgaactcctggcctcaagctgtccgcccgcctcggcttcccaaagtgctgggattacaggtgtgagcctctgcgctcggcccaattcacttttcactgaagttgacctttagtatattgttagtagttttggattctagtttgagttatcactagaaaaaatagtgaacaatattttattattttttattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgagtagctgggaccacaggcatgcaccaccatgcccagctaatttttgtattttaggagagacgtgatgtcaccattttgcccaggctggtcttgaactcctgagctcaagccatctgcccacctcggccttccaaagtgctgggatttcaggcgtgagccaccacacctggttcagtttcccttattattaacatcttacattagaatggtacatttgccataattaataagccaatattaatatattattattattgggaggctgactgggccttgaggtcaggagttcgagaatagcct

SEQ ID NO: 50940 - DNA, 1050 bp, Homo sapiens
cccaaacccaggggtttgcaccattgttcaattctttcatcactgttagaaaaactgcatgtaattcagcccactgagtggatctgtttttaccttctttgatctaagtagcagccttccaaacaggatggtgtccattcactttggaactgtctggcttcttttaagggcactaactcctccaggcttcactgccatgatctaatcacctctcaaaggccctaccttctaataccatattgaaggttaggatttcaatattaagaacttggggttggagggggaacccaaacattcataacacttggtaagtaaaatataaagtccagtttacacctccttacctatttacaaaattaagtgcattgtttcttaccaacactgggtaatgaacttctttttgccccctccccattttatcagttgatgtcttcagatgttacccggaatgtaaacaagctctgcttgaccaactgaactgtaaacaagtctactcaaacctgaactttaaaaaataagggttctccaacttctgcctcctgaattcctgacttttatatactgccatataagtccaggattctatagtaactgttggagggttttaatttttttcaaaaatgtttattgtaaaaggacaaaacttttttttccctctaaagcttagatggtagtttctgattttgtatctaaagctttgtgaagcattagcaattttttttttttttttttttttttgagacggagtctcgctctgttgccaggctggagtgcagtggcaagatcatggctcactgtaacctccacctcccgggatcaggtgattctcctgcctcagcctcccaagtagctgggactacaggcgcatgccaccacaccccgctaatttttgtattttttgtagagacggggtttcatcatgttggccaggatggtctcgatctctcgacttcgtgatccacctgccttggcctcccaaagtgctgggattacaggcatgagccaccgcgcccggccagcattagcaatttttgaatgtgcatatccttg

SEQ ID NO: 50941 - DNA, 1066 bp, Homo sapiens
ttcagcccttggcaaccacccatctactttcttatctctggattgccagtggaatcatacaatatgtgttcctttgtgactgaattctttggtgtagcatagtaatattttcaagatttgttcatgttgtagcatgtatcagtatcagtacttaattcttttttttttttttttgaggtggagtctgtcacccaggctggagtgcagtggtatgatctcggctcactgcaacctgtgcctcctgggttcaagcgattctcatgcctcagcctccaaagtagcttggactacaggcacgcaccaccacactcgactaatttttgtatttttagtagagacggggttttgctatgttggctaggctggtcttgaactgacctcaggtcatccgcccggctcggcctcccaaagtgctgggattataggcgtgagccaccgcgcccggactcattccttttgaaggcagagaatactccgttttatggagagagcacattttatttatctgttcatcagctgatggacatttgggttgttcgcactttttgactcttgtgaaaaatgtttcttcgaacatttttgtcctttcttttttatttttttattgagacagagtctcactctgttgcccaggctggagtgcagtggcgccatcatggcacattgcagcctccgcctcccaggttcaagcaattctcctgcctcagcctcctgagtagctgggacaacaggcgtgcaccaccacacccggctatttttgtatttttagtagatatggggtttcaccatattggccaggcttgtctcgaactcttggccttaggtcatccgcccaccttggcctcccaaagtgccggaattacaggtgtgagccactgtgcctggcacatttttttgctttttaaaatgaatatgtttttacttgagtatatattagtggaattgctgggtcatatggtaattgtatgtttaaacttttcaggaactaccaaactgctttcttcagttcttcctcacttaaataagtagtttgtgtgtgtgtgtgtgtgtgtgtgtgtgtgtgtgt

SEQ ID NO: 50942 - DNA, 1097 bp, Homo sapiens
actctaatttttataccttattatcaaaattgcactgcccacaggccaaatatggtcctccaggtgttttgtcaataaagtttattgtaacacagccatgcccattcatttacacagtgtctatggctgcttttatgctacagcaacagagttgagtggttacagcagagactatctgtcccacaaagcctaaaatatttgctatctggccttttacagaaaacttttactgacccctgccttaggctctgattacctgacaattgaaaaaaatctggaaagattaaaatattaaatcgtgtttataaacaaaatatagtaaggtcttctctatgttggtttgtctgtcaaccaaagccttcaacttttaagcaataatttgttttcatttttgcttcaaatctttataaaatttagccagattgtcctctctccattctaagatgtattacacattaagcagaagatactgagcataatttaataatgtgacataacagaatgagcatgggctgtggagtcaagagatctgacagaatgcgtgctaatcccattaacaaataacccaatgggcattcagatgaagacataggagcttcaagaactgtcaaatatttcctttttgtatttctctgttttgaacaaatactgtgtctccaagaacttgtcagctctgggtcgtctctgttaatggaaaaattgaggtcacatcctccatttggtggcaatttgctcacctaacctgctgacctttttcatgttctccatgttcactggcactgttttaatctagatcaaacttcctgtctcctaataaaagccaatcaacatcaaaaccagactgttgcccctgccctgagcaataggatgccagaaaccgaagttgctgaggacattacaaagaactaaatagtgattatacactgacagcagaatttttaccgatttacttaactatctgtagtaatgactctctttacatcaatgaaacatctagagtgtggctgtgtactgtaggaactggaagggttgagagatagaggtttgcctcattgagcttttgcaaacaatgataaatgagatctttcacatcagcc

SEQ ID NO: 50943 - DNA, 1048 bp, Homo sapiens
atccacagagctgaaaacaggtattcaatcaaaggttgtacattactgttcatagcagcactattcacagtaaccagaaagtggaagcaattcagatgtctattgacagaagaacagacaaaatgtggtccgtccatgcaatggaatattattcagtcttaaaaaggaaggaaactgacacatgctacatcatggatgagccttgaggacattatgctaagtgaaaaaagtcagtcacaaaaggacaaatactgtataatcccactcctatgaggtatctagagtagtccagttcatagacatagaaagtagaatggtggtttccagttgctgggtgaggatggagaaaggggagttgttacttaatggggacagagtttcagttgtgtaaattaagaggagttctggagatagatggtggtaatgatggcacaacagtataagtgtacttaattccactgaactgtatactaaaaagtggttacgatggtaaatgtcatggtgtgtgtatttgatcgtaataaaatgcaaagataactctaatgcagacatccagaagggagtaatgtgtggggtgatcctgtgggagtcagaatatcctgttcctcaacagactcttttacctagtggttgtagccttaattgatgatccttgtctgagtcagttattaaatcggtggttccaaaattcaggttgttttaaaaagcgccaacagcctcgtggggccctaattttgcatcctgctatttgattggatgagtaattaatgcagggtgaggtgccgaggtggtgtttctaaacgtctgttgctaaagataaatgttgtaaattaaaaaaagaaaacatatggagcccagacaggttcctttactgctcctgcctggccatggcaggcttttataatgtaacccattctgctctgtcgcttcctgtttcaggcaggcaatccatggaccttgtggaacttgtgtctctttttcccacgctggctggacttgcaggactgcaggttccacctcgctgccccgttccttcatttcacgttga

SEQ ID NO: 50944 - DNA, 1098 bp, Homo sapiens
atgcgcacttttggtagggactcagccttctttgtggggggcacattttccattttgacagctcatcaatctagtgaaccactagatctgtaaaatctaccaggtgattctactctgccctccccagcagtgaagggcaagtttactttgacttccatgtgccagtccttcaaagctttgaaaacagcactgatgcccccgaccctgtccatccaccaatatcttctcttctctaggctgaaatccccagcccttcaaccattcgtcacaaggtagtgtttagacgcgtggttgtcctggtctctgtcttccaaaaagtttcagtttgagaaagcacttccagaataccagttggaccagatacccctcctggatgtgtgggcaacctgtatgggttcttgtgagttctatcctgacttgatctgcccagtgcatttcagggacaggttgtacactgtctctgaaatgacgtatgacgtttgctctttttggagtgcctcttctatgaactatgctaaaccagattgccccctttctggacttaagcatttaatccatccttaacatctaaatcttgtactgtatattgattcctgtttaaatttgtcttggttctggaccatcattcgggcctttctggatctttctgagcttgctttatactacccaattttattttttgcactttgatttttgtgcactgcatgtcctgtcttctttcatgtcattgatagaaaggttaaacagtttcaaggcatgattttagccctttgtttgctgggaaagatcttctgattggttgagaatcttttctgaaacttttgttgggaagtgttcagcaatttagaaattgatgtaactgcacggcctttcagtttatttccaaattttatctctagctgtgtcttttccctgaacttcagacttttgtttccaatagtctttcccacttagccagcctaacatatccaaagctggacttcacatctttcatcttcagcttttccttcaacactcttcttgtcctcaagaaatgagaatagtcactcatgccaaaaaatcatggaataatctcaacccctgttcttctcttactcc

SEQ ID NO: 50945 - DNA, 1030 bp, Homo sapiens
caagccatacagttgttggaaaagatgaaaacgtcagccagtcctttcttcctggccgttgggtatcataagccacacatccccttcagataccccaaggtgaagagctggttgagggctgatccagcacagctgtgacagctgtgttgtttgttgagggagggatttgcacagggaaggtggctacatcctgccatcgccaggcaccatggttgcctgatgggcactagtgtcctcagtggagtaaagatgggatttagaggtcaaggccaagaacatgtaagaatcttgtaagaaatgcttggctttccgcttcactccactggagggtttgatttcctttccttgaacttattgagcagatgttgggttggatggtgagatcaccacagagtagtgaatcagagctggctgccaaagcctgtaataagggatggcccttccaaaacagccccagggaatgtgaaactctcttcaaaaactgcctgttccccctgagcctgtcaggttagatcatctaaacacaaagcactgcattgcttcttggaacctcaaatcctgtacttgcttgtatgtcatttagagcatgtagtcttttctgttttagaatccttttccatttttccctatcatgttttatgagggcctgagcatcccatccttttgactttgcagagaatgcccctcacatgtaatgagagtagagaccagcagtatgctctttgatgttgcaggtatcttgctttgattggcccaggggatcttgctttcctagtaggagctgtcagcccccttgatagaagaaggctgtgaggttcacctctcctgcctctttgcagaaaacagttaacaaagctggcctggctgtgattctttgaaaggcctgcttataagtctagcccttggctggcatctgggaactttgatttctgaagtgttctcactattcccagaattggcttactatgcttaaaccgtttagacaaacattatggttgatgataaacccttgggtttgtttttttttttc

SEQ ID NO: 50946 - DNA, 1033 bp, Homo sapiens
ccccaagtttcctgcctcctagtgtatgtgaccccttgtgtatgggtagaatgtactacaatcagcctccttatccatgtgttccacatctgtggattcaaccacctgttgaatttgaaaaagatgggtggttgtctctgcagtgaacatgtacagacttttttcccttgtcattatttcataaataatgcagtataataactatttacatggcacttacattgtattagggattataagtaatctagaggtaatgtaaagtatacgggaggatgtgtatgtatgttatatgtaaacactgcaccatcttatataaaggacttgagcacctgtggattgtgctatccacaatcccgagctttaagtgagaatgtagtccttcactgcagccttttgagaccctgaacctaagacccagcttagctgtgcctggatttctgacccacagaaagtaggaggtgacaaatgagtagtgtttacagccactaagcttgtggtcatttgttacatagcattgattggcccttatccctcattcactgaagactcaggtaccaggctcacaggtgaccttggtaccctgtgtcctgtcatcattctgggggactgcagtgtattcatcagcagcctgtgccactcacagacccttgacttcttcctcatctctaacctctagcaatctcttcccccccacctcagcctcccagcttcaaggccacatccttgacctttaaatcaccaggatctgttttacctcagaaatcttaaatttcagggtctcattctgggactaaaaccagtactctcacacccttgctgcctctctatatcctcacccatctcctagatctttgtttgtccccagtccaccagtcttcttaaccactgtcagccacctgaactgctctcttactggctctctccacttgctcccactcttgtccttctgctgctatgagccccagcaaaacctcgagcttacaccagagcaaacaaacaacaaaaacaaacacacacaattgtgccaagtggc

SEQ ID NO: 50947 - DNA, 1133 bp, Homo sapiens
atctatactctccagagttcagattgagagcagagttctagcacgttgcctcacgcaccttgagatagtctcttctgggaacagtgccctccgtgcccagcgcatttgggtaacattcacagcccacgttagactcctccttggaacaccatttcacgtgcctacagagcccagggccctccctatgactctgcaggggagagagccctcactggcattgggctgaggacagcctgggacactccctttcctcatccaggtagttctcatcatggttctcatcccgagcccttgaaaccccacgaaggtactagcccctgggatacagtagtaaatggacagggcagagcctgcccttgaggggtgcccatccaaggatccctggatctggaatgagagacaaatcttgaattctcccctgaatcctcatcctaccattgtgtgggactatataccaatttgccagtgtgcattgtcccctcctcctggagttaggctcaaaggcgggggtagggtagaagtccaagagcaaggggactccctttgctgtatggtaccctagaaggtccagagtcctagaactcctctcacaccaaatccacatatcttagctgcagaagtgtctggagcagtcccctgagcttcctgtgacactaaagtggcatgggaaagcagttgaattttcccgtgcctccaaggaggtaagagagggagggagagagaaagagggaaagagaaagagggagagagggagagggagagggggagagagagagcgagagggagagcacgtctccaaaaaatgtcacatagaaaatggcatggactgtgcagctaggaaccaggttagaatgacgacaccacattggaagacagcatgaaggtatgccatctctgagcgctggatgggattgtacattgggagtggatgctggcatggacaggttgccattgacaacaagcagattctcttctctcttgctctctctctccgaatttaagagtctcacagaatttaggtgataggctggggcaaaggagacaatcctaaattgcttgataacaataattggtaattagtaagacaatcccgaagtaactgggaaaatgtggaattgactagattaaatttt

SEQ ID NO: 50948 - DNA, 1341 bp, Homo sapiens
ccagagaaggttcgtggctggagcagacgcattcgtagagtgaagtcatgggagaagaggctgggaaactagattggttccaactcctaaaggaccactgaaggagtgtgggctgcacgctgggtgcagcaggtgagtttcctcacttgggtttcactgtcagcatttttaaaaggcaaactggttctcttcctgagaagaattcattgattcactcgtggccagtaagtcatctgacaaacccttgtgtacttctgatgggataggagtgtttgtagacaacaggcacacaaatataacatgcagcccagtgcagctcaggagcagccttccatggataagcggttggtacctacagtgtgctcctgtccttgctaatctgaacacataggtagtaaccttaagcatgtctcaatcttctgacttgtgatgaggtttccaattcttgttcctgactttagaatgaagtttggagagttgtcattaggtctctaggttctgaggattactgtggggtaggcagagggagagaagagtgttggggccagatgttcctgtgcttctaccagaaagttgatttgcccagtgtaccaccctcacttggcaggcctgagcagagtggcctgccactgacaacccagagaaagaaggtacagtgcaggcttgccctggtgggctcttggatgccctaagctgcagcatccagggccaggtgggatttggtaggataggccccccgtctactgtgtctgatcatactgcctttgaaagagaagggtgggtggtgaagacaagacgatgagacagggtggcctctgcatgttgtagcacccaactggaacatttgcagatgatacttggaaaaagctttaggaaagaggcccacttcatttatgaaatgacaccagctaatgtttgaccttagtcatatgttccttggttcctcattttgccatctgctggctgactcatacagcttcacttttaattaaaggtgggctgtgatgagagtcatgatcagtgagtggcttccatggcagaaagttctgtgtagttcttgggggatgtgagtgtaagtttgaggtgctaagacgaatatgtccatacattgtaaactatttcctctgtcctttccctcctctaaccattcctgccttcttcatctttctaactttcccaaggcattttacatcagatttcagatatagaacaatggatgttaaaacaaacccaaattcctaatgcttggtaccatgaaaacatggcaacactgtttgcattttctttacaaatggcctgtatgggtcagcccaggcattgacataggagcccattgtttgc

SEQ ID NO: 50949 - DNA, 1122 bp, Homo sapiens
ctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctat

SEQ ID NO: 50950 - DNA, 1045 bp, Homo sapiens
ggatagcgctgtgatgaacatttgtgtgcatgtgtctttatggtagaacaatttgtattcctttgggtacatacccagtaatgggattgctgagtgaattagtagctctggtttaagttcttggagaaatttccaaactactttccacaatggctgaagtaatttacattcccacaagcagtgtataaatgttccctttcatcacaaccttagcagcatctgttattttttgactttttaatagtagccattctgactgttgtataatctcattgtggttttgatttgcatttctgtaatattagcaaggttggacactttttcatatgcttgttggccacttgtatgtcttcttttgagaaatgcctactcttgtcctttgcccaatttcaatggggttgtttgttttttgcttgttaatttgttaatcttccttagagattgtggatattagacttttgttggatgcatagttcgcaaatattttctcccattctgtagcttgtctgtttactctgtttatagtttcttttgatatgcaaattaggtctcatttgtcaatttttgtttttgttgcaattgcttttggaatctgcatcatgaaatctctgccaaggcctagttccagaatggtatttcttaggtttccttctaggatttttatagttttaggtttttgaattaaatcttcaatctagttttagttgacaaattaaagattaatccatcttgagttgaaactggaaggggtccaatttaaatcttctgcctatggctagccacttattccagcaccatttattaaatagggagtcatttcctcattgcttgtttttatcaattttgttgaatgtcagatggttgtatgtgtgtggctttatttctgggttctctaacctgtttcattggtctatgtgtctgtttttctaccaatatcatgctgttttggttagtgtagctttataatacagtttagagttgactagtgtgatgcctgtggctgtgctctttttccttaggattgctgtggctatttacattcttt

SEQ ID NO: 50951 - DNA, 1094 bp, Homo sapiens
gaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtacttgcgggctggggtttctttcccctgggtttcgggcagagaacccgtgcggggcgcgcccgaagcgccctttggtgtcccttgctctccccatggtctcggcccccctccttctaagcgcgtgtacccgcgacctgcgtctgcaagtgctgctccacacacagcggccccatctcggcccggtcttccctgcctcccgcttggcccctgtgctgtaagctcgcctggaccccaggccgggcggtgcatagctctgtggcctgtggccccgtgctcagcatgacctaaccagaattaagcagtggacaatgggatttaggccccccaaaccctcgtccgatgacaatgggaggggaagtgtgatttttctcccctcggatggagcgtgctcagctgtaggaatgtgactcaacttgctgaaatgattttctgctctgcggactggtgcaccctgtgacccagacagatgtggagggtcccaccgctctgattagcagaaccaaaccgtgagtgaggtgcacatgtgttactcttaggaccggccctcccagctcttggtttccaatgcctgctgagtagaagaccttcctagggccattaaccagctttgctgacttgcatttaatgacctttcctctttatcttccttgttgtgcaggtaaagaaaccaagtggaagagtgtttcctcctctggccgtaaagcaggtactctctgcagcaccaggtaggaggggactcaacccccttcttgccttttcagttacatcagttcctactagggattccacacacacacagttgttgtgattttgtggtgatgacgagaaaagggttggctaagaaactgggcggcagaaaagaggcaaacattcactgtagccatttatcccgatggaagtggccaggccctgtgggggacattcagcctccgtcagaa

SEQ ID NO: 50952 - DNA, 1049 bp, Homo sapiens
aactcagagcatcccgcttgccaggagaggagtgaagattttggataagcatccaggttctcaaggtggcctcttgggaaaagataaaagcccagatttagattaaaccagatctgtaggacaaagttagaactgactgacagaaaaatctttcctgtatgactgactaaactagttggtaactaaaatgtcattgaacgaatatttattattaaaaaaaatcctacacccaaagatgtcctcaaaatggaggccacagtggcaggggaggtcctggtggctggctagagggcttctcctgtgtggacctttgctggagagcttatttggctggaagcaccatgtcagatacattttggcctgattttctgatgatttccccttctaggtggctggggtggcaaggaggtttggttcgtagcaacaaagtagttgtgagctctttgaacgaaaaggctaatgccctgggagccaaaaggtctcactggtgaggtttgccaaagctgtatgagttcactggggctgccagaacagagagtcacaaactgagtggctcaaaacaacagaagttgattctctcccagttccaggggactccggatgttccttggcttgtggccatatcattccaatctcggtttatatcctaaatccagaatgacctcatcttaacatccttaacttaattacacctgcaaagaccctgttcctgaataaggccatgttcacaggttccagggatgaggacacacgcagatcttttttggcatggggcggggcattcttcactatagcatcgtcagcctaatggtgagatgcgacagtccacagttttcacatccatgcccattacaaaactgggtgagatggccaggccaaaggatggctttgagactttaaaaagcatgctgggtaaaagaaactatttaaactacaggtctgtagttcctcgtaagagcagtgtcccgggcatcgtgcgcttgccagctacctgccattgcctctcttccgggctctgcacatgggtgaaaagccagccctgtaactcg

SEQ ID NO: 50953 - DNA, 1033 bp, Homo sapiens
ccctcattgtttggatgagagggacttgtccaaggtcgcgctgcaagccagcagcacaactggcctgaagtgcagggatcctggctttaccttgggggccttttcttctacaacatgttgccatgagaagtgtctgcatagagaaggtactgatgacccaaaagacgagtttagggtcaattggtgtgctttggccaaagaaaccctggaaaatcctctattcatgaacaggtcaacctgccccaaagagttgttggaatacctcaaaatcaaaagtacaagctttgatatatagtgcctgctggtctgcttggcagctctcctactgaatggaagattagattaaaaaatctagaaagctgaaaaagggacttctctttaagaggtaagcacagtgcaataacagaaaagttgtaacttcagggccccaagaaaggtggtattctgtatactcatgtcaaagtgacagaactgtattatttgctctgtaaagatttactattgctctgtaaagatttgctatctggaaggttatcagtgttacacaaaccattggccataggaaggaacaagctttagttctctggaaagttgcctgtgtataccatctcattcctagatgttcttatccggtgtcatttttttttttgaggtgcagttttgctcttgttgcccaggctggagtgcaatggcatggtctcagctcatagcaacctctgcctccagggttcaagcgattctcctgcctcagcctcccaagtagctgggattacaggctcccaccaccacgcccggctaatttttgtgtttttagtagagacgggttttcaccatgttggccaggctggtcttgaactcctgacatcaggtgatctgcccacctcggcctcccaaagtgctgggattacaggcttgagccttcacgcccggccttctactgccatttttccgaagtcaggtctacatgatttgttgttttatttttagtgtcaattaatagatattcctgagtctctgcagaccagccatttgc

SEQ ID NO: 50954 - DNA, 1032 bp, Homo sapiens
gtgtacaaaaatttctgctgcctgtagtgtcttctcagggaaggcgtaaaacccctcttttcaaggctgtacctggttatgttagaatcacccagaataatctcccttttgagtaattcagagtcccgtcaaagacatcttaagtgcatctgcaaaatccatttacctctgctatgtcataatctgatcacagcagttatatccagcctattcatgggtccctcccatgctcatgagtgaggattatgcagggtgtataccttgggggtgggaattttgccagccatcttagaattctgtctaccatgtttatctaggacatgcttaagtaagactggcattctctttcaactgccattgtatagtggtgaagaatctgatgactcctagtaccatttggtgccactgcctcggttcatgctaagggccagcaggtttactcattgttggttttgcaccacagtgcaagtgccaaccccataaaagcatgattatgaaaatagtttttcataatctatggagcccaggggtccttgaaacactctttgagaacaaccatttgtggagatgaccttacacagccatgtggcatcagtatgttttcattcaggtcagtgatgttttcgatatcagtgtacagcaatcatgtattgtggtgctacagcaggcaggaaggttgctttagatgtcttttgttgtatgaagctacaccttttcagttttacttctgtagaaagtaatataaattaatgcagccttttgagagggcagtttagtaaaatatttgaatgagcagttctacttcaaagcattttccctgtaggtatacgtatgcatgtgtgcagtggtacattttaaatgatgtttgtgatttcttgtgttttgtaccagccaaaaattaaacacccttaaatcccactagtgaaatatacagattctaaaccattcatactctgaagccattgcaaaaaataaggtagagctctggaactgacatgaaaaaggcaagtcacagaacaggatgtatgtagt

SEQ ID NO: 50955 - DNA, 1029 bp, Homo sapiens
cccatccctttcctaacccctggcaaccactgatctgttttccatttgtaaaatgttgtcatttcatggcattcagttttggggggaggcaaaaaaaaaagttgtatttcaaaaatgttatgtaaatgtaattataaagtagataaccctttggaattggcctttttcatgtataattcagttggcatccattcatattgttgggtgtattaattgctcattcattcttattgccaaggagtattccatgggatggatgtaccacagtttgtttacttgatgtattgaccccagtttttggctattatgaacaaggctgctgtaaactgtcatgtatagtatttttgtgtgaacataaatttttctttctttatgaataaatgcccaagagtgcagtgactggatcacatggtagttacatgtttagttttgtaagaaatgatcagttttccatgaagactgtaatattttgcaatccctaattcattgtgtcagtgccattttctctgtatcttcaccagtatttggtgctatcactatttccattttagccattttataagtgtgtggtaatatcttattgtggtttagtttgcatttctctggctaatgatattgaacaccttttcatgtatttgtttgccatctgtatatccttttcagtggaatgtctgttcatgtttttggtccattttctaattagattttttgtttttcttactattgagtttgagagttccttaaatattgtagacatttgtccttagtcagatatatggtttgcaaatattttcttccattctgtagcttgtctttttatcctcttaacagagtcctttgcagaagttttagattttgatgatgttcagtttgtcaatttttccttttattgatcatacttttttttgtgtgtgtccaagacagggtctcactctgttgcccaggctgcagtgcagtggcatgatcgtggttcactgcagccttgacctcccgggctcaagtgatcctcccacctcagcttcccaagta

SEQ ID NO: 50956 - DNA, 1042 bp, Homo sapiens
gtttgggcattctcaggtctttcctggatattcatgctgtcctctgcatgcaggtgtcctcttagatccccaggaaaataaatacacttaatttattagcaatgatggttttaatgaaatcatttaacatctccaaaacaaacaggaccaaaacaaacttgataaatataaatagactttcaataaatttgtcaacttcttgatgggaacttttaaaatctcagcatatcatacctccaatcgacagggactttttaatatataaaatccctttttgagtcttgtgctgacccatctgatcttcctcatcagcacccatcagccagtgtctctgggaacccctagaaccacctgtatgtgatgtatgtgtttgaatgacagcccacaagaccacatcatgctgccacccttttttctatcttagcttatgtttctcgtaactgaggtttcaaagagataggcctctccacctcaccttggtccagatacttatcttgcagagaatgttcttctctgcacgttgtgcattcctctgcttgttttaaaaacccctgaaccacctaggccagagattgtatcgtaaatgacctttatttatttattcaccaatgttttttgagtgccggcttgctgctaggtgctaggcctaacaatgtggaagaggtcactgcccttatgaattgttttctctggaaggagacatacagtacctaaaatattttcagatattgctgagtactctcaaccaaattcaagggggtgatgggatagcaagcgcccaagattaggggcagctactttaaaattaagtggtgaaggcatctctgaggagaggtaatgtgcaaggaagtgaggaaggagacttcgaggccaagagatcagctgtaagagttctgaggcagagaagagccaggcttactctgtggcccggaaggcagcctgtgtggctggagtttggagaatgttggagaaaagacagagaagttgtcaggggacagatcacacaggatcttactagtatattcacaaggttgcacaacca

SEQ ID NO: 50957 - DNA, 1034 bp, Homo sapiens
attaaatgacccaaagtggaggcagacagagtaggcaggtaaaacagacaggataatttcagattaaattatttcaagagtggcttgctattgggaaaagcacttggtgggccgcttgttttacgagtagagcgaaagttgaagtatgcattctctgggcccaggctctgggctcaggactaggacaagaaagaggactggtctcctcactgccccatgggctcctgttatgtgggggttgcaagagccaagctgatgatattacacctggtgttttgatggtgtggaggggacacatcagagaagggctcccaaaggaggtacatcttgcctatctgactgtaacttcatagctcattagccattctctgctacttggatttttctcctccttttttgtcatatcatactggaacatctctcaggcatatccttctcaggtatgtctctgggattggaccttcatggtaatagcagtgattgccaaatgggggactgaacacagatttgttattactcttgaatggtttgaacatggtgcactggattgtttcagctaaatggggcttgcattgctgcttgtgctgtagaaaaggcttatcacttctgaagttcgtcttcccaagggagtttcgttgtgcttttttatcattaaagagattatagtcgcagacctgtgccaaccagctgagtgaccttgagaagaccccttcttgctaggtctattttggcagagctgtaaactaggagaactgactggccttgactgctggaagctcctaggggaaggggaggactgtgcacgcttatcgaacactatgctttacctgtgccagctcactgagtcctcacaagagcccgatgcagcagggactgttttatcatcttcattttacaggcaaggaaactgaggtgcccagcagtgaagtgggtgggtggggggtttgaggcaggactgtcacccagatgatctgattttagcatgtgtgctctttgctgccccaccaccacacagcatggatgtcagagcaggt

SEQ ID NO: 50958 - DNA, 1030 bp, Homo sapiens
tgcctcatgaatatgtactacagttaattattttgagacaaggtctcagtctgttgcccaagctggagcgcagtaggggagatctcagctcactacaacctttgcttcccaagctcaagtgatcctcctgcctcagcctcccaagtagctgaaactacaggcgtgtccccccacacctggctaatttttgtatttttggtacagacagggttttgccacgtagcccaagctagtcttgaactcctggactcgagtgatctgcctgccccatcctcccaaagtgctggaattacaggtgtgagccaccacctccagccatgtacaactattatttgtcaattaaaaaataaaagtaaaaaaggaatgtcttcagtaaacatacagtaattaggaaagtttttgcacatttggaaaaactagaaaacaaaaaaaacaggctgatgagtaggatgaaataggtcccaggagctacctgttttttttttcttttgatttttaaattttagaacattttggatttatagaaaaattgtgaaaatagcagagtcttctcatgtgctacacacccagtttcccctgttcaaaaacctgtataaaaattgatgtatcattgtacatattgtaggggtacctgtgatactctgatacatgtatatcatgtgtaatgatcaaatcaaggtaattagaatagccaccacctcatacatttatcatttctttgtgttgagcacattataattcttctcatctagctattttgaaatatacaataaattcttgttaactagagtcactctactgtgttatataatagtagaacttaatctttctaactatatttttgcactcattttaaagtttaatttttttttttaatagagacagggtcttgttattttgcttaggctgttcttgaactcctgtcctcaagcaatccttctgccttggcctcccaaagtattgagattacaggcatgagccactgcacccagcgtttttgtacccattatctgacctctttatccctctc

SEQ ID NO: 50959 - DNA, 1050 bp, Homo sapiens
ctcccagtctctatcgatgctgtctatttctctgcaccctgtacagctttgacttccacctgcattaatttaattctgcctggattactacactggcctccttgacaacatgttgtcctcacagaaggaccagagtgacctagctgaagggtcacctaggttgggtcacttcttagtctcgaatctgccgttaactctcatggatcaatttgaaattccttagaatgaacctcaaggccattcatgaactggaccctgccacccaatcctgtgcacctcatcctctgtgagctagccatcctgaacttttgtcctttccacaatacaccaggtgtttcacctttctatactgccccttaaccccttcaacctcattcttattgagaatatttacttgagtttcaagatttaatgggaatatcacctgctttatgaagtcttttctgagtatgtccccaagtgacctttatctactttgtttccccgctgttctgtggacataggtttttcagagctcctccaaaaatcacagtagtatactcactgtcttataaaattaaatgtgattgcttgagggtagggttcatgccttgctcatctctgtatttctggcctagggcctgatactgaggaatgctcagtaaacgcactcattgaatggacttcaacaatgaggtaagagaggcaaggtcccacagctggtgaggccagagacaggactccaaggcattgtgcaggctgacttcatgctattggagacctcaggtgggcttccaagtctcataagaccctctttctcacattcctttccagtttcctatcctgagaatgagatgatctacaagtgggaaaatttcaagcttgaaatcaatgagaagaactcctggaagctcttccagtttgattttacaggagtgagcaacaaaactgaaataatcacaaccccagttggtaagcgtgccagggcttggcggaagtccaggaaggtggtagggatgattggagatggccatccatacaaatgctttgcagtcatcccgtgcaaacatt

SEQ ID NO: 50960 - DNA, 1028 bp, Homo sapiens
gagacttggctaggagggtcgtgccctggatttgtggctttttggggtggaagatgactgcttcgttttgttgttgttgttttgagatggttcctgctgtgtgtgaagtgtcacaaatttgcaagcttcctgatctgtggagctttctcgaagattccatggcactgggcttgtgtcttgtttgtctgttctggggagggagggtggcttctctccctaccccagattgcgttagctcatcagagaaggggatgtgtagctgcttgctggctcactggtgccctggagtggggctagcctcagcaggagcttgataaatgtctttctatgcgtgctagcaatttccagtcatccacatccctcaaaatgggatgtggactagttgagaaagctgacgtggtgactggctagggcaaaagatggctctggggtgggggaaataagaaggggtggtcagagaggaaaacagcagggaaaagggactggggaaatggaaactgcccttcaagcatagcaacctgtggtgtcaggaaagagctgaggaggtgacaatggggtgtactgggccacactgaaccagaagacctctccctggtccaggcttagcctcaaattagttgtgtgacttggggcacagtccttcctctatctgggcctcagtttgtccatctgtagaatgaaaaaaaagatctgatttagaaaaaaatccaacatcttttcttatgcgcccctcccccccccacttctcacaccaccaacagtcgactgtttgggagggggtagtgcagagattcaacttcatgctggaccattatgtctagagacatgtgaatgtctgaaaaactgccctggaaaatgccactattccaatgtgtgagtgtttttcaagtttttattctgtctagccccgaaagtgagcttaatggctggctggggaaaggtatgcattgtcagcagctctttaaccccaaggacctcaagatgaggttttgttttgtttgtttattgttgtgttttttttttttaac

SEQ ID NO: 50961 - DNA, 1053 bp, Homo sapiens
tatttgcatttcatgttggctaaatgatgttgaacattttttcgtgtgcttgttggtcatttctgtatctttttttggagaaatgtttattcattccttagcccactgaaaaaaatttggtaagaagctggtaacctttatgtgattctttttttaaaaaacagctttatcgagatataatttacatactggaaattacttgtagcccatcttttaattaggtaattaactttttgttactgagttgtaagagttctttatatattgagggtactagacccactgcagatagatgatgaacaaatattttctctcacttgtggatgtcttttcactcccttgattgcatcatttgatgcatagaagtttttgtttttgatggaatccaatttatctatcttttattttgttccttgtgcttttggtgttgtatctaagaaatcatttcctaattcatgttcatgaagaccaacctctatttttcatctaataattttatagtgttagctcttagaggtagatgtttgaacgagtttgagttaaattttgcatatgataagtgaaacagatccagctccttttgcatatggatatccagttgccccaacatttttcttcattatttttttcttttttctctacagaaagtaatcccaattgattctttttttccgctgctcaaatatactgttgaatcttcatagtaaaattttcattccagttatactttttaacttcagaatttttatttggttctttttttattacttatttattttggttgttgttcatttttgagacagggtctcactctgtcacccaggcttgagttcagtggcacgatcatggctcactgcagcctccatctgctaggctcaagtgatcctcccacctcagcctcccaagtagctgggactacgggcacataccaccatgcccacctgatttcttattttttaattttgtagatacagtgtctcactatgttacccaggctggtcttgaactcctggttgcaagcgatcttcccaccttggcctccccaagtgctgg

SEQ ID NO: 50962 - DNA, 1057 bp, Homo sapiens
caccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccaggtaagctggtgtggtggggttggcaaggacagtctccccgggagcctgggggcaagcaggcagaggccagctcgggaccagcacctgtgtgccagggacaagggtggggaggtcgagcccagcgggagctgggtgcactgcatgggctctttcgggtggctgcttgcctgcttcccggcagctggttccagggctggagacccagtgtgctatgccccaggttcccagccaaggcattccggtgaaggggctggaccccgccaaggtgcggtccctgagctgcctctgcctctcccaatccctgctggggactgtggctggaggcaggcagtagagcgctctgaggcctgccttttctgttcagtaggtgacaggagtggggctgacgctcccagagccaaaggtcacaggtgctgtggtcgggggtggcaggaagtgagccccagaagggtcagagctttggctagggggaggatggtacacagcagggcccgggcgaacccctctctccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgc

SEQ ID NO: 50963 - DNA, 1078 bp, Homo sapiens
gctggcatgcagtcacctgtgtggattaacattttgcaagggtgtatgggttggagtggagcaggagagcctgaagtggggagaccaagttggaggttgtcagtgagacttgctgggaacctgaacgggggcagtggtacagtggtagtagaagtggggtggaggggacagagctgagaggcccaggtggagttgaatcagcaggcttttccagtctctgggagtctgagatgatcttggttctgctgtggacttgcggaatcgaggacgcagccccctgctggaaagggagctctggctgcccatggagtaacactatcgtgctaggtgtgagggctggttgcagagtgggacttctggccaggcctgggggcagcaaggaaaggaggggacagggagagcagggttgagcaggggaggcctggcagatgagcaggatagggtgcttccgggcagtcgagcttgggttgctggcttcagaggcattgaggccagggcaaagggaatgtgctggcaggatggattccagcctccagcagagcgatagaagatcggggagcagaaggaagagggaagcaagatcaagaaggaggatgtgagcaggttagtggccaaggaggggagcacattctggagaaggcctggtgcttggcactagttttcagcgggactgggctcagaacacataggaggttagcctgagagctcccgagtagcctttgtaattgggaaagggggcctggcctgaaaggaaacatcacacctagaagcaagtctgtacccttggccccccatagtctgctgctgctgcctgggatagcagtgggagagtcccagcttcccagccaaagccttctgagcttttgtcctgcctctgccactactgtctcagtcctgtcacttgacccagaagcctggggctgctctgccctttcttcttgtcccatgtgactgcccaaccatcgtggccatttctcagtgtgtggcccagcagggtgaggcgctttcacggtgtcaagtagccaacctccagaagtcttcagcctgcagagctggactccacccatgaaacagcctg

SEQ ID NO: 50964 - DNA, 1048 bp, Homo sapiens
ccgcagcctggctgaagcgacagtgactcctccaccggcccagaatccccacccactcttccccaggggcgagtcgggggaaggggaggaggcggaggaggggcgaggggcggagtccgggcgcgggagccccaccctgttctcgcccctcggcggggcccgcccacacccccacctcccgttctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgag

SEQ ID NO: 50965 - DNA, 1090 bp, Homo sapiens
atgctggcggcacccggtccacctgcccacccagggcacggactcaccacgaactgtggcaggccggagccattggcaggctgcggggcgtgcgcaggcggctcgcagtacaggtgggtgcgcgtgagcgtcttcaccaggcactcgccgcggccgatgtgcacgcgcacctcctccttgctgatgcccaggttgaggccctcgccctgggacacacatgggagcctaagctgctggcccccacagaggcggcctgagcaccgtggcggggcagggttgaaggtggccctcacctccacatccaggacatggcctggcttgaggcggtaggggcgggcaggcccctcgcggctgaggggtgccaggcgggggttgggctggtacaggaagccctggcccccactggcactggcgaagtccacttgcacgttgtctagggtgaagaagacccgctgcgggtgggctctgtctggtacagcagggctccggcacaggaggaggctggacgagttgacggagcagacggtggagcactgtggggcattcagggccgaccacaggtggagtgagctgggctctgctgtgcgctgctaggggcatggcggcctaccctcctcctccccactgggcatgggcatggtcggggacagccttgtcgcctgctggtgaggggctcacctgcagcagccccccaccgagctggatacaagcctgggggtccgcagcaggggctccacagctcctccttggctgtgggtcctggggctgggccctggaagcctgcacctctgcgtcagcctccagccacacagacagtaggggccgctgcaccacgtctaggccggtgcccctgacacggatcagtcgcccacccctgtaccaggatggcagtcgggtgtgggcgggcggtgggcaacatagcccagcccgcatcccaccttccctcctgcgtggtgcacaggctggcctgcgggctgaccctcacccccggaagctggcactgggctccgccgctacaagctgggggttggcggtgtagcggaaggggctggcgagcagtgtgcgctgggcatggccaaagaccacaagg

SEQ ID NO: 50966 - DNA, 1251 bp, Homo sapiens
catggctctttggccaatggctatgatgcttctgccattggctggaacactttgctgctgcctggtggtcaagtggcagggcatccccaagtgacagggaagaccttggctctgccaccgtctcaggtgtgttctaggtggggcttcttccaggacagcaggtcacttggcacctggcacatttggctcaggcagctttggctctgaagctgtccggcatttccagtcagggcgttggggacattcggcatccagcagtcctttccgaaggccttcctagagttgggtttctgttatcaaccttccagaaatggctggatgtccctacacatttgttttcgatttctaatgccgaagggccattccccagggggccagcagtgcttgtctcagggaggccggaggctgggtgctaccttcttatctccctattctgctttttctgtagcgaccacatgctgcttttgtaataagaaaaagtgatcggcgaagtgataacgtgactgttgtcatggatctgtggtttgttgtaatgatttccctgctgtaccagggttagtttgccagtttttgcatgttacaaacatcgctgagcgggaataactggccaaaaaaataatcagaagcaaaaaagaggagggagggcagggacacgccttttaagaaattttctgaagagcggaaggaggcaggaggctggagcgccttctactttccaggtgctccagcgggccggccctggggactgaggctttggagctaattatctattgtgcccctggcagtgggccatgctgcacagacaggggacctgcctgggcacagtggggacggtccgtttttccttccaacttggctttctgggttagacatcaaaccaaccgctggcatttggtctctgccaggttctaggcgcccacgaggtcccctcgaggaacatcttttcagtaagtacctgcccgtgcccacgcatgtgtctttctccatgtggccgcaattgtgcgcgtgtgtgcacggcctgtgtcctgtcctctgagacgtggtctccaggggctacccacccctcttctgggagttgtactagccagcatccccctgggaaaaggtcccactttcctggtcacggccttgctcttggaaccttggctgattgtgtcttcttcctttctcatcctttctaggaacaaacaattgtgagtattcttctctgcctgttaggtttggggggctcttagttgctttggggttaac

SEQ ID NO: 50967 - DNA, 2025 bp, Homo sapiens
cgggccgggagagtgggccacggcggctgtcacctccttagtgtccttgaaggagcccttctgaggcagtcactcacgtatcccggcccgcctttctcaaaccgcttcgggaatccggttccgggactcaaatttctccacggtttcctctctcgtggaccgctttgccacctatcccggtggcaaagaaccggactttgccagtcatcccccatagtcccccagtcttagagccccagatgccttcccctcgaggcgcctggaatgggaaggagctagggtttctgaggctgcgggggttttgcttctgctcttctccgtgtgcggtcttgcgtattcaggtccgagtcttctttccttacacttatttaagaagaggttaatttaggtcctaggtgggctggaaaccatctgaagcagctgccagccagcacctggccctgatgggtaagaggtttgacctctaggccatgctcccacactgagccactgcgtggccttaggccatttcctcctctctctgggttctagtttcccctttggaacccagaggggaggagacttcatgttctcaaaggatcctgtcaactctgaccttccagaactccgtgactttgcggccactccccagggacatctctacttgccatgttttctccttctgacctctgggggagactgcttgtgcctaatgaaattctcttgacgatgctgacttctcccaccttgctgctgaaaggacggcagtatatagtggctttccagaggctctgatggctccagcaactgggctcctgtaggctcttggtgaagacatgtgtgcctcctccctgacctcccctgtgtgtgtgcctgtgtgtgcgttggggtgggagtaggggacagtgaacggtgggtagctgggcagtgccttgccctgagactgaccgtcctgggtgtgagaacccttacagaggaaccccaggtcttgaatcccactgatttggacgccataggaaaacatgcagccaccattgacacatggtccaacagaaatatgccaaagacagaagcctcagcaggcataagatgtggggtgtggatgttctttctttccatggaaccatgaaagggtgatgggagagcgggaggcgtgtacatattgcatcctgcctcacacttggctcctttgattggtggcttcacagggaagtcagggcacaaggcagagcctttgcgacctcctgaaggaaggtgcctgcatctgtacagtaaggtcagggaagtccatctggagcgctctctgggtcttttgccaaagcccaaaggaacacctggcacagggaccgggtggcagagaggttcagctcagccctggtggtgatgttgccatctgtgagggaggtccatgctctcaggagattggcttgctgccacagctgaagcccaggaggaactactgctgggagctgcaggggtccacccgtgacctcccagggacaccagccttgaactctgacctgaggggccagtggggtgaaggggcaggcgtgctgtgtggcactagctactgtgagcagctcacacacctcctgtcccctaatctttccaacagtcacggaaagtaggtacctccgttctgtgaatttcagatgaggccatgaagccatctcaagaagagtggatggtggatttggaccgaggcctccctagtctccagatcttttttcattttctgatgtgcttgttcactcaggaaatgttccttatgtgccagctctgggccaggtactgtgctgggtcctagggtgacagtattggaccacactgacttggcccctcctctcgggctcaggggttgaggagggagcaatgcagtgataacctagggaagggggtaagtagggccttagggtcccagctcagtagccttagggcatcagggaaagctccctggaggaaggtccatcgaagccgctttctgcgtgcttacaagagcccccaaataagatgatttcagatgttgataagcgctagagagaagac

SEQ ID NO: 50968 - DNA, 1070 bp, Homo sapiens
gaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagcctt

SEQ ID NO: 50969 - DNA, 1057 bp, Homo sapiens
gcgcctctcggctgcccccggccctcactacctgcccgcctctacccgcaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcggctgtgcgcgcgtctgtgggctcgcgggaggggggctgtcgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttcta

SEQ ID NO: 50970 - DNA, 1053 bp, Homo sapiens
gccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgt

SEQ ID NO: 50971 - DNA, 1031 bp, Homo sapiens
ctattgctagcctggtcgaaaccgcctgggtaacacaggaatctagctaccatgacaacagtcagagggcctgccgtaggctatagggaagccagggatggaattctctcactgagacagatcctaccttcctgagctagcttgaatccagggaacgacctgtgtgcagtctaccttgtgtaaccctttcccctccgtctctctgcagacaccctgacgtggaataagcccagtctcagcggggtggcgcctcttcctcgcagtctccactcggcaaccaccatcggaaataagtaagtggctgctcacctgcgtctctcttctctagactggcgtggcccctcccccgaagggctctcactcagttttgtcctgtcagaccctaaggcctgaggatgcctctttctggctgggctggcatttggcagccctgtttttccattacgaccctgggggaccaaggaaagacagattcaggggggagagggccacacacaagctgagtctgagaccctccccgggcctgtgaggctccgccctatcaggtacagagtgttctaggtcctctgtgcaagcacctgggtgtctttgtggatgtccaggtcctaaagggaacctagaaactgtggacatgaaggtgagctttagatgagctgaacggcacttttatgtggtagaggtgacacagttctcctgagggctgagccaccaggcaggagagggccacgtcaggaggcttcacgcatccttggggactctcctggggagagccagaggactgagctctagaactggggtagcagaggtggcctctagcttggcaccaactctacaatcctttcccactcttccctcctcactcccagaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttct

SEQ ID NO: 50972 - DNA, 1035 bp, Homo sapiens
ataaaatgcagccgggcacggtggctcattcctgtaatcccaggactttgggaggctgaggtgagaagatcacttgaggtgaggagtttgagaccagcctggccaacatggtaaaaccctgtctctagtgaaaatacaaaaattagtggggtatgatggtgcacgcctataatcccagctactcaggaggctgaggcaggggaatcacttgaatccgggagatggaggttgcagtgagctgagatcacgccattgcactccagcctgggcagcagagtgagactctgtcaaaaaagaaagaaagagagaaaggaaggaaggaaggaaagaaaggaagaaagaaagaatgtctctttgaggcagcatattgattgattggttttattttccctctacgccagcccggcaatctttgtgtgtttatccattttcattttaatggatttgccaatatggctgtatgtgagatcttttattgtgataaaatatatacaacataatattcatctgtttaactatttataagtgtacaactcgggggcatgggctttgtttcttcaccctcaacatcctcctcctcctcctccacaccattagaccctgacccccgccaccctcctgctctggctgtgtgtgaggaccagcttaccatttgttctctgttgtcccatctgtcgttggttactttctttctctttttttgccttttctcagtgtcacttttcattattactccagcagttaccctagggattgagtctgcggtgcagtggctcaagcaacgccagagcctcccagcagcgagactgtgtttccgccgggcctcgggtgctcttgttttcgtatattttaaatcccaaaggacactattagtgttggtctaaacagcccattttttacctttctagtgcgttccatgccttcctgcagatctgtttttccacgttagatctcgctctctctctctctctcaaattactttatttcttggcagaaaatagggtcaagaaaataacaagtggataacatcatctc

SEQ ID NO: 50973 - DNA, 1068 bp, Homo sapiens
gtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacc

SEQ ID NO: 50974 - DNA, 1731 bp, Homo sapiens
actgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccac

SEQ ID NO: 50975 - DNA, 1064 bp, Homo sapiens
cccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaa

SEQ ID NO: 50976 - DNA, 1010 bp, Homo sapiens
gagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaaga

SEQ ID NO: 50977 - DNA, 1050 bp, Homo sapiens
ttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagt

SEQ ID NO: 50978 - DNA, 1048 bp, Homo sapiens
tgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaac

SEQ ID NO: 50979 - DNA, 1035 bp, Homo sapiens
gacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttc

SEQ ID NO: 50980 - DNA, 1052 bp, Homo sapiens
ttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggt

SEQ ID NO: 50981 - DNA, 1057 bp, Homo sapiens
agcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatg

SEQ ID NO: 50982 - DNA, 1047 bp, Homo sapiens
tggggccctggccagggtggaagattagatgttggacttgtctctaatgcgactactcctaaatgactccacgcgggagagccgattaggagttatgggggctgctgtcatcttgactcaggggctttgtcactaacagccgatggctgctacagctataggacaaggaaccatttggccatttgcctttgacactttaaaaagatcgtggtaaaatatacataatacaaagtgtaccatcgctaccgtgtgtaagtgtatagtccagtcaccaccatccgtctccaaactcttttcattgcatgaaacggaagctctgtcctcatgaaacacccatgccctttccccacccctcagcctcctgcacccacccttctattcctatgcatttgggagctctgagtgcaatcctacgggtgcatggccttctgtgcctggcccggatcacttatccgttgcctttgtgtatttggaatggatatccaaccattggattttcatttttgtgtggttaaacatcatttgttccctttttgacttctgaccttcctacctcgtttgaagaggtccgtaaacgcacaccgtactccgccctctgccccagctgccgggctctccacacttgccaaggccccctactcggtacagtcttgatattctcagctcagcctcataatctcaccctggctgctgtaggcctcctaagtccctgcccgtccagccgctctaagtcacagagtgtgaatgtggcacgtccaccctctgtgtccttgagcgtggtggtcactgtgtcctcatcaggaagatggggataacatttacttgctgtaaggcttaaataagatcatccttttaaagagtcttagctcagtctttggtacagaaaactcagccaattattcattcagtgggtacttattaggtacttttgtacctgttctaggtcccgggatgcagctgcagatggagatcccgtgctccgcagctgcagctgcctttctagttgggggagatgagtaggatggagaacagaaaaaggaagacagg

SEQ ID NO: 50983 - DNA, 1029 bp, Homo sapiens
aggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttgcgtggctgtagctttgttggggttgggggaccagtcaaggccaacctgacaggggtgccaatgagcagatcaaagcatgggctgagcacaggtcacctccctccagggctcctgcttcaccccaccctgactccagaaggcaccatctatctttgcttcctctgcctccctgagttcaagccaacgtaaggagaggaacatgtagcaacctggaatggagcccaggcagcaaggaggcaaagagctgggcaggagagcccattactgggtagggtggtgtcaggaaggctccctggtggaggtggccagataatcaacagcaggcccggccgggtgtggtggctcacgcctgtaatcccagcacttcgggaggccgaggcaggcagatcacaaggtcaggagatcaagaccatcctggctaacacggtgaaaccccgtctctactaaaaatacaaaa

SEQ ID NO: 50984 - DNA, 1028 bp, Homo sapiens
tggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtgggg

SEQ ID NO: 50985 - DNA, 1020 bp, Homo sapiens
gccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggaggctggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggt

SEQ ID NO: 50986 - DNA, 1394 bp, Homo sapiens
accttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggg

SEQ ID NO: 50987 - DNA, 1031 bp, Homo sapiens
cttctctggaggccaccaaggtggccacctgggcctgtggttgaggctctgggttgggagttgacttgggttttctatctcctccctggcaggctacctttggctgtccccagtctgtctcctggcatcaggcgcagcctcccccaacacccagttgcttcatctaggaaagccaatacctgatcactagaattatatgcccaactggagtcagtagggccagagtaaggggtagggagcttccactgaacatggggagtgatgccccggttgctccctgcaggctctgagatggagaggggactctccaccttgttgactggtaataggtcacctgagtacttttttgtttgtttgtttgagacagtgtctcactttgtctcccaggctggagtgcagtggtgcaatctcggttcactgcaacctctacctcctgggttcaagcgattctagtgccccagcctcccgagtagctgagactacaggtgcgcaccaccaaacccggcttcttcttcttcttcttcttcttcttcttcttcttcttcttattattattattattgtatttttagtagagatggggtttcaccatgttgcccaggctggtctcaaactcctgggctcaagcaatctacccgcctcagcctcccaaagtgctacaggcatgagccactatgcccggccaggtcatctaagtagtttttctaattccatttccccctgttcctagagtagggagtttttcatctgaacatgacttacacttgagcaggaagcatgccaaggtcggcctggcttagcccccggcccctgagcctgactgcctgtgtctacacttcgcggtgtaaggagggccaggctgccctgccgcaggccccgggaggctccacactaacagaaaccactctgtatccacaggtccagagagctcggtgactgcaggtaaggcccctgtcacctccctgctcctcccctttgtgacatccctgcctgcccccggtcccgtagggcttcggttttccatttattcc

SEQ ID NO: 50988 - DNA, 1037 bp, Homo sapiens
gtttaaaagtagatggactggtttagtggcaaattacgcaacatcaaagagagaatgcgggaaccaaaaactggctcagaagaatgtattcagaatacaacccagaaagacaagttcagggaagacactaaagacagaggaagaagccgcaaggagaatgagaaggtgttccatacatttaactgatttcacagaaacagaagacagcaagtatggcagaagcaaaacttgaagatataatgatggctggctgggcatgatggtcgctggccaggcgtggtggctcacacctgtgatcccagcactttgggaggccgaggtggccggatcacctgaggtcaggagttccagaccagcctagacaacatggtgaaaccccgtctgtaataaaaatacaaatattagccaggcatggtggcgcttgcctgtaatcccagctgcgtgggaggctgaagcagaatcacttgaacccgggaggcagaggttgtagtgagcctagattgtgccactgcactccagcctgggcaaaagagcgagactccgacttaaaaaaaaaaaaatctttcaagtatgatggtgaagtgcaaacaaaagcaaagaatttgccaccaacattttctcaccaaaaagtgtgtgcctcaagcagaagaaacccagtactagatggaacaatctgagatgcaagaaggaataacgagctaaagaggtcaatgtgcagctcacctaagtagacattgggtgtttgtaaatacagttttatgggaacccagccacacccatttgcttacatgctgtttgtagtggcagagttgagtggagtcttcccttggtatccacggggattggttccaggacccccaggggtatcaaaatccacagatgctcaagtccctgatataaaatggcacagcatataacctacgcacatcctcctgtatacttcttttttttttttttttttgagacagagtcttgtctgtcacccaggcttgagtgcagtggcacaatctcggctcactgcaaccttcgtctcccag

SEQ ID NO: 50989 - DNA, 1026 bp, Homo sapiens
cagctacttgggaggctgaggcaggaaaatcgcttgaacccaggaggtggaggttgcagtgagctgagatggcaccattgcactccatcctgggtgacggagtgagtgagactccatctcaaaaaaataaaaataaaaagagccatacctgcatcagccacaaaccttaacagccaggactctgaccgttaaacccttagtccaagaagcagactggaggagaaggtaactgaggttgctttctccatccccaccccatgctgtcacaaggcactgcaacagagcaacccaggccacaatgatagcttatgactcctggccttcagctcttattagacacctcattgagagcatccaagcttgctgtgtgagttggagcaagtgtcttccttttcctgaacctcagcatttcgtgtagcaaatgacagcttttgaaacgagggcccagggtccttaggcttttccaagctgattttgtcatttcactgcctccgcctgtggccagcttcgggttgggcaactttgttttgttgaaatcagtagggttcccctttgctctcctctgttctgagagtgacaacctgaggctttcaaagcagaaataggaagtgccagctccagcactgtgggtaggggacaaggggtcctctctctgaagagcctcgtggtttgttttttcctcttcctgctgggggggagatgggaggtggcgtgctcaggcagcacctggaacagctccggctcccgggcttcttccacgcctgatgcctcactcggtgcgggaggtaggcagggtggcacttgagggcacgtgatcctagaatctgctgttccaggaaagcagcccattctccgttcattgagcagacagcgattgggtacttctgggccacagcagccagtccctgccctcctcatgggacctatgtgctattgcggccagggaaccacggcaagtaagcagaccagcaagagttcaggctgacgtgtgtttcagaagatacacatgggccctgtgtccccagt

SEQ ID NO: 50990 - DNA, 1080 bp, Homo sapiens
ggcgatgccttccatcagtcggatacacacatattcatcatcatgggtgcatcggtgagtatctcccaggccccaatcttaaaagccaggaagtgcctgctccatgcctcagcttttccaactaattgttgcagggccccacaggctctgctaagttgagctcctcctcccgctcctgctagtgcgccaggatcatcccggctctacctggtgtgcatatgcacttgcaagacttttttttttttttttttttggagacggagttttgctctggtcgcccaggatggggtgcagtggcgccatcttggctcactgcaacctcggcctcctgggttcaagcgattctcctgcctcagccccccaagtagctgagattacaggcatgcaccaccacacccggctaatttttgtattgttagtagagacggagtttcaccatgttgaccaggctggtctcaaactcctgacctcaagtgatccgcccgcctcggcctcccaaagtgctgggatgacaggcatgagccaccacgcccggctgcaggacgtttctgaaccctgtgcctagccgctgaatgtagcccttaatcctggagttgcaggctctttagggactgtctagatggacttcttggggaaaacagggaatgctattcattctgtagttttttcagacctgttcatgccttaacaaatgagttccaaaggcaggatctgaggcctgatctctgcctcttcactaacacttcaagttccgtcgatacaaacacttagcttttctttgaacactgtctctttgcctcaatttcgaaagcctaccaaggagctctgcctcaccccacctggccccaattgtccagcttgtagaaccgccattctgcactcataggaaagacaaaagaatagtatagcatgaggatttccatgggaggggagggaggggtggtcctaggacagccatcgcccgagactagagcaccctcccctgtgtcccatggggcagtgagactgtgcaggggctggtggaacaagggcttcatctcaaattacacgtggtctcagttttcacttttaaccctggat

SEQ ID NO: 50991 - DNA, 1035 bp, Homo sapiens
gggatttgggttcttgtacacagatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccaggtgggtaggcatggaagggcagggacagatgggctcagccacacaagggatggcgaagacagtgctccttgggaatcttctgggggctcaggattgcttcagccttttaatggggtcagcctggaacaagaacagtagtactgggaatgatggaaagttgtattggggtaaagctcaaagctgcttattagaaggaatccattatgacagctatgtaggtttttttttttcactttccttttcttccttcccccccctccccgccgcccttcttttttttttctagaccctgaaaattgttcggacagcagaactttcgcctttcattgtgttcattgcacctactgaccagggcactcaggtgaggagaggttgtgcgcgatgggtagttcactttctccgggcctgcccatactgggacctcagtccaggtcattggccagagtgctggctggaggtcacagctccagctgggcttcttcctccagggccaagaagccaaagggtatgcacattcgttccagctcttaagccactagctaggccagtgcccatgctacctaacagggacaaaacaaaccagacccagtcatcgtcctggaggcacacagttccaggggcagagatggacagttgagcagatcctgatactggtgggatgcaggctctggcaggggaagctgtgatggacagaggtggcactgaacccgccctggggtgcagtatggctgtggggaaagacagagaggccaggaatatatcaaaaagcctaccctgctcctctgcccagccctacccatgcactttgc

SEQ ID NO: 50992 - DNA, 1072 bp, Homo sapiens
ctaacagtaggctgagcaaatatttgttctttcctatgttcactgtcacttaatctaattgtttggattagaaagccaacttcagttgcccctgctctattcacccccgccaccgcccgccccccgccaagtttgtttttcatctctttttaaattccagcttcctttgagcaactgcctctgccctttgaaccctgctgcagatgtttcctctgaaggggctttcagagcggcaggcattgccactccagcactttgtctgattaaaggccagaggctgcagaacaaaggccagacatggagtcctgggtgagtgtttattccctggctcctcctgaatcccagcagtcatccttaacagagccacttccgccctgccttgtcactggtcaggggcaggcctgccatagctctgtggcctcctatatccactacagatgatggtggctgctttgagaggatgatgtggaggttgtgaactgaactctgagaaatagaatctagtacctttgacctttattatttgttcagcattactcatgtcactgacagtatatgtctgcatatcttttctcctatgatgtgtcagtaatgaggagacatggggactagttgaaggagttctgtaagatgaggtcacagagagctgaccctccctttctgagagtctcatgaagacagggtggctcagggacaagttcacggtggagaaaattgtgctttgcttttggaaaacttactgttgcaagtgtgtactttagttaccacgttggaagtttccgtttttcttagtcatcatttgcaacttctgggtaagcgtgatagtgactcttagtcatcgtaaagaggaacgtcttgttggataagcacatctgaaagaccaacctttgggatggcaactcttgaacttttccagctggaatggttctgcctctagtaagctttgctgagtctttaatttaaaggctgacatgtaaaaagcaatcactgtaataaagctggataagaagaatatgacatagctaggcatggtggctcacacctgtaatcccagcactttgggaggccgagg

SEQ ID NO: 50993 - DNA, 1052 bp, Homo sapiens
attaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacac

SEQ ID NO: 50994 - DNA, 1046 bp, Homo sapiens
accattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactg

SEQ ID NO: 50995 - DNA, 1047 bp, Homo sapiens
cagagaaagcaaaagtatgcaaaataaagaatggggaaataactattagaagaaatttaagacattataagagactactttgcagacctctgtgcaaacaaatttcaaaatctagatgatagagataatttcctagcaaagtaaagattacgaaaaacaactttattagagatatgaaaattgaagagctcaatcttcatagaagaaagagagaacattttttaaaaagaagaaatagagaaaattataaggaactacttaccaaaaagtatcaatccccagatagtttcacagggaaatgctaccaaactttaaaagaccatatagtctcaaagtaactttgcgaaacagtgtttcttctggaaaatataaaacaaaatataaagaaactatacataaatattgtactctaattggcaaagttgtttctcaaggggatatgtgtagacaattctgaaacagccatacatgtatactaagattgaaaaaataagtaaatgaactgtaggtgggaagtacaaataatcaagaaggctaggatgaactatgtggtactggattcgattcagagacatcggtatgtactcaagtttaacttaatattgatagaggtgaatagatacaaaaataattacatgtgcgtatatacatgagtcagtatacatatgtatagttcctagccctgtgtcctgagagggcctagaagcaatagtaccctagtagcaacaagcacacccaatgctaagaccttggattctaatatcattctccaataaaaggaactagagctacttggagaaataactgattctaggaccaaggcaggggaaatacaagatgggcctggagaatctcatagcaccagaaagtaaggaattgaggaaaaaaaaaaaaaaaagatgaagtcatggcaaaggaatagaggagtcatcctgaaagattgccaaatttggaaaaattgcctcaataaaatatagatactcctcaccttctgatggggctatgacttaataaacccatcataagttagaaatattgtaagttgaa

SEQ ID NO: 50996 - DNA, 1049 bp, Homo sapiens
tatacaagtcagctctaaggagttttcacagaagccacacccaaaaatttccatttacagctcattgtccagaggtaattcatgtggttagatctaagtagtggtatataagtgtgttatctgccatagtttgcccctctgaccacccaaataaatgtatgtatccctcttctcacatatggaacacacagttactacagtcggcttaaagtccagtacctttggatgatgtgcaatatctccattagatactaatggtcaagcagtcaaatatattaaaaattatctccacccactctttgacacacccatttttaaaagtgaagattcgataacacacaacaaccactggttcatactagttcataatagttaccatgacttgaaaaaggactgaaatattgtttctacgttttattgttacaaacactgctaaaaggaattgtctttttacaaggccctccacaacggttagtcttccatattgctggatatgggaacccttccatatgaactttgttttatctactttttaaaagccttgtaaacacccacattaatggaaatggtggagtagggaattccagaactccattctttcataaaagcaatgaataggctggcaaaactgtcagaagcaactttttcagaactctggaatctaagcaaaaattacagcagccaggagaacacttaatgaataaaaaatttaaatttcagtgagagttctgtggcatttttggttaccttgagaccatcctccaaccctcagcccatcaatagtcttaaaaatggcagcttatattgcaggtgcaggttactggtaccagaggaagcgatattgaccttattttcaatgaactgtgattgtgtagtttgatctatctggtggttccctgaaggattacctcaatggtttacctttttatcacctgcactagagcttccccagggctgaggcaccttccctggtgctggttgtggaaagaattttaaagcaaatgtattagtcacagctacacagaacaaggaataacatctgggaaaag

SEQ ID NO: 50997 - DNA, 1053 bp, Homo sapiens
acctgccttctgtgttgatctcgctgggagctgcagaccaaagctgttcttatttggccatcttgccagcccccagttatttcttttgctatacagaagctttttcatttaattaattcccatctatttagctttgtttgtattgcatttgcttttgggttcttggtcatgaagtctttgcctaaaccaatgtctagaagagattttccaatgttttcttctagaatttttatggtttcaggtcttagatttaagtctttgattcatcttgaattatttctgtataaggtgagagatgaggatccagtttcattcttctacatgtggcttgccaattatcccgacattatttgttgaatagggtgtcctttccccactttatgtttttgtttgctttgttgaagatcagttggctataagtatttggctatatttctgggttctgtattcagttccattggtctatgtgtccatttttataccagtaccatgctgttttggtgactatagccttatagtctagtttgaagtcgggtaatgagatgcctccagatttgttctttttgcttagtctttcttttgctatgtgggcttttttggtttcatatgaattttagaattgtttttctagttccgtgaagaatgacagtggtattttcatgggaattgcattgaatttgtagattgcttttggcagtatggtcattttcacaatattgattctacccatccatgagcatgggatgtatttccatttgtttgtgtcatctatgatttctttcagcagtgttttgtagttttctttgtagaggtctttcacctccatggttaggtatattcctgagttgttcattttattttattttttgcaactatggtaaaagggattgagttcttattttattctcagcttggtcactattggtatataggagagctactgttttgtgtacattaattttgtatcctgaaactttgctgaatttatttaccagttctaggagctttttggatgagtctttagagttttctaggtatacaaacatatcatca

SEQ ID NO: 50998 - DNA, 1064 bp, Homo sapiens
cctgccttgctaggttggggaagttctcctggataatatcctgaagagtgttttccaacttggttccattctccctgtcactttcaggtacaccagtcaaacgtaggtttggtcttttcacatagtcctatatttcttggaggctttgtttgtttcttttcattcttttttctctaatcttgtcttcatggtttatttcattaagttgatcttcaacctctgatatcctttcttccacttgattgatttggctattgatacttgtgtatgcttcacgaagttcttgtgctgtgtttttctgctccattaggtcacttatgttcttctctatactggtttttctagttagcaatttgcctaaccttttttcaaggttcttagcttctttgcattgggttagaacatgctcctttatcttggacgagtttgttattacccactttctgaagcctacttctgtcagtttgtcaaactcgttctccatccagtttatttcccttgctagcgaggagttgtgatactttggaggagaagaggcattctggtttttggaattttcagacgttttgcactggtttttcctcatatttgtggatttgtctacttttggtcttttatgttggtgaccttcggatggtgaccttctgtgtggacatcctttttgttgatgttgatgctattcctttctgtatcttagttttgcttctaacagtcaggaccctctgctgcaggtctgctggagttggctggaggtccactcccgacctatttgcctgggtatcaccagcagaggctgcagaacagcaaagattgccttctgttccttcctctggaagctttgtcccagaggggcacctgccagatgccagctggagctctcttgtatgaggggtctgtcgacccctgcagggaggagtctcccagtcaggaggcacgggggtcagggacccacttgaggaggcagtctgtcccttagcagagcttgagcaccatgctgggagatccactgctctctttagcaccagtaggcaggaacgtctaagtctgctgaagctgcacccaca

SEQ ID NO: 50999 - DNA, 1032 bp, Homo sapiens
agttttgctagatataatattccaggttagaagtttttttttttccttcagcactttgaatacgttatcctatttcctcctggcttgtatggtttttgctgagaagtctgccagatatgtattgaagctctcttatatgttatttgcttctttttttcttgctacctttgggatccttactttttccttgacctttgagattttgattattatataacttgaggtagtcttatttgggctgagtctacctggtgttctttgactttcttatacctggatatttatatgtttctctaggtttcaaaagttctctgttattatatctttgaataaactttacacccccatctatttctctatattctgtttaaggtcaataattcttagacttgctattttgaggctattttctagatcttgtaggcaggcttcattgtttttattctttttttgcccctgaccatgtattttcatatagcctgtctttgagctcactattttttttcttctgcttgtttgactctgctgcaaagagaccctggtgcattttttaaaatttgttagttgaatttttcagctctagaatttctgcttgatttgttaaaattatttcaatctctttgttaaatttctccagtagagttttgaattccttctctgcattatcttgaagttcgttgaactttctcaagacagctattttgaagtccttgtctgggaggtgggtgtagtattctgtttgtcaccattagatcaaaagtactaattgtattaaaccaatattcatacatttattgaatttatgattgcttcttctatcagttactgaagaaggtaataatgttcagtttttacatttctcttttattcctgtaaatttttgattcataaatgttgaggctacgtttttacttgactaaggtttataaatatcatcctgctgtgttgacccttttattcttatgcagtgacctttttttaatatttagtacattcccttaccctaatgtttattgtgttcagtgtaatata

SEQ ID NO: 51000 - DNA, 1032 bp, Homo sapiens; identical to SEQ ID NO: 50999

SEQ ID NO: 51001 - DNA, 1032 bp, Homo sapiens; identical to SEQ ID NO: 50999

SEQ ID NO: 51002 - DNA, 1069 bp, Homo sapiens
gacttcatgactaaagcaccaaaagcaatggcaacaaaagccaaaatagacaaatgggatctgattaaactaaagagcttctccacagcaaaagaaactaccatcagagtgaacaggcaacctacagaatgggagaaaatttttgcaatctatccatctgacaaagggctaatattcagaatctacaaagaacttagacaaatttacatgaaaaaaaaaacaaccccatcaaaaagtgggcaaaggatatgaacagacacttctcaaaagcagacatttatgcagccaacaaacatatgaaaaaagctcatcatcactggtcatcagaaaaatgcaaatcaaaaccataatgagatatcatctcacatcagttagattggcaatcattaaaaagtcaggaaacaacagatgctggagaggatgtggagaaataggaacgcttttacagtgttggtgggagtgtaaattagttcaaccattgtggaagacagtgtggagattcttcaaggatctagaactggaattaccatttgactcagcaatctcattactgggtatatacccagaggattataaatcattctactataaagacatatgcacacatatgtttattgcagcactgttcacaataacaaagacttggaaacaacccaaatgcccatcagtgtgaaactggataaagaaattgtggcacatatacaccatggaatactatagagccataaaaaaggatgagttcatgtcctttgcagggacatggatgacactggagaccatcattctcagcaaactaacacaagaatagaaaaccaaacatcgcatgttctcactcataagtgggagttgaacaatgaggacacatggacacagggaagggaacatcacacactggggcctgtcagggagtggggtctaggggagggatagcattaggagaaatacctaatgtagatgacaggttgatgggtgcagcaaaccaccatggctcatgtatacttatgtaacaaacctgcatgttctgcacatgtaccccagaacttaaagtataataaaaaataaaataaaa

SEQ ID NO: 51003 - DNA, 1029 bp, Homo sapiens
agacctttcatggcagtgcatctgacataatgtcttttggtacatggaaacatgaagtccatgcattggaatcaaggacataccaggaaactcaaggggtagtttcacctactcttgaccctagaccacctttgtttgacctaaactttacttcaaccttgtcctgccctgcttttcagtaccacaagccatacccattatggtagatacactgatgtaattggctatgccctgcctgatattattgtctctcaccaaaggccacagttgtcactgcctttcagactccaaattctttaaggtcttccctttcctctcacagcatattgttgacagtaaatacatataacagtgcttattctcctttcacagacaaaagatctgaaatgctctgcttagtcaattattataaactatttctgctttttgacttcactgtttatgttcgtataatgcttgtagacactttgctttaactcataccttttccttttggattgtagtttttgctccttcatactctgaaactacctctattctggcagcacattttaaacccactttggctaatgcttttcatgttctcacctggtaacttaaactctactacctagatgctattggcaatccattttggcctatgttaggatctatacataactagcccattgatggtaaagtatatgttagtgactagagcagaggttgacaactgtccacattggggctgaatatggcttgaagatgtgtttttggctcatactgttgtggcattgttgaatttagtcattgtgatgcccaccacaatgtgccactcatatctcctactaaagggagtatagctgactgagggcccagctgctgtgttctatcatccatcattgtttctttcttccaaggctacacttcccatcaactgttccaaactactgaatgaccatggcaagaatactaatgagagcccattccttggagacccagactcctttaatggccacctttggcttgagtattccccaacagccttcc

SEQ ID NO: 51004 - DNA, 1058 bp, Homo sapiens
ttgttttctggttgttttgtatattttttgttccttttgttttctcttattgtttgttattttggtgtggtgattttctgtagtggtatcatttgagtccattctcttcctcatttgtgtgtagggtttactagtgggttttatacttttgtttgttttcatggtggtaaatactgtcattttgctttcaggtttaagactcgagcatttcttgtaggactcatctagtggtgaaaattctctcagcatttgcttctctgaaaaagacttcatttatgagggaaatcataaatttcccttcatttatgagtgaaaacgttgctggggatagtatccttggctggcagtttttttttctttcaggacattgaatacatcatctcattctttcctgtcctgtaagacttctgctgagaaatctgctgttagtctgatgagagttcttttattggtggctagacatttttctcttgctatttttagaatcctgttttatctttgactttagagagactgactataatgtggtggggagaaaacctttatgcattgtatttctggggatgtttgagccccatatagacatatggatgtcgaagtctcttgctagacttgggaatttttcacctattatttcattaaataggattccatcattttgttctctcttcagccttgagaacactgataattcaaagatttgatcactttatggtatcccaaatgtcatgaaggttttgctcattctatttaattcttttttatttatttttttttctgactggattatttcaaaagacctgtcttcaagttctgaaattctttcttctgcttgacctaatctattgttgtaactttcaaatgtattttatattttattcaatgaattcttcagtttcagaatttttgttgggttcttttttaaaaaaatatctatttgaaaaatttctaattcatatcttgaattgtttttctgatttatttttgtttttcagatttctcatttatcttgctgagcttctttaaaatttgtattttcaatttgttatctgggattt

SEQ ID NO: 51005 - DNA, 1079 bp, Homo sapiens
tttgataatagccattctaataggtgtgaagtgttccataaattttggtatattagttttattttcattcagttcaaaaaaaatttccccttggtttcttctttagctcatggattatttatatgtttttcttaatttttaaatatttgtggatttcccaaatttctttctactattgattctaatttaattccattgtgattagagaacatgctttatgatttcagtcttttaaatttatggggaattattttatgaccttgcatattgtcttttctgtataaagttacatgtgtgcttaaaagaatgtgcgttttggagtgaagtgttctattgatgtcaggtagtccataagtatatagtgttgtctaagtcttttatttcttcactgattttctttttgttatatccattattaagagtgggattttgaggttttcatctattattgttgcattatttctttctttctttaattctatcagtttctttcttcttcatgtaccatggggctctatttgttagatgcatgtatcattttacttttcacatttccctgaggaattgaattactgaattataaaatttttctcttttaaaaagtctatttagtataataacagtgtagtcactctagctctctttaaggcttacctggtatatctttccccatcctttccctttagcttgtttctttgactgtaaagcgtgtctctcatagtatagttagatatatattttttcatctagtgtttaaaatccagcctgatagtttctcccttttgatttgaatgtttaattattttatacttaatgtaactgtttacatttagtctgtttcaatttctgcctgccagtttactatttttcatctacatataccctgtctttttgttcctctgttcttcctgctctagttttttgtgttaaatagctatattctaatatactgttataattaatttttgatgtctttatcatatacatgtatatttttaattattttcctactggtttctctagggtttataatgtgcatcttattttaccacagtttacagaagattaatgctgacttc

SEQ ID NO: 51006 - DNA, 1387 bp, Homo sapiens
gccacagcttcatgaattttctttatttacaatggtccttaactgggtttatttatcttgaaatggtggacaaccacagttgcagacctcaatctacatacagtacatatcaagtaactaaacatttccttgtaatgtcatgacttttctctgcttcttggaagcacttccaacatcacaagtggcactttgtatggatcccatgatgtttaaggtttatggcattgcactaaatacaatgaaaaatatgtgagaatcatgagagatcacttcttactatgatatgcaatttactgcagacatgaactgctcttgtggagatgattagcatcacacagctttttaggtggatactcataatacctaagcccacccacaatggcaacaagaggtgtctatgaaattattatagtagtataactacagtaaattttatgcagttatgatttaatactgcatctttatatttgtttacatttatcttgaccgtgaatggcatcatgtacagtctgtgtttgtaaattttgacaaattttaactttttataacatatttgtatatattttgtggtagtaaatgataaaatggactagcatctaaatatattttatgcattcgtgacatacccttttcttaaatttttatatttctaggccacatggtttgtaagtttttgtagattgttgcaaatttcaaaaaatttttcaaatatgttgaaaaaattctgtgtataagtggacccatgcagttcaaaccatgttgctcaagagtcagctgtactatagatttttcactttgttgttatcataaggcttacataaaacatcttataataggtgaatttaagctgataagaacttaacttttatcacatatagctctacacttttattcccctgaacacacacattttggttttggtgtcaaaatttacagcattttgtaatttatatcccttgataatttattttaattatagttatttttcatagttttgacttttagccattgtacttgaggtaaaattgctttacacaccatcattatactcctattctatatgtaactgtattacttataccattaagttttgcattttcatatgttttatgttattaattagtggccttctgttttagcttaaataactccctttagtaattcctgcagggcaggcctagtggtgatgaactctcttagcttttgtttgtctgagaaagcttttccttctccctcatttttttcttttttttaaaaattgcttcctcatttttgaaggacagatttgccagttaaagtaatcttggttgctgggtttccccctccccactttggcactttgaatttatcatcccattttctcctgacctgcagagtttctgctaaa

SEQ ID NO: 51007 - DNA, 1026 bp, Homo sapiens
ctttatatgtctggtagaattcagctatgaatccttctggacctgtgtttttttctggttggtaggcttttcattactgattcaattttggaactcgttattggtctgctcagggtttgtatttcttcttggttcagtcttaggaggttatatgtctccaggaatttatcagtttattctaggttttctagtttgtgtgcagaaagatgttcataatagtctctgatggggttttttttttttttttgtatttctgtggggttggtgatgatgtcccctttatcatttctgtttttggttacttgtgtcttctctttttttctttgttagtctagctagcagtccatctgtcttatttattctttcaaggaaccagcctcattgatttcattcattttttttatcattgaatgctataatctttcctcttgatgctgttttagctatgtctttgagattctgacatgttgtatctttgttgtcattagtttccaagaatttattgatgtctgacttaatttcactgtttactcaaaagtcattcaggagcaggttgtttaatttccatgtaattttatagttttgaccaatcttcttggtatagatttctatttttattgtgctgtggtctgagaatgtggctggtatgatttttgtttttgttggttttaaaaatttttaatttgctgagaattgtcttatggctgactgtgtggtcagtagagtatgtgttatctgcagatgagaagaatgtatagtctgttgtttttgggtggattgttgtgtagatgtctgttagctccacttgatcaaatgctgagttcaggtcccaaatatctttgttagttttctgcctcgaggatctgtctaatactgtcagtggggtattgaaatctcccactattattgtatagttatctaagtttcttcataggtctctgaaaactggttttatgaatccgggtgctcctgtgttgggtgcatatatatttaggatagttaagtcttcttgttgactctttacca

SEQ ID NO: 51008 - DNA, 1034 bp, Homo sapiens
tgtacccagcgctgcttttgccttgctctgtgaccccaggcaagctgcctcacctctctgggccagtttccccattgtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggccagcaccttgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcgtagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaaccaacagtgtgcttttaataaaggatctctagctgtgcaggatgcaaacgtctcggggtcagtgactgcctcctgcccctgttggtcc

SEQ ID NO: 51009 - DNA, 1067 bp, Homo sapiens
cgcaggcgcgtgccttcggagcgccgggtgggctgcgggcgcggcgggactcccggtcttccccggggcggacaccggcgtcaccgcgtcctacggagccgggcgccgagcgggaggcgcatctgggccccaccggggctgcccgcaccgagcacgcgaacgcgccctcccgccctgaggccgccggcgttgcggtcggagaaccatagagccactcggctgggcgtggcgcggcggggcggggaaaggggcggggcctgggcggcggaagtgcgcagccgcgcggcattctggggccggaagtggggtgcacgcttcgggttggtgtcatggcagctgcggggagccgcaagaggtaagccgcgggtccgagggccgatttggcctcccggtgggtgtctgtatccaagggggcttttcttgctcctctcagcggggctggggcgagctgggcgtgcgggcagctgtgactcctgcgtgacccgcaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggc

SEQ ID NO: 51010 - DNA, 1265 bp, Homo sapiens
tcctgcagcgacctgctcaaggccgcccacaggtacgtgctgcagcacttcgtggacgtggccaagaccgaggagtttatgctgctgcccctgaaacaggtaacagctggcgggcccagccctcgccccccaccccaccccaccccagtctttgtctttgactcccgaccccgttttgttcctgacacagccctgcccacaatccttagtgcctgctgtgtgtccccgagacctttctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactcccaggttctggaactggtctctagcgacagcctgaacgtgccttcagaggaggaggtctaccgagccgtcctgagctgggtgaaacacgacgtggacgcccgcaggcagcatgtcccacgggtgaggcgcggccgcggggggctcccacagcatccaggagggcatgcaggtggctgagggcctggtgcaccctgaccttccccgagttcagggactccgtgggggtggtgcccccacctgtctgaagaagaatccatcacacaggtggtacgggcatctggggggttgtctcagccctgacgcccagtgtgcccgagggtcccgcctgaccttggcgttccctgcaccccagctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggtatggccccccgcccgtttccctcttgccctgtgccttctactccccaccagcacaagcccaccccacctgtgccggtcaggtcctgacctgcccctccgcccctccattcaggggcctctccaggagcctggggtgtggcccagcagtgggatccactcacgagtcccgtctccacctgccctccccaggcggcgggagcctgtttgccatccacggagactgtgaggcctacgacacgcgcaccgaccgctggcacgtggtggcctccatgtccacgcgccgggcccgggtgg

SEQ ID NO: 51011 - DNA, 1038 bp, Homo sapiens
ccgaccctcgtcacggcagagggaggggggcgaggcaggtgcttgaggatccgaggctggtggggccggggcccgacagccacagcctcccaggctccgggccccccgtgggccccagttgctgtctggggggctgagggccgggctgaggcctgtcctgagcctggcttattggggctgggcccagccacggagaagcgcactttcttcttcctggggacttgggtgagacccagtgcgggtgccccagagcagcatccgggggcccctgctgagggctcagacacaaccgcctccatctccaccacatcaggcccagctctgcgggtgggaggccaggcgaggccagcggcgtcggctctgggaacaggtgtagacacaagcccgctggactcggtcatcctcggcacagcctccgagacaggtggagatgaagccacctctagcttagccactgggcctgctgtaggcaaggccacatccaggccatgtttggaggcaggtgtggacacagccacgtccgtgtccaattgtggcttggagatgggtgtagacagagccacactggactgaggctcagaagctggtgtagacacagccgtgtcagattgcggcttggaggcaggtatagacacagccatgtccctgtcaggttgcggctcagaggcaggtgtagacacagccatgtccgtgtcaggttgcggctcagaggcaggtgtagacacagccatgtccctgtcagattgcggctcggaggcaggtgtagacacagccatgtccctgtcaggttgcggctcggaggcaggtgtagacacagccatgtctgacttagcccttgagacatctgggagggcttcccagacagtcgtggacactgtgtgcagcttggctcggcgcggggttctgatttggtctgtgccttgctctgtcacagggacaggtgtagacaggcccaaacctggccctggtctgtcttcctgcacaggggacctggggccaggctcaggagctcctgcaggacctggccccaactcctcc

SEQ ID NO: 51012 - DNA, 1204 bp, Homo sapiens
caagcccctgtgttagcccagacctccgtctagacgggcccgcgtgtcgagcactcctcgccgtggagatcgggcgggagggcgaggctgtgcggcgagggcttctgcggatgtggagggtgtggcatttgccatcgtgaggtcttgcttgctgttcccatggctctgccgaagggccgaggagtggccctccctgaccccagcctggtgggggcagaaatcccatggcagcccccgcaggacaagtcccagttggggactgagatcgttggctggggaatgtggcagggaaaatataggaggtccctgtcgcccccacatcctgtctgctccctcatggctgcctgggaagggatgtgtcggtgggggggtctggagagtgcttcctcctcaaggcaacggtaagggtcctgacttcccgtctctccgatctgctccgttggccggcaggaaactttgctgccctgacactagcctggctcttgaggggtccttgtggggtcctggactgtccactgctcttgccttctctgtgcatgcctgggggctatgcagggggaggggcagcacccaaaataaggaacgctgcggccttttccccagcctgtggtcagtggtccccaagctgccttcagggtccagggcctcagtgcagcacagaggagggtcccctgggtcccccactgggaggacatgataaccttggtcctcttctgggcactcatggtctggggaaaagatgggggcatcgtggactcaggataggctgtcaggagctgaggaggggctggagaagggggttagggcgaggagaggttcctgtccctgcaagatcaggagagggggtcactaaccccacagccaggtgggtccagcccgagagtccgtgacttagtagctgaggacttgctctagggtcagagggcacatggcaggagagtcaccccggctgaacgaggctctgcatcttaccgaagccgctctacgggtgccaggcactggctctggagcgagtgcccaggcggagcagagcgctgggaggagggtccgtggggagcccctgccaggtgggtgtggcttagcccagctgtgggcagtcgcactcagggacgagctccaggtggggagcctgggacccacagccagtatgcagcttggggagcacccgggaggggctgtggccaccggaccccctggggtgggg

SEQ ID NO: 51013 - DNA, 1007 bp, Homo sapiens
gggctcggtgcttcccgcctgcgtgaatggacttgtcccgtctttgacttctcctgggcttgcccctgccttggcctgggggggggctttgctggctgaaaccaaagggagtgaggtggtgggaggggtaggggaatcgggttggtcagttctgtggagatgacctctttgagagggccgggctgagctggtggaaggaactcttggctttttccagaccccaccccactccctcactccccacccagagaacagccctggctccattgttcctgcagactagagagggaaggttgttttggaactgggctcgctcccgcttgtccacactggccgctctggtggggcctctgtgggtggtggtggggatggcacctgctgcagcctccaggccaaggtaggggagaaggaggttagggtgaggacaggttcctgtccctgcaagatcaggagagggaatcattagccccacagcctgcagaaggcgggatggggctgctccagggaagggggtgcccgtgcctcggggccacaggtccggccagaggtcattccagccaggcccatgcagcttccttcctgaagggctgactctgcccccatcactgcaggagggtggaaaacaactgcagaagcagacgccccacgcccagggctttgcttccacctgtgggacccaggtccacagccccaccagcggcctgggtggggcaggaacggaccccctccctgcagtcctggttctggcaccccctccccacttggactgggctccccagggcccccgaagcccagcggggctggggctgcagacggaaacaccgtggtggcctgcccacctcaggatggaaccccggggtcccaggaggtgcctgcccctcagagatgagaaaaaggaagtgcagggctgagatatcaccccatggacagtcgcccgctggaggaggaggctctgtacccctgcacctcctgcctgctgggtgagctgctgggagctgcactggggc

SEQ ID NO: 51014 - DNA, 1044 bp, Homo sapiens
actgcccctgggactcagagctgggaggtgagaaatggggaatgcatgtgaaccacctgcctctgcacacagcaagtcctgttctgggttttctcatccctgggtcacaccctgcgctggggagataaaaagtcagaccctgcccggggcacccacagtcagcaccgccggaacactgtcagcctggtgtggacagtgccaaggtccagcagggtggggtggttggggtaggagctcccctgaggagagagtgaggccagcaggggtgggtctccaagtgcttcctttgacagctgctctggatgggacgtggcttggggtgggtgagaacccttggctgagtttggattttcctgcagggtttcattggaacaccaggttccagggccgtagagatgtggaggcctcctgtctgggtgatggggcatggtgctggtccctggctgtggggtggaaaggagtcccaagagagggagctggcaagacaggaccttcccagctaaggtggggttggtgggatttggctggggcccttggaggagcctgaccaggaggtgagacagggcacctggaaggaaggaggcgttggggagagtccagatggaggccatggggttgaggggcccagacacccggctgggggactccaggaaggcagcaggtgtgggcagtgggtcctctggggtggactgaggtgaggcctgggtgtgaccacgcggtggcactggtggctgccggcagctgtcgtctgcagagtgggtgagaccgagtgtggcagatggcttggtccgcggtgctggaggggactggcggagcagaagcgccctggcgccgggtccttgctttcctggagctggggcttggggaatggggtcggtcattgcagggacagaggagagggcagggtaatgggtgcgcaggggtcccttccaaaggctgcgggtggccaggggtgtgcgggggcgctgaggtgcggtcgccgagagattctggcctccagggtggtcgggcctggcatggactctaggggatggtgcacacacc

SEQ ID NO: 51015 - DNA, 2661 bp, Homo sapiens
cccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactgtaggtggccgcgggcggggcgtcgcactggccaagccccaaccccgaggcccctgcacatagaggctggaggccgcggcgggtccgcggggctcccggcagcttcccggggatgggatgggtcactctgcggacccctcggtccctggaggccgtccttgggctctcagtgggcctggccctcacccaaagctgcagaaacactttctgcgggagctggggagggaggggcagccggctacactgagagccggcagttgggggtagggcaggacctgcggtggactcttccagggaagggggtcctgcctgcacccctgtggctggggccccatctgacaggggtcaggccatgactatttggctggaggggcagagaaaagcaggggcctctgtctcagacctcagccagcccatggggtcagggctggacccttcagcagcctggatccctggggctagcggtgggggggggggggtgggcaggggtgcccctttccaggctgggcaaagggatgggacagggaggagcctgctcagaggagcctaacttggggatttgttttcttccagataaacccgggacccacttcactccagtgcctccgacgcctcctgatggtgagtagggctgagttcgggggacctggatgggctgtggcactcttgggagtcaggggccatttggaggtgtgcacccagacgtgtggagtgtgtctggagtgaggaggaggctggacaagggcacctgcgtctgtcctgggagtccgcagcggtgggccgcagtaggaactcggggtctagaggccgccgcctgacggcactggacctcggctctcacttctctgggcctcagccccctcagcctcaaaactgggaacaagtcctgggacccacaggttgtgaggtgatgtcagacctgtagggcagggccagagtccggtcagggggctccgctctattgtcctcccttctccctgttcagcaaggggtggggctggacagaggctggaagtggacaggagcttgcagggaaggctgagctgggggagggccctgacctgatcagtgacagctgtctggggaggggcctggagggcggcagtctgtccctgggactctgcaggctgtcatggggggacacaagtgatggagggggcgggctgaccttgttgacctgctttgtgaggtggggcctgtcctccccggggtgctcctggtgtttgggccactgtcatcggggtggtgtgagggtgtgaggggaagagaggaagtggtcagctttgcagaggaacacagacggggggaccggtggctccctcgccaggcctggggtcctttccagcaggtggggaaggagcacctgccccatcactgggtctcacttgcgttcagttgtgtgtgcagggctgtctgtgagggctgtgctgaggccttcctgaccagcacatggggtgggaaggacgacctggggaatcctgaagtgatctgaagacagagccctgggctggatagatcgtctcggccactttccaggtcttgggagtgggggatgatggctggaggaggtggccaggccttggcagggggccctgtgatgcccgcctgtgctgagaggtgggggcagcttgggatgctcagtggtctgaaagatagggtggggtcttccctcggagtgtggagtttaggcacctgggaaccggagctggattcaggggtgtgagatggaggccctctgcttcctcgaccgcctgccaggctggggtgacctgtagtcagctgtgctttgctcctgaagccgcacaccagcaagtgggcagtggttctcccacacttggctactcaactcctggtcccagggactctggcctggggcagcgctgggcctggggtgaggagctgggcagcgggaatggggaatggtggctgtgggaacccgtcctacccctgggctctagccctgcaacctgtctgttggcccccagcccctgatggccctccaacacccgccccccaaccccaccaggctgttcctatgagatcccaaaggctcctcagagcaccaggcttctcttggactgtggggagaggagaccggtctgcgtggccaaggtgattgaggcctctgaggggcctcatgccggtggggttgctgtcccccttcctgagactcaggagccctgtgggtcagggcagcacagcaccatgggtggtttgtgacctgaggcatttgaggggacacgggttgcaggggcctgcaacaggctgggagagcaggtaggtgagcagctggcttgtcctggaagaccctctccct

SEQ ID NO: 51016 - DNA, 11666 bp, Homo sapiens
tggatgaggagcatgcccgccatccaggaacagtgcccttggccatggtgtcagggccttgggagaggtctggctgagccaaggtgaccaaaaggggagaaaggctcaggagccctggtgcagggaggtgactgggtccttggccatggggttgggacctggggggaaccattggtccacaggtccagccgaagcccaggagaacagctggctgggcatcagcaggtgcccgttggatttggactgggagtcccagggccttggacaaggcagggccaaagggagagggagatgctgaggggagagagaaggggaaccagaagggaagtgaaagggccaggggtgcatgtggtttgagtttgatttgagccaggacgggggaaggccagtggtgatgacagccctcatgactatacttacagtggcagcagacgggccacatagcgctgtgtgctgggcaccctctaagctttgcagatactggcccatttaaccccacaatcctgggaggtaggtcctattgctcctattcaccgaaggggatactgaggcccaggcaggtgataacctgcccacattctcacagtgggtaatgcagagctgagcagcctggctgtaagacctgaggtgggagagtagcagaagaggggtgggggcacagccaaggtttggggaggaagacagggatctggtggggggagcatgggtaggttgcagggatggcaggcggatggccctcactcagccttctggggtgggggcagggacacccagacagacagcgccagagcctggggtgggctgttgctatagcaacagctggctccagctcccagtgcacccaccctccttggagatggggggggttcctcctgccccatttcacgagcctgctgggaagtgatgggtggtagccacccctctgacatgacttattaatgataattggacccaattaaacatttattaaatccagacagctgcagccgctaacggacccttccctgatcctgggtgggccatgctgggggtgggggtgctcaggatgggctgccgcaggggctctgggttttaacgtgcctgaggcagctttgttggccacgttgaggtctggtgatgggacgtgtgtcaggcgctgtggtctgcagctgtaagaactaaaatgagcaacagttcctgcacctctccaagaaggaagttcgctttgacagagagtgagggcgatggaggaggcaagagtgaggtggggggccgggggatgcccagggaggagggggcgtgtgggtgccccagggatcccagggagcgatgggaggctgcagaagggcacaggcctgccgcgggtggggggctggccagggagaataggagatagtagaggcggaggccaggaatttgcacttctccagggaagctggggaagagttggggagagggaggcaagaagattccccacccatcttaggcgcagggagcggtcagggaggcgccagaggtgggccagagctgtgacctggcctcacaccccgtcccggtggggctctcaggcccctgagggccagacgcgggacctgggtgcgacccgggcgggaggcggcagggctcagctgtgctggacgctgcagcagcgcgggaaggggctcccccggctccatggggtgaatcggtgaggggctccggtgccgatgtggaaggagctcctgagcagaactggggcctggactgcttgtgcccgagttggtttcgaggcgtctctgcttttcgctggaggcccacgaggtgggtgggaagtgggtgctcgcccgtcgcagaaacagagtcgggtgccgcctgcggcagacgcccctctccgcgcctgcaggtgcggggtgggggagaaaggtcatccctggagaggcccggggctggcgggaatcctcggcgggcggggtctgcgaggggcagggccggtcctgtgagcgcacgcacgcgtgtccgtgtccgtggtggacccccgatgcggcgcgggggcgggtgaatgcgcgggctgcgagcacggcaaggtctctcaggcttgtggacgtgggtacgggcgtctcggcaccctgagctttctcccctacccgccccagcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggtgagcggggcggggccggtgcctggggcggggaggggcggggcctatgagatggagcgaggctgggaggggcttcggggccagtggggcgggggcaggggcggggcccggcggggaggagcggggctgggaggggcctggggggcggagcggggcgggagcgggggcggggcctgcggggcccggcggggaggagcggggctgggaggggcctggggggcggagcggggcgggagcggggcgggagcgggggcgggggcggcccgtctgaccggcaaagccccgcccgcaggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtggtgagcgcggcggcgggcgcacggctcgagctctgtgggcgcgcggcgacagcgtcctgactcctgccctcgacccccagacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgaggtgagcggctcccccgggggagggctccggccagtgccagggtcgaggtgggcggctcccccgggggagggctccggccagtgccagggtcgaggtgggcggctcccccgggggagggctgcggccagtgccagggtcgaggtgggcggctcccctctgggagggccgcctgctcccctgctccctgcacatcccagggcagggatggagggtgctccagcctctccgtgactccctcacccctgcgtcctagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtggtgagcgccccggggtggaggccaggcggggtgggctgctcctgcgtcagtccctgcctggacatcacatgccatcttcatccatcatgttcctcttggggtcctgggagtgggccggtccctctgggaaggctctggggagggtggagcctgtgtgcggagggtacctggatacctgggggctggtgaggcagaggcggggccttgtccaggctccctggtccctgacctcagccacgccctccctgggagtcctctggcctgtccgcatgtctccacgctgtaagcacaggctgttggggtgggcaggctggacacaacaccagggtcctcactcttgggacatgggcagccgtcggccgttttggaggcagtgtcaggacttgaagggccagggggaggcagtggccgtcgtgtcccgtcgtgttcgtcttggtcagttcgcccatcttctggtctttctctctgcgtctgtctcttctctttggtctcttcttccctgtcggctccgcctcttgtgtcttccagcctgacctgctggcaggatgaggtgccgtgcctgccctccaggagcccgcagcccgaggtctgcccctggtgcggcagggggggtggcttgctgctgcctggccttgtggtcctcagagcaagtggacagacacctcctcccccgtgcagccctgggtgtgactctgggggtgcaggctcctcccacccacagagagcccccccacatgcatgggtgtcctggggatgctggtggtcaggggtcagtggcctgggcaggctggggaagcctggccctcccatagcctgctgtggacaatcaggaagccccaagcttgggggcagcctcgcccgcagccaccggggactcctgggtgtgtgttccgctcgcctctgccgcgtgtctgtccctttctctgccgtgtctgctgtgcatctggcccttctcctgtgttctctcttcctccaccatcccctccctggaagagggactgctgcgtggggctgggggctttgcctgcagcggagggggggcttgtgggaccactgagcccctgtgtccttcccagaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtggtcagtggcgggtgaggggtctggtgggggtcggggagagagaggttcctggtcgcctggtgatggaagctcctccccagaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtggtgagtgaggccctggggccgggcgggccagggtcctgtgcctccctcagcctgggcctgccgacccctgcctggctctgtctcctgcagagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcagggtaggccgggggacgctggcgaaaactgctgggctctggctttggacaagaagcccctgggtgactctgctccccttccccgcagccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgagctctgtacccctggctctcggcgggcggcggggacggggctgcggccgctcacactgacaccaccctccaggtgtgcggctcagatggggtcacctacagcaccgagtgtgagctgaagaaggccaggtgtgagtcacagcgagggctctacgtagcggcccagggagcctgccgaggtgagccggctgcacgtggggtctcaggcacaggcggggcggcgtctgggtttccgtgtctggatgtgggcgtgcccgtgtgctgcgttgggcccctgtggacgtgtgtattgtgttgtaagtgagcatcgtccagtgttggtgcctgtgcacatttgtgcagctgcgtgtgtgggcgtgtgtgtccatcagtcagtgggcgtgcaccaggccaggcctcagtgctgagaggcagcgtgaaccatgcggggccccaccgtgtgggcactttctctgcatacgtccatccggtcgatgtatcacatcaattaggtaaaagtggtgcccggtgtgtgtgatgcgcgtgcacagatgtgtgtctgcagaggggcgttaactgtacggtttggaggaatgtgggtgagaacgcatgctgacgtcttcagatgtctgtttctcgatttgcaaggaagctcgcgtgtgtgtgtgcacagagctgcgtgtccgtgatctttggatgctctgtgtgttgtgtgttcctggatctgcatttacagacatgttcttgcgtaagatgtgggagcctcacctgtgtcctcagccccaggctcccgggctcctctgggagctgggatcgggacggctgagtggtgacagtgggggtaggtggaggcagactggctgggtccagggtgggtgtccagcactgcatgaaatctgagtcccgtaccctttcctgcaggccccaccttcgccccgctgccgcctgtggcccccttacactgtgcccagacgccctacggctgctgccaggacaatatcaccgcagcccggggcgtgggcctggctggctgccccagtgagtacctgagctcagccccgaccccgggcctggtgcggctgtgcggccacgtgaccttgtcctgccctggcctttcaggtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacacgtgagtgacagggcccaggactggccaccggctatgccctcctacctgttcacccccatcactgtgcttctcctcacctgcccaggccctggcctgacccacacctggctgggggctgggcagagccagggttggggaccaggctctggaggaggtggggaagcccgtccaggtgcggacatcacgttcctccccgattttccccaaagcctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctggtgagtgagggccagcgctaccctggggcttcatggggtggggtggggtcacccgagccacagaggtttcccatgcccgtgccccagacgcttctgcgcctgcgacctgtgcggagatgcgctgtgagttcggtgcgcggtgcgtggaggagtctggctcagcccactgtgtctgcccgatgctcacctgtccagaggccaacgctaccaaggtgaggggtgtgggatgtgaaggggagtggggaggaggcctcgccttgaacatccttgttctctgccccaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgccctaaatccagccccacccgccctgagccacctgaccctgtcccaaccggtccccccgccaacctccctctccttgcagaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctgggggtgagcagggatcaaggacttggggtgggtgggcaggcgccgagaggctccaccagagcctgggctcagagcgcgtctccccagggctcgagcccttggagggcagcagcgtggccacccctgggccacctgtcgagagggcttcctgctacaactccgcgttgggctgctgctctgatgggaagacgccctcgctggacgcagagggctccaactgccccggtgagtggacggctgggcgaggggagtgtgaggatagcctgggctcggccgaggtgctgccccctcgcctgggcagcaggtcagtgccgggggttatggtcttgggactcggccccctcaaacatgtgcgtgccggggaccccacgcctaacccgtctctctcgttgcaagccggtgtggcacactgctctgaggagtcctcctggtaaccgacaccagccccaccctggggtccccactaacctcatgaccatctgactaacatccaccttcccttgcacccttgtggcttgctgctggggcctgtgcctgggccagcctggatgccaggcagatgccaggcagggcctcactgtacctcccccacagccaccaaggtgttccagggcgtcctggagctggagggcgtcgagggccaggagctgttctacacgcccgagatggctgaccccaagtcagaactgttcggggagacagccaggagcattgagagcaccgtaagacgggggcgcagcccccacctacccactggccttcctccccagatacccagagcagcaccagggcagcccggcttgggcggccccccaagtccttgcctactccctgccacagctggacgacctcttccggaattcagacgtcaagaaggattttcggagtgtccgcttgcgggacctggggcccggcaaatccgtccgcgccattgtggatgtgcactttgaccccagtgagacctgcaccctggacccttcctgggaggcaatgggtgggggatgcctggggctctgccatgctcagagctccctcctccccagccacagccttcagggcacccgacgtggcccgggccctgctccggcagatccaggtgtccaggcgccggtccttgggggtgaggcggccgctgcaggagcacgtgcgatttatggactttggtgagcgccaggccacgagccacagcttacctgccccctcctctgcccatgcccctgcccctcaccccttcctggccctgctcccaggaaaccctaacagctccctgtgccggcagactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaagggtaaggatgtccactgcagaggagggcggggaggcagcagggtgggggcaaggattgggggtggggctaagccaccatcaggctttgagttgggggcaggagcccggattaaggcggggtttcggccagatgcggtggctcacgcctgtaatcccagcactttgggaggccgaggcaggcggatcacctgaggtcgggagttcgagaccagcctgaccaacatggagacactctgtctctactaaaaatacaaaattagccgggcgtggtggtgggcgcctgtaatcccacctcgtgaggctgaggcaggagaatcgcttgaacctggcaggcggaggttgcggtgagccaggatcgcgccactgcactccagccggggcaaaaagagcaaaactccgtctcaaaaaaaaaaaaaaaaaaaaaagcagggggcggtttcagggataaaagtggggaatcctcggagcttttccagccggccctcccggtcgccctttgcagtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtgggcggggaggggacggggccggggcagctcaggtgggcggggaggggacgggcgggggagggggggccggggcagctcaggtgggtggggtggggacgggggcggggcagctcaggtaggcggggtggggacggggccgggcgatggtcctgagcacctgctcctgccctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtgtgagtcccttggagggtggtgtggccccgaccccggccctttggggtcccggtgtacgaggtggctttgcctgtggcccctgagccctgacccggtgtccctcctggtggcagggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggtgagggtggggccggggcgggtgggagtgggaccccggggcctgtgggcggtacccaaccgacgcctcctgggacctcggtcccggtcccgtcttcctccatccaggaccaacctgtgccgatgagaagagcccctgccagcccaacccctgccatggggcggcgccctgccgtgtgctgcccgagggtggtgctcagtgcgagtgccccctggggcgtgagggcaccttctgccagacaggtcgggggcgtggggctctcggggcagggggggggggggggttgaacgtttgggcgggtacaggttccaggtagcattgcagttaggatgcggctcagtctagtctgggttttgagttaggatccacacacggctggcatggggtgcaggaggccccgggggtcaggactgaggccttggtg

SEQ ID NO: 51017 - DNA, 1226 bp, Homo sapiens
aacccctagggtagctcctcccccactaaggaccctgccatttctgtgtgattaacgctgccccctagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaagggtgagcctggcacagggcagggggcggaggccggatgggcccggagcccacgaggccccaccctcacctgcctatctcacagggctggtggagaagtcagcgggggacgtggataccttggcctttgacgggcggacctttgtcgagtacctcaacgctgtgaccgagaggtaacgtgccatcctctgctggctgtcggttccatctgtgccctcggggcgggacaccggacccccacaccaggagggcccaggaggggacggcccggtgctgccacctctgtcctcccgcctctctctcacctcccggtcctcccgcctctcactgtctgtctctttgtttccaagcgaactggccaatgagatccccgtgtgagtagagctcggcgccccccgctccctctcactcccactcctccatccttcctggtggggagcagagtccggagcccccggggaactttccatcccttgtggcggaggatgggggtccggcgctatttggctgcaagaggccgtttcctgcctcagaagtgcagtcgcccctcccagggcacaggccgagggtcgccccacagccaacccccaccactgaggctgtacacacctgtgcgcatatgcatgcatgtctgtgtccgtgtgcacttccgcgtgtgtgaacatgca

SEQ ID NO: 51018 - DNA, 1949 bp, Homo sapiens
gtgtatatgtgggggggacatgtagatatgcgtgtgtgactatgcggccgtgtgtgtgcatggctccatgtatgtgtgtgtatatgagggagacatgcaggtatgtgtccgtgtgtgtgtgtgtgcatatgggtccatgtatgtgtgtgtatatgagggagacacgcaggtgtgtgtctgagtgtgtgcgcacatgggtccatgtatgtgtgtgtataggtgagggagacatgcatgtgtgtgtccgtgtgtgtgcatgggtccatgtgtgtatagtgtgtacacatgggtccatgtatgtgtgtgtatatgagggagacacgcaggtgtgtgtccgagtgtgtgtgcatgggtccatgtgtgtatagtgtgtgcacatgggtccatgtatgtgtgtgtatatgagggagacacgcaggtgtgtgtccgagtgtgtgtccatgggtccatgtatgtgtgtgtatatgtgggggagacaggtgtgtgtccgagtgtgtgcatgggtccgtgtatatgcgtgtatatatggggggatatgtagatgtgtgtgtgtatgaacaggtgtaagtggggagcactcaggtgtgtctgtgtgtgttcgtgtacacgtgtgtatgtgtgtgaacatggaggggtgtgtgtgtccgtgtgtaggtttgcgtgcatgcacacatgcatgtgtgtactggggcatccaagcccctggtctccactccataccaccctacgcctacctccttgatctctgcgcccagccttggctgtgctcccctgctgtctgcacgtgggtgtctgcacgtgggtgtctgcatgtgggtgtctgtgccctcaagtgtctcgtgtctgcacgtgggtgtctgcaccctcacgtgtctcgtgtccgcacaagcatgtgtaggtgtccctgctgggctctttggtgggcggccagtgatcctcgaggtcacgcatgtcttctgtgggtgcctgctccttgcaccccacagtgttgagatgggtttgcattggccccgcctgtcccctgctcacccgcctccctctcttcctgcttctaagccccgaaactctggattccggggcccttcacaggtgagcacgtggcagcagtgcctgcagacccctggctggcccatctgtcctcccgcccgtctctctgatctctctctgccaggctgcccctgtctccatccctcttctccctcccactgtcggtgtctgcccaccagccacccctgggtcccgtcacagcccttgtggcctccgcagctggggcccttgtcctcccgcctcccccaccctgtcctgttgccaccttcctagaggccctgacctgccctctgccctccagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacataggtgagtagggaacccagcgtgccgagaatagtggcgagggctgcccagacttgcccagctgggctgtgtccagtcacttgtgaccaggggtcagggaggacacgccttgctgcctgagccgaggtcactgccagtgggaggaggaagggccaagaagatgcaggagaagcaatgatcagtttccacgtctgaaaggcatcccggccctgcccggagcctgccgggggtcgctccagtctgagcctggccgtcgcctccagcaaagcttgagctgcaggaatgtccccggccttggctcccagtgccctccttggggtcaaggccacctcatccttgcccccaggggtgatacctcgggggttctccaggctgaggc

SEQ ID NO: 51019 - DNA, 2026 bp, Homo sapiens
cctgcacacccagggagcagagggaaggttccctgcaggtgggcaatgaggcccctgtgaccggctcctccccgctgggcgccacgcagctggacactgatggagccctgtggcttggtgagtgttttggggagactagagagggatgcccaagggtctcatgatatccgagggacagactccaccccccagcgcccacccttgagtcagggtgcatgtgagccggcgggctgggctctcttctcccgctgtagcccctgcagttcccagtgctgtggggccgggaggcgggtgcccaggtgtgggccccctgctggtcacctgctcgttggggtgcccatcagcatcactgagtcacagccgggtgactcccactgtctgtgctgcagggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagcattgcttttgtccatcctcaccagcgcgctggcccgttggcttcttgctccgctttgtggtgggagcacggacttggagctcccttgggtggccctggatggagccaggccctgcacagggatccttgtggctgatgaggccctgagtggggagcacacactgctgagcactgtgggaggcggggccgtggaggcaggaggctctctggcgtgcacgtgtgggtgcgtgtacgtgtgggggtgtgtgtgtgtgggtgcgggtacgtgtgggtgcatgtgcctgctctctggcgtgcacgtgtgggtgcgggtacgtgtgggtgcgggtacgtgtgggtgcat

SEQ ID NO: 51020 - DNA, 1048 bp, Homo sapiens
tctgtcatgggggcaggtgaccgtgcctttaggggacagaccgttctccatcaaggctggacgtgccccgtccctaaagcagccctgtctgcaagtgcccagcagaccccacggtgcccgagtgccccggggctgccagcttcaacagcagacctttaatctgactatcctagagttcagaagtccaaaaccaaggggcaaacaaggccacacgcttcccgaggctccggggaggacgctgtctgccttcccagcccctgccggctcaggcatctgtggctgcgttgcccgtctctgtcccctggtcccacggcgtctcccccacctctgcgtcttctctctctgcctctctctcaggtgggccctggccgttgtttcagggcctgcccggggaaccctgggcgatcacacctgagaccctgacgtaaccccctgcaaagccccttcttctaaataaggtcacattcgaggtcttgggactacggcctgcttgtcgccccctgaggtgcatgatactctgggacccacatctctgtcttcggggatcgcctggcccttgtccaggccccggggcccagggtgtaaatgagaggacacagccgggcaggaggaagccgtccctttcccgagctggagctctgagggcgccttaggggcagggggcatctgggttcccacctggtcagagtaaacagccccgggcgcctgtgccatatgcccactcccgagagcctccggtgagggctgaggcctgcactgtccctgctgtccaggtcccactctgacctcgcctgtctctgacccgtttcagtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgagtccctccgcctc

SEQ ID NO: 51021 - DNA, 1060 bp, Homo sapiens
gcctgcagtcctgcagagcacgagtccctccaacaggcctgttcattctggatgctgccgcctaccactctctgaagtacgcagtgtggagtactcagggtcggggtgctcagggccggggtgctcggcgtggagtgcagcgtggagtactcggggctggggtgctcggcgtggagagtgcagcgtggagtactcggggccggggtgctcggcgtggagagtgcagcgtggagtacttggggtcggagtactcagggtcagggtgcgcagtgtggagtactcagcgtggggtgctcacggccccgccatgctccctgggggtgtccttgtctgccgcccacctaccctccagagcatgttagtatctggaatgaaagttatctcaccaactcaaatagagaatcattcccaggagacccagctggtgtggattttgctttggctgacatgcccgtcctctgccccacgcaggctgttacaggcgctggaacgcggacgggagcgccagctgcgtccgctgtgggaacggaaccctcccagcctacaacggctccgagtgtagaagctgtaggtctgcccggctccccccggctcccttctcacagctccagctgtgggagacactgtgggagttgctgtctgtgtccccaccttgccccagagccactgtccactggggaacagccccgggagccccctcttcccgagtctgctgggccattcgggacagctctgtggtgagggctgctccgccccctcagcccctcgctttcatatttccgtcctgagatcccttcagggtgcacgtgggtgtccccgtgggctccgtgcacacaggcttcccacagttctgctatcccacagttgctggcccgggtgcgccattccccatgaacagaagctcagggacccccgggcggccacatcctggtaagtctcagcaggccacagccacctctgccggtgtcctgggggctgggggccgtcggagccagtgcagaccctcacccttgacgcagccacagcaggctcagggttctgcaaaacagccagaggggag

SEQ ID NO: 51022 - DNA, 1022 bp, Homo sapiens
ggcatggggtgccctcagggcagggcctgggcagagggcaggctccgagaggggtcacgttcttgccgcctacctgacagcaggccttctagaaagttctctccagaagcagccaccgccgtcctgaggcactttgtgcggagacgggaagctgtcgcctcagaggtgggtgcgtagaagggtttggccgggtgcgaggatgaccgcgtctcccttgggctctggagtctgcggtgggaagggcttggtttcagcaccctctggtcagaggccggccgagcccatgggcggtgaggttggtgcctggggtcgtggctggtctggtacaggtggggctcagcccggagaagctggagccggttcccaggccccgcgctatgactggggtgggggcaacgtctctcgtgaggttttttacttaaatgtgaaacggctcagtacggtggccgcagccgggaacaaggtccgacccaccgaggcccagccttgaacttgccgcgggggcacctgaacacggttttacagcccggatcactggctttcttgaagtttgggaactgattgatcatggtggcgggaggtaaggttcattgttcttgatgaacaaaattcttagggcgtgaagagccgatgctttaattaaccccccgggagcgtctcaggcctccccccgggagcgtctcaggccccgtttacgctgagtgtctggggaaagacgtggtttggttttgtttttctagtaacccagatgaaatgtttaaaagcatggttggcagcacattgaatttggcaaaattaaggtttgcatttgtgaaaatgcggatgcagtttgcggttcttttcagacattttggtaatttgcaaatacttatttgcgaaacgagtttgtcagaacattttttagtatctagaggaagatgagatgggccgaggaggtcgcgcacccctggatccctggaggagctggtgtgttctctgtggggcgggtggacgtggcccggacacacgggccgtgctcacag

SEQ ID NO: 51023 - DNA, 1052 bp, Homo sapiens
caggtgtgagccacgcgcccgaccaacttgtgtatttctagtagagatggggtctcaccatgttggccaggctggtctcaaactcctgagctcaagcaatcctcctgcctcagcctcccaaactgctgggactacaggtgtgagccacgtgcctggccctcacactttctgttagtcctttcaaatgggatcttccaaggaactactagacataagaaaacaaataatgacaatttttttttataaatgaggtctattttgctatctccagttctggggatgcatgctgttggttttttgaggcaaccattgagctggggagcagaggatgaaaccagagcacgttaaaatacaacataattcacagttcttaccaagattcgagattttacgtatcccatttgctatccgtctcttctgctcaagggcagagatttcctgtgagttttcctcactctcgtatctccagtgcctgacacaggacaggagctgcacgagtttgttgagtgagtttctggctgtgaacctgtgaggctgagtgcacgaacgtgtgggcaggtgtggctgtacaggtgcgggttcagatgggagtgcaggtgagggatgtggctgtggctgttcagacctggggtgtgatcagggcctacgggccgcagccaggatgcctccctgcctccctgcagaagcggatgcagcagatcatggcccactgctttctggccgccaagcccaagctggactgcaagctgggttactttgacctcattggctgtgacttcctgattgatgacaacttcaaggtgctgtcctgggcggcggggggcacagtagacagatgcaaggaggcaggggccatctgtacaccctgaccacactggcaggccccaggcagaatctgcagtcagcccccaccctgcctgcatgcagccctggggatgggtgtatccatgaggctcaccccctgtgcagctaggatggaactgcaccccctcctcagagcagccccctcaggccagagcttcagaccctcagagcttcagtggacaaacagg

SEQ ID NO: 51024 - DNA, 1021 bp, Homo sapiens
gggcctcttcccaatggctggctcaaggtgtctgtgccccccaagtcgagacctgaggatcggggggccccgcccccaggcccaccccccacatgccctgcctccgactccacacggtcacggccaagtcgccggtccctcctcctgccctgctccgcagccacgggggactgaggggccagcagaatctgctttggccacgtggccaccctgcgctccacagggacagcagctccattccctgggactcggcagccccggcactgctagaaggcaccgtcggctgtggtctctggccagcacagcaggtggggcacagccagggcgccaggaagaggagaaggcaggacagagggaactggggaccacagaggccaaaggaggccccaggtctcagagccagtgaggaaccaccccaggccaggggcagcccccaccaacatggtcctttcgctggggcctggagtgggggttcccaggtgaggggctgggaacacacctgtcattgtgatggggtccccagtcccctcccagcaggtctgttggaccctctgggggccaagggcagcagcggcctgttctgcagcccactgaggccagggaggggtgaagcaggaggggcctgggaggggtgaagcctccatggctggccaagcacccaggacttggttaatccacacctgctcttaggggtcagggccacactgcctgacggcttccaaggccgctaatggccacatcacctcagggtcctccctctgctcttgctaccctgatgcccctggggcccctgtgccctccggcctctgccctcggctctgccccacatgcctggtgctgtgtcgcgccatgatcccaggtcaggactacatcccctggtgacattggaaccgtccagctcccctccctgtggcgcgtgtggttacacccccaggctcaggggccccacgacgtcagcagaggtcacctgagcccgaggggacaatggaacctttgccgcccctgggccctgactggatgt

SEQ ID NO: 51025 - DNA, 1145 bp, Homo sapiens
ggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggtaagggcgcctggcccagcccagcggggcccccaacccgaataggagaaggggagggcggcatgggggcccctcctgtggaccccacccagcagaccccttcctgcaggccgtgcggttgccgccatcctgggcctgggcctggtgctggggctgctgggccccctggccatcctgctggccctgtacctgctccggagggaccagaggctgccccccgatgcccacaagccccctggtgagtgcctcatggccctgccgcactgctcctggcgggtgaggcccacccaccaatctctccttttttcctccccagggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggcactgtgggctgcacacctgtggcatggaggcttgggccgtgcccgcctctgactggagaggggtcttgggaggcttgggccgtgcccgcctctggctggacaggggtcttgggaggcttgggccgtgcccgcctctggctggagaggggtcttgggagacttgggccgtgccaacctgtggctggaaaggggtcttgggagacttgggccgtgccaacctgtggctggagaggggtcttgggagacttgggctgtgccaacctgtggctggagaggggtcttgggccagggtggaggtgagggtagcggggtcaagtgggaccctggaggttggtccctgggtgcgagttccagattgagtgggga

SEQ ID NO: 51026 - DNA, 1034 bp, Homo sapiens
ggtccaaggcccagcaggtgcaggtgggcggggcggcctgtgccacatggctggaatttaccaccttcctctgaagcgttttcactggtatcatgtgtaggcttgtttttctcccactgctgagtgagtcatcttgtttttatgtagaatcctgtgattcctggcgacagccagtgggcccggcccaggttagggatccttcagaactggggtccaggcctgtgtagcccctgtgccccgttacccctgctggccccgggcaggccttccggggcccccggcttctccctgccctgtgttttcatttgtgccgcctcccttcgggaaccttccagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactga

SEQ ID NO: 51027 - DNA, 1023 bp, Homo sapiens
ggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctgggtgaggctgggtccagcctggccggcacgccaggacccaggaccgactggcaggggccgggcatcgtcgggaggtcggggcaggtcctgcgggagccccagcctgggtgtgggctgacccattcccgtctcgcagaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggaggtgagccctggcgcagccgtgtcccggagccggccctgcgaggtgctgtggcgggaggggctggtggatctgggcctgaggcaggaagctgtgctggtgtctggcctgagac

SEQ ID NO: 51028 - DNA, 1090 bp, Homo sapiens
cgtatttctgttaaaaatacaaaaattagccaggcgtggtggtgcacccctgtaatcccagctactcgggaggctgaggcagtagaatcgcttgaacccgggaggcggaggttgcagtgagcaaagattgcgccaccacactccagcctgggtgacagagtgagactccatctcaaaaaataaaataaaacgtgaagagtgtgacttttggaagctgtggttggagagtggggtctggtggtgattctgtgtgacagagggggagggtccatgtgtttccccggggaggggaccgtggcatccaccttccccagtgtctctggcgtggcccggcaccccacaagccccacgtcccggacgcttttcgcgttgcctggtggagcctgtcgctgttggtggcaggttcacgcagccatggagtcctgggccggcggcatccgtctggctgttcggggtcctgggggcccagtctgacggccacctgcccatttgctgtcttgcagggtggatgtgaacactgaccggaagatcagtgccaaggagatgcagcgctggatcatggagaagacggccgagcacttccaggaggccatggaggagagcaagacacacttccgcgccgtggaccctgacggggacggtactgtggctgggccggggtgggtggggcggtgggcggggcgggcagggccatgggccttgcctggtgcctggagggcagacaggccctgtctgagggacgggcggtggggaagtgtcagccggagaccccgaggtgtggtggggtgcacggaagctgggttcatgatgccagaatcctggtgacagaggtgtgtgtgccaagcactgggcgtggcccatggagggcgcctcttatgtcttcggggccttcatctggtggtgtctatgcctcttggtggccccgaggcacagacgttgccggctggcctcacaggtgaggaaacgggtgtggggtgctggccggggccctggggctccagacgctggcatcctgccgcttccagcctgggcagcagagcaagaccccatctcagttgagaaggaagttcagctcagtatcagaggccct

SEQ ID NO: 51029 - DNA, 1021 bp, Homo sapiens
cgtgtggcccggagaaaacaatgccacgtgtggtctggagaaggcagtgccacgtgtggtctggagaaggcgatgccacatgtctggatcctgtgaatcgaggatatgtttcatgttgcaggatagacgtgcttggggaagtctttgctgagtcttgctaatgatgtgtctgtgtctctctgcagactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaagtaggtgccgccatgtgcccagactggggggctgtccgcgtgcgctcgcctgtgtgttcctatcctggctttgcgcggtggggggcgccgggccctgtgtcgggacctgccgggctgggaagacgtgccggtgatgagcgccacttccagcctgctgtgtttgcgcggaggcctgcgctggcagcccagagccgctccttgaatgccctgggtccgccgggggctcagagggccagagtgggcctgtgtggccgtccctaggacagcctggaggagcccacgcggcactgcagtggtcagcgtcctccatgctgaggggcagacgccggccacgggcagcctccgcaggctgcagcc

SEQ ID NO: 51030 - DNA, 1099 bp, Homo sapiens
ccaaggctgtggccccggcttaggggctcctctctgccctcagcaccccttctgtgggcacggcctgccccctggggcctggatctggaacggggggtctcccttctgcagcccctgccctgcttggccacagcactcaagagtgctcccttccagagagtcgggcagctgtgcatctgtacagggggaaccaaggttgtgccgggccctcctggagctgggtcagcggggacagcagtgtgggggccctgaggaggcagaggcaggagcgtggcctgcaccttcctggttggcgtgagccctgggctgcggactcccctgtttgcttccagttttcagtggctcctccccaaactgacgggccaaccctgggcaagaacgggctgggggcaggcacccaggatcaggcagcacccagccaggcctttctgaacaccgcctggggcctcaccatccgggaatgggggccctctaggttcttcagcagcagccagtcccccaccctacccagtcccggaggtaggagctgtgatgacagatggacatgccagaaatgggacccagggccgcgtagagcaagatggtgatgagagacaaagagacgtggagtggtggggcggggggccggggctgaatgagttgggggccagggcccgggtgaatgggggcggcgggggctggggcagggaccacggccggggtgaatgaggtgggggatgggggctggtcgggggtggctgggggctggcatgggggccagggtgaatggggggggctggggccagggtgaatggggggcgtggggatgtcctggtgctggcaccacctccctggcctctgcctcctggtttctgccccagtgggaggtgatcagccacttagccgcaattcccctggaatgtgccatctctagccccctctgggcacccaggagcaaaggaatggacaggtcggggtggggtgggcggcctcacaggagggtccaggctcccagcccacccagccaaggctccatcctctggcccagcccagctgcaccccttcattctctctcagcctcacctcctgggctggacccacactgcaatgtttgccatag

SEQ ID NO: 51031 - DNA, 1044 bp, Homo sapiens
gggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctgaatttcatgctgcttgtgtctgtgtgggccgggatgtgtgtccatctctgtgctcagggctggggtggcccgtgaccagggggtcacacctgctggcctggggtggtgtggcagctgcagggcaggtgggtccccacagggaatcgcgtcgctggagccatggtgtagagccctctgcagggctctctccccatcccgtactggatgccagccctgccctgatctccgcttctgtgaccgccagcatcacttccaaagcccggtgtctcccgaggctcatgggagggggaatgctaacgaatagagtgtttactcaacacgctactgccgggtgcagtggctgccgcctataatcccagcactttgggaggctgaggggtggatctcttgaacccagcctgggcaatgtagtgagaccccatctcacaaaaaatacaaaacactacctggtgtggtgatgtgcacct

SEQ ID NO: 51032 - DNA, 1034 bp, Homo sapiens
tggttctgagcagccagctgggtggtgtctggggatagctgggaggcacagcggctgccatgtgggactgggactggagtgctccctggtcttggcctctgtggctcagccttgctctggtctgcctgagtgcaggggccaaggggcacagggccagtgaggccggccacgctcgggccctcacctgtgagatggggtcggaatttgacacagcctagggcttggttcttggtggtggaccgtggactcctgagaacgggagtgctggtcctgaaaggcgctggttggagaccagctgcttttctcgctgtttttctcttaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccagg

SEQ ID NO: 51033 - DNA, 1053 bp, Homo sapiens
gggagaaagcctggtcaggtggatttgagagcttgggaggggaggacgtgtgaagagccatgaatgaggcccgaatccaggggatcaggtcagggcagggggcatttggcagaacttggaggggtgtgtggtggagagtggtgtgtttgaggtgcgttttgctggcctttgggtgcagttgggtcggggaagcaaacggtgctggagagtcgctgggtctggacctgagtcctgagaggggcggcctcagctgggcctggagctcctgctgtgctgggggtgttgcaaggaggccctgcatgcctcttccgacccctctgctcctggtgggggtgtgtgtggacactccagggagaggggtgtgcagtagctgtggttgtctcgagctcccggggcagtgggggtctgggtccagtcgggtggtgggtacaggtggggtggggaggggcattgggtctgggtggtcatgacagtgggtggtagtggagagcaaggtcagtgggggactgagcctgggagccggctggggacggagagtgcaatgaggactcgggagccgagctgagggggggggggggggtggcgtggggggatggggacgaggtctccaggagcccctgctgtggcggacgacaaggccctttctgttttgtttccatgtaggtggctattatcatggaaaactaatttttcccagagaatttcctttcaaacctcccagtatctatatgatcactcccaacgggaggtttaagtgcaacaccaggtaaggtgcctggaggggccgcggaggctttctggctgcggtggggagtgtgcactgacggggcccccgttttgcaggctgtgtctttctatcacggatttccacccggacacgtggaacccggcctggtctgtctccaccatcctgactgggctcctgagcttcatggtggagaagggccccaccctgggcagtatagagacgtcggacttcacggtaagttttagagcctctccctggtgggccgtcagccttgtgtctggggggctgttctctgttcctgagtt

SEQ ID NO: 51034 - DNA, 1024 bp, Homo sapiens
tacccctgtgtggtggcacctggggcttcggtaggctgcaggacctgtccagcacctcagcccttcatcgactaccaaggctgatccagcagcctgacccctccaggtcagcagacaccacctagagacctagtgtcatttatagagaagatgctggagctgtcagtaagtttctggggcctttggcggaggctggcgccagcctcgatctggaccaggtcagtagtcagtgtgcccgtgaatactgtcccgccggcaagcacaaggcagagcagggccaggtcagcagttgctgtccagccacagggccccggcttcaggtggctggagcagcaggctctgtttgcctgtgtgtggaggctttggatgagatttcactagaagagagtgctgctgctagaagaaggtttgcaacccctgctttggactgtcgggagggttgtgggtgggtaagaatgaaaaaggctctcctgaaggcattttggccgagttaacacagccacacctgtggactctcctttggcccaggaatcccagttctggatcatctgcaactagggcagccagagtgcgggagtacatctgtagggtgggccctccatcatcgtgtcattgcccatgaccagcgttggggatgccagcaggccgtggtgagataaggcccgggagcaggtgtccagggcgtgttaaagtacttgttacgatgcgtgtgtgtgccttcagctgatctgaagaatatataccaccgagtgagtagtggtcggccgggcgcggtggctcacgcctgtaattccagcactttgggaggctgaggtgggcggatcatctgaggtcaggagttcgagaccagcctgaccaacacggagaaaccccatctctactaaaaatacaaaattagccgggtgtggtagtgcatgcctataatcccagctactcgggaggctgaggcaggagaatcacttgaacccgggaggcggaggttgcagtgagccgaggtcgtgccgttgtattccagcctgggtga

SEQ ID NO: 51035 - DNA, 1874 bp, Homo sapiens
cttgagccgaggtggtcaaggccacagtgactccagcctgggcgacagagcaagaccctgtctcacgaaaaataagtaaataaactcttatgccctggccctgcctccctggccagtcttatccctgccctcactgtgcttgggcccttgcacactgcactttctcaggtgtggcctgttcacctgtggccccttctaccaggaagacagctgctctgcccagtgagtgccttggagtctccagagtcctcgtccctccagccgcagaggctcccccgttctgcggctcgttttgcttgtggctagtggtaaatgctgggcagcgggcttccgggtgcggtgaaggggccggcggtggtgcctgcccacttctatggtgtggattctccatcagtgcggggtccttgagctgagttggaaggtgcgagtagctgccctcaggagctggtctgaggctgtggcccgaataccccctcaagccctgtaaatgtatccctgcgtgagtttttggaggacaggaacgaggctttgggtttctcctcgtctttgtacctgagctgtacgtcgtgtcaatgaaggtggtggcgggacagacgggaagagagaagccgcagggcctctgggtgtctgggcgggtggcaagcgagggtgacctgtgagctgtgactctgggtgaccgggccctgaatgaatggcgggctgcagaggcgggagtggggctgcgccaggggagagagctgtggccggcgctgcttctcgtcgtcagtgtagacgttgcttttaacagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggtgagtggggtgcccaggggcctgtggacactctctggtcttttcccaatggacgcatgccggggacatcacagagccatgcttgactcaggctggggctggagagaatctccggtgtggggcccttgaggggggcggggtccaggttgactcaggttggggctggagagagtctctggtgtggggtccttaggggaggggtccaggtatgcagggttcacagctgttgctggtgtgcactctaggcacttagaggagaaactgcctttctagactctgctctttgcttctggatatgggaattagcctgttttggcttggagtatttgacaggactagggtccgacactcctgtccctggcactggcttgggccaggtgccccgaccctcaggctgacaacgagaggacctgtgcctcataagcattcacctcatggtgactctcccccttgctgaagtatagagtgtgagagtgcatactgctctgtcgaaacactgccattacaggtctgctagtaatttggtaagaaataaagtgtgagaggccgggcatggtggctcacacctgtaatcccagcactttgggaggctcaggcgggcggatcacctgaggtcaggagttcgagaccagcctggtcaacatggtgaaaccctgtctctactaaaaatacaaatattagctgggcatgatggcgcacacctgtagtcccagctactcgggaagccgaggcaggagaatcgcttgaacccgggaggcggagcttgcagtgagctgagatcacaccactgcactccaacctgggcaacaagagcgaaactctgtctc

SEQ ID NO: 51036 - DNA, 1456 bp, Homo sapiens
atgcctgattaattttgtatttttagtagagacggggttttaccatgttggtcaggctggtctcgaacccccgatctcaggtaatctgcctgcctgggcctcccaaagtgttgggattacaggtgtgagccaccacgcccagcccctttgtgaatttttgttttccttgtccttcctgctgtcatattgggatgagaagaattgggggaaatagccccctggcctcctgggggacgtgagaatgctgttctgtgtgaagctcaggaagagtggctggggaaacagcagttgaatcgtgaacatgattttaaaagcctctccaagcaggtatgggagagaagcttgtttgtgactcattggatggaatctattttatttttgcgcggctgtccatgaactttcgttaaacctgcggcctggccacttagctaagcccagacccacctgcacttgaattgtccagtgaattattttgtatatggcagagtgttagcttcagggtgagtgtcgaaaggacagcctgtgtggcggtgctgcttggggtcatcactgtggccatcaccaggtgttggcctgaggggagatccctggcccattggcttctttagccaggagctggggatgccactgtgtggaagcacttccttcccaggcaggactgtaaccccatccctggtgggggccctcctggggaggcactccttaggcagaggaacccgctggggcccagaagggccctgcgttgtgtgtggggtcacatggaggccagtgatgtgtgacagagtgggaggcatttggcagggaaatcagggaggcctctgaaggcggtggctctggctatgccgggaagggcctggggagtttccagtacaggctaggctgggaagcagctgtgagaaggagtgtgtcggtcaggactttggagtgggacctgggccgtgctgggtcttgggagttgggaacgaggagggctggctggggctgctctgtcttgggagctgggaatgaggagggctggctggggctgcctctgtcaaggggctggcaggcaagaggacgtgttgatgtttatttgcttggctgtggagtatcctgaagggtggatgggggagtgggtgatcggaacagtatgttgacttatgggtacaggagggccttgaaatgggaagagactagaagctcagaccttctggacccacggggggagttgggaggctcctgtggtgttgatgggagaagtgatgacattttgcgttagagaagataatgagagtgggaaggctgtggtgaacaaggattgcaagagtcagggaccccagaacaagaagcagggttgggggtggtgctgaggccacacatttgggagcacgcgttgggtgccctggctgagctctgcactccaggccctgggtgtgtggggtgagcagccaagccctggccattgacatcctcaggt

SEQ ID NO: 51037 - DNA, 1079 bp, Homo sapiens
agctccctggagcccaaccctccactgagcctccaggggcccgggacgctccatgcccgggccgcgccgcgcctcccctaagggccgggtggggcgtgggagcggaggacaaggcgggagccgggaggcgggagggtcggggttctttctccaccggggtcgccctcagccgggcctgccgccctgggccgtggcacatggggagggaagcgcgcggcttcggggtctggggctctcgcgcccactaacggtgcccggagccgcccgccagtgcgcaagcgccgccccgccccccgccccatcccccaccccggggtcgacggcgacagagagtcgtgggcgcggtccgccagtctgcctagagcggccagccctccccctccctcctcaccgccccggaccgcgcaccggaagcagaagctaggctggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcagggtcatgtcggggacttgaccactcggccgggtttcccgtcagctgggacacttgcagctgccccaggacgggcagcctcgatcctggttcgtcagtggatcacgggagtctgtgtcgggggagggctgccgtcgagcccgccgtcgcctcgcccctgaactgttagactccagactgccccgtaaaccccgagagaaacgagcgtgcccgggactgtgcttagggccagcgtttctgggaaacccgggcggtgacagtgg

SEQ ID NO: 51038 - DNA, 1035 bp, Homo sapiens
agctgccctactgcccccaccctgtcccacagtgcatgggtgccagacctggatgggctgcagtagtgcagtggggtgaggggaggtgccgcagggttgaggggctccagatgggtccagggttgactctgaactcctagaggagaggcgggtgaggctggctcagcccttggtgggcactgtccctgagggactcccagcggccggctgtcctgggagaggctggtccagccttcttccccgagggcacagcagcggctgcctctgcctgcctggggttgggggggcggggggaagtgcactgaacctggtcccagtcctgcccccgtagcaggcaggcgtctgtctcccagcctgtttcctgaaagccccttcccatggtggagcccctcagggaggtgcggggggaggtgaagccccgagggggctgaggctgcaggtgaccccagccagccccgttcttgctttagggcgaccattgacgaggtggagacggacgtggtggagattgaggccaaactggacaaggtgaagggcgggcctggagcgccctgtgcccggccaagcttgggatggccacatggccagactcgccctccaggccttactaagccacttacaccccccatatgtggagcatgcgtgtggtgctccaggtcctggtccctgtgtcttagcatgtgtgttccagggtgcacatgtcacatgcacacatgtggctggccctgagtctcgtcccatctgggaggggctgggctgtggtgagtccccgacccacggtggctgcccgtcccctctgctgggctggtgacacggggacagctgctgtgtgggctgagccttggtgtggctggggctggggctgagaaaggggagggggcaacaggccgtggaggggggagccgtgtccatgagccccacatgggctgagaaagagggggcaacaggccgtggagaggggagccgtgtccatgagccccacatgggctgagaaagaggagggggcaacaggccgtggagctgggagtgggcagc

SEQ ID NO: 51039 - DNA, 1020 bp, Homo sapiens
ccctggtctctgacttgatcctgtgtccagagcagcgcgtggggaacaggcagctggagccgcgtttaaggcctggggtagggtgcttggaaacgtgaagtggtttgaatgacccaggggcttggaggggtggcggccgagaagagcggcggggaaggtcaggtagggggtaggggttgtgtgcacaccgagtctgcatgttttccatcattcgtggcgtgcaggcgtgtacacctgcgtgaactacatgttcacagacgtgtgcacaagtgtgcatcggctttgcttggtggacatttggcaaacgacaatggaggcaaagaaacctctctgcatccccaagtgcgcacctgcgtgaggccccctcctctgcacgagctcgtgcggggtgcgctcttgtgaactttgcccctctgcgtgcctccctccggacaccaggccttgcacaggacgtgtggatgagctgtgccacggggctgtgcttgcttctgcatgtagcctgccgatgagtgcacgcaagcgtgtgcacacaccacctgtctgtgtgggttcacgtactgtgttagccatgtcagcaatagacacatcaccttgtacacgcgtgttccatcactaggtacacatgttgatgcgtgtctgtgcagtgtctccttgaacacacatgtatgtgtggtaccagtgtgtgcaggcatgtttgtgcatgaacatgtttgcacatgtgtgcttgattgtgtatgtgtgggtgtgcacgcgcgcgctgggtctcttgggatctgctggcaagtcagcatgtgtgtggaggcacggggagcctctgtatccctggagccctcaccaggaggctcaggagccttggagtgggaggctcagggccagccaggagagtggccgccagccctgggcagaggaactggggccatcctctgctctcccatcttctgttgctgacctgggaaaaggggttgaataacttgagcaccctaggatcctgcattgaggacccgggctgtggggaggtgt

SEQ ID NO: 51040 - DNA, 2959 bp, Homo sapiens
ggtcggagctcgagggggaaggagagccaatgtgacaccgcgggcgggcggggtcgttcctccggtgagctttacctgccgccatagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagtgagtgtggccctgacagcggggagggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcaggacctggacagctggaggggattcgcccggacgccccccagcctccagctgtgccctccccccaggctggggagcggagaacagggaaggctgcttgtctctgaaaaacccctgccatgcctgatggaagaatgttggcagctactggaaaggtctcactggtgccagtggttctggtggggtggtttctgctgcccccagcactgtcccgagggccacccaccaggtggcagcttctgaccagaacctcccctattggggtgagccctgaaggggggaagaacttctgccagccccagacttctgtggcagagcagcaggtacaggactgggggtctctggcacccgcaccagccacgttcccagaccctgcaccaggaccctaggtgagggcccagggcaagcccctctgggatggccaggctacctgcccagcctccagggtcctgctgcctccttgcccaagcattgtttctctggttttaagcccctccaatgggcctcactgggggcaggagatcagccagggcccctggtggccaagctagtgggaaccaggctcgtctttaggcccaccctgtcactctcccgtccaaggccacatagtaggctgaggatggcaaacactgccccacagacacctacaggtacgtatttttccaggaagctgcggttctggaacctggagtttgagagccagtctttcctgtatagacaggtaggctctgttctggggccgtccccagggggtggggctgagggtgggcaggcccctgtgcagtcttggctctgggtcgtgggcggctctgggtcacaggtacggaggatgacggctgtgctggtgggtcacgggcggctctgggtcacaggtacggaggatgacggctgtgctggtgggtcacgggcggctctgggtcacaggtggctctgggtcacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtaagaaaaacaggcacgagaagctcctgtcatgtgcccagtgactactgtggccgaggcatggggtggggggccaggggccactgacggcagcaactgggggtgaagcagccccccgcccagggctgcagtccctcaggccagcccgtagcccgtcctgggctggcccactccctggtcatgggagtggtctcagcggtggggagggtgctgggccggtcttgccccaggctgacgcagggtctggtccgtccacaggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctggagaccagtttgtttcttcagctgcaaacagctgcctgggcaggcaggtgacacaaggcctctgtccccagggatgggacctgcagggtctgttcacccagggcacccacagtcctgaagtgcaggcccagggtctgtccagctgggagagggcagaggtggcggctgggtgagttgccggcctcagctgggggcctgggggaggcccttcttcagcagagatgtgaggaagctccccagctcctcgtcctagggcagaggcaaaagcattgtgggtggtgcaggacagggaggaatgttgatacctgtgttgaccgcggtggggtgggggtcaccccttacctggtaggtccaggagaccagcagcaccttggtgcctgggtcctcagaaggggcggcggcctggaggaggacggactccacagtcacagagccgtctgggaggtgctgcacacagtggtccttcaggacgctgtggggaggctcggtgagaccctgcctggcctccagggcccaagggagtggggggggggcggggccgggcgcccacctcttgaggtggctgtagacgcgcaatgccgtctcctgctccttgcgtgtgtcatgcaggtgcacgcggcaggtgaagcgcagctggtgctcagccagac

SEQ ID NO: 51041 - DNA, 1051 bp, Homo sapiens
gccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcaccggcttatgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacag

SEQ ID NO: 51042 - DNA, 1589 bp, Homo sapiens
caccagagaacacccagtgccagcacttagtcacttactgccttgcctgcctggggaaagatcctggagaaggtggcctcattggtttgcagctctgctgggggtccagccacagcccaggagtgactctgaccgaggtgttggccccacagaccagccgttgtctctgttggaggctgagggccacagcacagtgcccactacttagccagcaggccgtggccaccttaagaggccaggggaagctggcgggggagggcgtgtgggctgccagcctccaccctggacatgatggtgtggggcatggtcccctgtgtcccccttcctgtgagtaggggtggccctgcttcttggcccatgtgtctgtccacacagcagacttggtccggtttcctcagtgcactggggtcctgcagagcttggggaggcagcacagggggcggggggcgcagcagtgactcatctgccctccctcgagtaggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctccccagcagccaggcccgtgaagcctggagaagccccttctc

SEQ ID NO: 51043 - DNA, 1033 bp, Homo sapiens
cccctgctggtcccttccctcccccctgcctgtccctccctgctgcctgtcctccctccgcccgccccgcttcttctcctcccctggaccatcccttccccaccccgtccctccccctcccccaccctacccctcccctcccctgctcaaaagttggcttctcggagcagtctcctgtcatggttctggaagttttgaggcttcctcattctctcaccttgctcttttctgtcatagtaaccttcgtctggcgtgctttgggtgtcttgtttgtctgccgtctgtctccttgctgacagggatatctcctcctgtcttctgagccctgtcccctcgtgtatctccaggctctattcccgcacctttccactttccttcctgggatcactgtgggtcctgtcgggaggcgggactgccagtacttcaggactgggctttggaattcagaaaaccagcccgggccccatgcctcggggccgtgtgccacaagtgcctctgtggccttaggtccctgggcatgaagaggggcggccctcccttcccacaggtgccagagggcctctgtgagcctggcgtggcttggggtaggagatgcagagggaggagacagctgagaccctgctctcagagagctcacacccagcgggggcaggaacaggcctggaagagaacctgagatcccctctctgtggcaggcagcccctcggctgtggccccgtcatcctgatgtgtggtgctggctttggacacttcgagtggctggcagggggaggtgggtgggattcaaggggaaaactgttcactgccatcagactcctgcccaggcacagtctgtgcaggggccgtgaccctttcctctcgggcccccaggccacatgagggggctgagtgtgccttggctggccaaggcctctggctggagcagctgggcagggctgcttggctgtcaggagtgtgggagggctgcagatgagggtctgtgttgggggctgcatggtgtgcagtggtgtgaggctcgtgttgccacgctggc

SEQ ID NO: 51044 - DNA, 1029 bp, Homo sapiens
ccgggctcctatttctccactgggcccaagtcccgggcgtggaaaatgctgctgggcagggcagggtgccacgaggcggcgtccagatcctacccagcctgctgcctgggccctcagaggtcacagtgtgagtgtcgaccacagccctgcctgccttgctccttggcctggggacctgcccctgcccagccatcccctctgtgccgtgtgggttgccaccctgccctctgaactctgagctcgggtcacccggcctcctcctggttcgtgtcccctgaccctctgcggcctgcctgggtgccctctgccccgttcccaagcctatctgacctgggggtggactggtgaggcacctggccagcttgctctcctgggggccctgccggctccgcatcccctgctgcccctctaggtcctgaggtgcagggaggtttggtgagtggaggtctttgtctccctggctaggtggacaggacaggagggtggtgggcggcctctggggacctgtgggccctcccagcccacctacgtccgtccgtcgggtctgagagtccttgtaggtggactgtgagcctgactaggggtgcagggcaggggtcaggcaaagtcctgccctcacagagcctgaccctgggcaggcaggcacagggcctgggacctgaggctgctcctgagacgccaggagggtggagtagggccatagggcatggctggcatgatggagaggaggctgctgggggatttgggctcctggttgggaatgacaggtctgagtgcaggggtgggtgcaggtggcctgatgccctggctgttgaggggtgggcggctggtctggagctggctgggaggtggagcggtggacctgaggtctggggcaagggacagggaatagcctggggagccttggggcccggtaggtgcagctgctgctgctgaggaggctggggcctggccctgaggagtcccagtgtgggggaagccctggggggggggggctccaagccccaggaacagatgaggtgggggtgg

SEQ ID NO: 51045 - DNA, 1146 bp, Homo sapiens
gctggtacctgacgccgccccgaccccgcgttccccgcagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggtgagtgcccccctcccggccctcctggggaccagggcccccttcaccccacccagctgtaacctcctcccaccctcgccatccaggaaggatgttaacttggcggagttcgctgtggctgcaggggaccagatgctttacaggagtgaggacatccagctaggtgaggcagtgctgggacacgagggcacaggcgcggctcccagtcccgggctgggaagtgcatcctgggagcggggacctcagcctcctctcctcccacagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcgg

SEQ ID NO: 51046 - DNA, 1022 bp, Homo sapiens
gattccccttcccccacatgggccctagggggcatgcccctcccccatggaatctcccccaccacgaggggcctcaggggcccacacccccccaaagatgcccccaaccccgccagagtccttggggcacacccctcccccagttactcctcctcctccaccagggtcctcagagcccgcccctcccccactgattcaccctcccccatcaggaccatcagggtccgcccctcccccagtgactccccctcccctatccaggccctcgggggtctgccccaccccacggacttcccctccaccaccagggccctctggtcctgcccgtcccttacagacatccctcccccaccagggccctgcccctcccccactgactcccccaaccagggccctagggggcccaccccttcccccaccgactcccctcccccaccagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcggtgcggggaccggggaccggggccgcggggtcggggcaggggtccggggccgcggggtcgggggcaccgcaaggctcacgcgcggcttcctcctgggtgcgcagcggtggaggagacggacgcggggctgtacacctgcaacctgcaccatcactactgccacctctacgagagcctggccgtccgcctggaggtcaccgacggccgtgagtgcttcccccccgccccccagctcccgcccctcgaccctcgaccgccgccccggcccgcgcgccgctga

SEQ ID NO: 51047 - DNA, 1269 bp, Homo sapiens
gccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcaggtgagtggccccctgcttggccctgggagggcaaagtgctgagaacacgtttctttgccacgaattacttggcggtccctctctctgcgtcttgcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcctttcctgcgggtctggagctccatttgccgggtgtgaggtctctcaggattgaggctgctgccagtcccaggtgttgcagaagacccgggcagcagggtggcagattggccgtccctctctctagctggctcttggccgccgtccagagggtgctgggcctgtaggagccccagcctcgctgtgagcaaatgtgtgctgtgtgcagttcaggctaggtgctgtgggatcactgtgaacagatcccacagcccctccctgagcaccacattccctggggaggccgacccggatggcagaagtacagggggacaggactggggtttagggagcacccggaatgcacggggtgattcaggtgtatttcatgagtggagggtcgggg

SEQ ID NO: 51048 - DNA, 1100 bp, Homo sapiens
ttgcatctccctggaccccagccgggtgaagacaaacacaggggcaccaaggtgagggctgctctggaggcaccagtctgctcatttacggccaaatccactaggggaagctgtgcagcaggggtgaagggcgggcccgcaaataacgttcgtaaaccttcctgcttggagtcccaagtagcccctctgaggggtaacgtagagtcatctggggacctcagttgtagaggtgggcctggagcctgaactttatgtcctcacactggcctatcctacctgtcactcactgcttagccaggctgggcccggcagatgacctggcctttccacttcctgctaagcgtccctggaagaccctcctgcaaggcaagtctccgagcaggcccagcaggctctgctccacacccctctcccaccaggcgcccctgcaagtccatgctggggtctctatattagccaacctcacggaggtcaaaggggcctgtctggagtagaaaggtgaagctacacgttggcagcgcctactctggggagcatcattaggggctcagccaaacccaatccaccagagaggctgcttttagttctcagacaaaaagtgtgagtctgatttttattttatttatttatttatttttttgagacaggatctatgtcacccagactggagtgcagtggtgcgatctcggctcaccgcaacctctgcctcctgggcgcaagcgattctcttgcctcagcctcccgagtagctgggattacaggcgcctgccaccacgctaggctaatttttgtagttttagtagagacggggtttcaccatgttggccatgctggtctcgaactcctgacctcaggtgatccaccagcctcggcctcccaaagtgctgggattacaggcctgagccaccgcgcccagcctgcgtcttatttttttttttttaaccccaggaatgaggagtcggggaggcccggtaccgcaggctcagtgcttattccgggtccttggtctctagcaaaaacgggggaaatagctctagacgcttccgccttccacgtaactccacttccgttgccagatacgtcacttccgtagtcttgag

SEQ ID NO: 51049 - DNA, 2202 bp, Homo sapiens
atttttgtagttttagtagagatggggtttcaccatgttgggcaggatggtctcaatgtattgactttgtgatccgccctcctcggcctcccgaagtgctgggctcacaggcgtgagcccccgcgtccagccccatctgcatttctgtgatgtctgtgtaagttctgggtcccagctgggagccggaagttacagtctgcttgcgtcgctgtttgacctgtagaggggccttatctcgctctacgaacttgtttcttattgggagagtgttttgtggttggcttttaacctcttgttctgattctagtggaatcccccaaagaaggtaaagggagcaagccttccccactgtctgtgaagaacaccaagaggaggctggagggcgccaagaaagccaaggcggacagccccgtgaacgggtaggaccccagggctgcccaggtggctgtcagggttggctggagggacttctgctttgtaactggctcctgtcctgttcacagcttgccaaaggggcgagagagtcggagtcggagccggagccgtgagcagagctactcgaggtccccatcccgatcagcgtctcctaagaggaggtgtgtgcctcagggcgcacccaggaggccgataccggggtggggctgtccctcggggtaatcattctcaccctgaggtggtttcttgtttctctaaacctggagcttgtgtgtcttgtctgagctcctgtgggtgtgtggggcctggccgggccagatggtcacacgtgtggtggtgctgttcttcctcccaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctg

SEQ ID NO: 51050 - DNA, 4783 bp, Homo sapiens
gtcttactctgtcatgcaggctggagtgcagtggtgcaatcttggctcactgcaacctctgcctcccaggttcaagtgattcttgtgcctcagcctcccaagtagctgggattacaggcatgcgccaccacacctgggtaatttttgtatctttagtagagatggggtttcgtcatgttggccgggctggtctcaaactcctgatctcaggtgatgcacctgcctcggcctcccaaagttctgggattacaagtgtgagccactgcacccagcctcaacagttaattttctacatttgctttagtgatagctttactttctcttatggagaaattaggggaattctggcccctttagtctgaaatgactggcgagttttgcggcatgtactgactgaggaccatggccgtgacacggtccctcactcccagcgttgtgggtgccttctgtgtcacatggaaacaaagcacttgttttcccaaaaaattgtttccatctttggttccatctcctttttattggtgggtttcctcatctgcttgttcggctttctgccatctgttcaaattatccacaaattgcccaccacagattgaagtgctttttttttttttttggagacggaatctcgctctgttgtccaggctggagtgcaatggcgcaacctcagctcatgcagcctccgcctcctggtttcaagcgattctcctgcctcagcctcctgagtacctgggattacaggcgtgcaccaccatgcctgactaattttgtatttttagtagagactgggtttctccatattggtcaggctgttctcgaactcctgacctcaggtgatctgcccgcctcagcctcccaaagtgctgggattataggcatgagccagtgtgcctggcctgaagtgttcttctctgtttgctgaaagtatgttcatattgtgttttggtgagttgttaactgggatacagagacgtgtaggacaggccaacctcactggtggaaaggcattgaagactagaatgaaaccagccccatgaagaacgaggcctgtgccgtgggttgtgtggctgggctcacgggcatgcgtcctgcctggctgccaaggcagacagcaggtgcaatcgcaaagctccctccagctgagccgtccgccagacgtgtggccaggagccactcctgggatctagcttgaggctcttgtttgctgcatggacacccacaagatctgaattctgggctcttaaggttcttggtaataactgcctgacccgtatcttccagataatcgttatgtaccttcaggtgttagagtgtgagcgtaaccaacacctggtccagacctcatggtgagttgagcttccttgttttatgagaccagcaagggcagtgcaggaatgtgttgacttgaggcacttgggcagtgggtaggcagcccagtgacttggttgtgggctggagttgtccgagtgcccagtgctcctgctgtataaattccaatcagactcccaaaatgggcactggcagtcacggtaggtggcccgtcccctccctgcaagcctggacttcctgtgtcccccaccctgaagagagcagtcagtgggcttcctctgggagctgttgacttggcgcagggggaccttttcctggggagggtggagggacaggctagtgcagacttggtctgtttctccactgacattgcatcccatgggagaggggcagagaaggttctggggccgattttagcaatgcatgtgctagaaaggaaccctaaagtgcaatgtagtatttgggggattctggggattctggtgaattttttcccatggagttaagtctgtaagggtcatatttttgctgactgaattgtctggtgctatgacatgtttaatagagaacctattttgacttttcttttctgtactctttcaatcaaagggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgttctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttattggggtatgtgaggagcagtaaatataaaaccagttcaactgtcctcatggaatcaccctttctgtttttgcagtattcataaagctagtgtaaggtctggttttagtctattaaatcttagagatctaaaggaaatgctcaaaatgtagccaggttttaaatgctttaacttttaaaaaatgtaaatttttgtatgtttatagcttctaaatatgaaagttaaagaatgtactgtgatgaaatgttcagtattatgttgcttctcagtatcatgttgcttctcagtattgtgttgcttctgattctatgaatgttcattttaagaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagctttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggaggtcagtgtgttgctactatggagagattctagtctgatttttttttctccagcctccagtaaactttactgtgttattcttcaaattactctaatctgggccaaagcattttcgtgaccaacaggctgttttttaattgtcctgagtcttgctggccgtgaagttgaggaaagtgtaatgatgatagtgtttgtttttacagatccctttgcccaatcgtccccattggtttcttttgtttggagcaactgaagaagaaattcaggaaatctgcttaaagatcttgcagctttatgctcggaaaaaggttcttcggcattttttcatgtaacgtatgcgtttgtgtttggccagaaacacctggttctgaacggacaccttctggcttttgcaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctgggtgagtctgttagagtgcaggaatccactccccacaaaggcaaagactggtgactctcccccgcctccattctggggtatgtgctccttccagacattttttttttttttttttttgagacagggtctctgtcacccaggctggagtatggtggtgtgatcgcagctcactgcagcttccaactcctggattcaagtgatcctcccacctcagctttctgcatagctaggactacaggcacatgccaccatgcttggctaattctttttgt

SEQ ID NO: 51051 - DNA, 1052 bp, Homo sapiens
ttcctatcgtgagtcacataaagtgctttagcatttgtgccacgagatcctaaaacttgctatgttcggtctatgcttgtgcaccagaagctgttgatctataaggaaaagcagggagggatcgttgggaagggatgaggaggttggcactgggctgtggggagcggtgtgcagttttgttcatcagaggatgtggacttcatagcgatgttgtgttgtggggtttgtgttaggtgctcatagttggaggtaacgacgggatctcagaagccttgctctgcttgactgtggtgcagaccctgtgctctctctctggcaggaagcccgtgcctctactactggatcaagattatgttaatttaaagaaccaaattataaaggcggaaagacgagttctcaaagagttgggtttctgcgtccatgtgaagcatcctcataaggtgggtgtgcggctcctgccctgcgagcccgcctaggccgctgctcctgcctggccgcctctctccacctcagtgcagttgaaggctctgaagaggactgagtgcatccctgacttggctttccagtttctatttataatctcaagaatagttcctgacgtattcgtcttctagtgtcagctgtttattttagtaacacatttttaagtgttttggaaatggtattatttaagtttgggctttcaaaaatagtggtgagtttataaatgttgaattttagtttatgttttcctttctctacagttaatttttttttgttttctttttttttgagatggagtttcgctctatcgccaggctggagtgcagtggcatggtggcagtggcagtggaggcacaacctccacctcccggcttcaagccattctcctgcctcagcctcctgagtagctggcactacaggcacgtgccaccacgccgagctgatttttgtatttttagtagagacggggtttcaccatgttggccagaatggtcttcatctcttgccctcgtgatcctcccaccttggcctcccaaagtgctgggattacaggcataagccactgtgcc

SEQ ID NO: 51052 - DNA, 1026 bp, Homo sapiens
ggatgcggcgcggggctgacgctgccttgggttcgcctacgtccctcgggaattttgtcccggcgtggctcccgtagccagatgcttcgccgctcccgccccgctggctcccaaagcctgttcggcagtcgcggcgccgtcgctatggcgtcactgtcctcggggccaatccaagggctgcgcgcgtgtcccttacgcgcttctatcgccgggaggaaggggtgtgtgtggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgtgagtgcggcggggcggggcggcgcgggcgggcgggcgggacgggccggggaagcgggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggtgcggaaagcggtgcggaggtggcgctcataggttacaggggtcagggtctggggctggccgtggtcttcagttaccgccgagcgtgcgggatccttctgcgcttgccgcctccacgtggcacaggccaaggcgtggccagatgggtagatgggtttgttgggtggttgctagcagtttccacgtaacaagggaagcgtatttgagagttacttgattctaacgagactagcagatttgcacttcttgttggaaga

SEQ ID NO: 51053 - DNA, 1552 bp, Homo sapiens
tttcctcagcctccgagcagctgggactacaagagcccgccaccacatctggctaatttttgtatttttagtagagatggggtttcaccatgttgttcaggctggtctcgaactactaacctcagttgatccacccactttggcctcccaaagtgctgggattataagcgagagccgtcgcacccggtccactcagcaggattcctaaaataagcatgagctctgccctcagtgcagtccaaaagggggtgtccggcctccctcccggggggccttcgcgggcttctgctggtgcttctgtgcctgtgggtctggattcctccagggcctgatcctgggtgcagatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccgtaagagcgcaagaggccgcgagggaggccgcccggctgcggggagcggcctggggcaggactgggagctgggtgtggtcccggggcactctggagtcagccattagagctgccctcggaacggccttgcacaaacgcctaagacctgtaaggtccctcactgctgagccggacgggaggtccccgcgcctccccacgtttgtgtgaggctgatggcgcgtcggagtccccggcgctccgcccagtcggcccagactgcagctcccggctgagatgtgtctttgccgccctcttctcccccagagggcccagtatcaagacaagctggcccggcagcgctacgaggaccaactgaagcagcaggtgagctcagcctcccctgcgaggcgcctgcgtccctgagaacgtaggtggctttgtgggaccagtcagtgggtcagaggccacggggcaagaacgctggggttgctgacggtgggtgctagagcaggggaaactactcggacagacacgcaccagcacacgtgtacaggcacacatgcagacgtgtgcacacatgtacatggagacacaggcacctacccacacggacacacactcctcgcacacacactcccagcacacacagacaggtgcacccacttctgcacacacgggcacacacacacccctgcacacacgggcccacacacagacacccccacacagaggcctgcactcacacacccgcaaacatacccccacacaacacgggcaggcacacacccacatggacactcacacctgtaaacacacccccatacagacaggtacgcacatacaccccgcacacacacacacagatacgcacacacacaccacacacaggtacgtacccccccacacacacacaggcgcacacataccccccacaggctcactggcacccgcgcactcgggcacacacacagccccacacacac

SEQ ID NO: 51054 - DNA, 1050 bp, Homo sapiens
cacacatgggcgcgcgtacacccccctatacacatgggcacagcccccccgcacacatgggcacgcacacaacccccccacatgggcgcacagaccccacacacacatacgggcacacacgccttcccgtcacagggacacacacacacacccgcacatgggcacacacccacacacgggcgtacacacccccccccacaggcacgcacaacccccccaccccccgcacgggtacacacacacacacacacacacacccaaacgggtgcacaacccacccacacatgggcacaatcacccccacacacatgggcacagtcacccgcctgcacattcgggcaccgtcaccccccgcaaacgggcaccgtcacaccccgcaaacgggcacactcacccccctgcacactcgggcacagtcatcccccgcacacatgggcacagtcacaggttttaaaggcttttctctttttctgcggcttcttctcagcaacttctcaatgaggagaatttacggaagcaggaggagtccgtgcagaagcaggaagccatgcggcgaggtaggctgtctgctctcctggctggggcggaggtggcgggggctgcttgtggacccggcgtgcactctgagcctgagttctgccgcccggcccctcatagctaccagtgcagtgggcgaggcctgctggggctccgcggggtggggctgcctctcggaagacacctctgtctgcgagtggacgccaggatctgttcagggagggcaggagctgcttcacttcatgggaagtacaggggccttttttttttttttgagacggagtctcgctctgtcacccaggcaggagtgcaatagcacgatctcagctcactgcaacctctgcctcccaggtttaagcaattctcctgcctcagcctcccgagtagctgggattataggctcccgccaccacgcccagctaatttttttgtatcttcagtagagaaagggtttcactgtgttggccaggctggtcttgaacttcttgatctcattatccgcctgccttggcc

SEQ ID NO: 51055 - DNA, 3833 bp, Homo sapiens
cgagcgtgtgtgtgcgcgttggtggctgttccgtggctgtggcaggtgacccgatggcgcttccccttcccctccggcaggtcagccggcggctcctcagtcgaccccaggacgcgctggagggtgttgtgctcagtgtaagtcggtgtgcctgggaccggggaggcgcagggaggggaccctggagctgggccgggctgtggcccttgctggcgctcgtggtggcacccaggagcttttgggtcctgagatgcgactgcttggaccgtgctggggatagataggctgcccctgaggtgggaggcttcccgaggagccgagtctgcacccaggcattcccgcagccccttcccctgaggcttccatgggtgcacagtgtctcctccaaacccccgtcttccccggcagcccagcctggaagcacgggtgcgcgacatcgccatagcaacaaggaacaccaagaagaaccgcagcctgtacaggaacatcctgatgtacgggccaccaggcaccgggaagacgctgtttgccaaggtgagagcgcctggctgaacaggtgggccaggggccgctggggtctcacctgcctgcaggtgtctggggggctcagctgcctggggaatggaccccccttaggcctttgcccaccctcgtgtaggctcagggtgctggtgtgggcagcagcgcctcccatcttccaggcgggggacgtctcctgtctggcaggctgtggcttccaggcagggacgctgggcagagcctccacactccgggtggagtgtgcaggctttgcagaggcggagggaacatctgctctgtctcccctcactcttcctgtccagaaactcgccctgcactcaggcatggactacgccatcatgacaggcggggacgtggcccccatggggcgggaaggcgtgaccgccatgcacaagctctttgactgggccaataccagccggcgcgggtgagacgtccccacagcatgcaccaggcccttggctgcggcccagcaggctgccttctgggaagggggtccaggtgtctcttggggaccctgtctttctgcagctctgtccttgtggccacgcaggaggcccagtggagggtccctcggagggaaagtcccctgagtgtggaccctggtggacacgaggcccccagcgtgtggaggctgccagtgggatacttggctcagggcagaagggaggtgggtgggtgcagggggagaggagtcttcacagctgcaggggaggctcctccacagccgccctccccccaacacgcctgcaggtgggcgtgggcactggttgccttttctagaaccatttgaaagttagctgaagacagcatggcacactcccttcaataggtcccacagtgaccccgcgcagggcacagcccgggcacccttgtggcctcggctgtcctcgttggaaccacgatgctcatggttggcaccctcccctctggcctttgacctttcactttagaagacctgtccctgtcgtggactctaagcggccaccagtgctgcactgggccgggtgggggtgaagcctgtggggcggagttcgtcgcccccgtgtgtggttggtttcccacggccttctgaggctgggccgtggtcagctgcccagaggccaggctgatcggcttctgtcgagtccaggacttagggctgctgatggggcagagcctgaccccgtggggatctgcctgcttggcctgctcctgccgcggccggacgctgctgtgggctgctcctggtgtcactctcgccctgcttggcctccctctcgttcacagcctcctgctctttgtggatgaagcggacgccttccttcggaagcgagccaccgtgagtgtcactaagcctctggccacaatggggtggtggggtgggcacagccgtctgcctgggccaggctgcagccctctgttcagtttctttttctctgtaagctttgtgtgaaaaacagctttttttttttttttttttgagaagaaatctcgctctatcacccaggctggagtgcaatggccccatctcggctcactgcaagctccacctcccaggttcacgccattctcccgcctcagcctcccaagtagctgggactacaggctcccgccaccacacctggctaattttttgtgtttttagcagagacggggtttcaccgtgttagccaggatggtctcgatctcctgacctcgtgatcctcccgccttggcctcccaaagtgctgggattacaggcgtgagccaccacgcccagccttttaattatcattctaagacagggtctctgtcgcccaggctggagtgcaggggcgatcacagctcactgttgcctcgacctctggagctcaagcaatcctcctgcctcagccgcctgagtagctgggactgcaggggcacagtggaatacctgtctaatttttttgtaattttagtagagatggagtttcctcacgttgcccagactgggctcaaacttctgagctaaagagatttgcctcccttgacgttctgaagtgctgggattacagatgtgagcccccgtgcccggtcaggctttcttttctttttcttttttttttttttaaggcagaattttactctgttgcccacgctggagtgcagcggtgcaatttcagctcactacaacctctgcctcccaggtttcagtgattctcgtgcctcagcctcccacgtagctgggactacaggtgcgccaccacgcctggctaatttttgtatttttagtagagacggggtctcaccatgttggccaggatggtctcaaactccttacctcgtgtgatctgcccgcctcagcctcccaaaatccaggttacattcgtgagccaccgcccctggccctggtcaggcttttgagagtagatccatgaaagtgtcgccatgtccctgctccctgcaggagggaggcctgtgggactttctgctgtggctgtttacaaggctttgctcctggtgcctaaggctggaaccttctctctgcaggagaagataagcgaggacctcagggccacactgaacgccttcctgtaccgcacgggccagcacagcaacaagtgagggagcccctcgggtcctgggcccccgggcagggctgtgcagccgtcgcccttggttcccaccgagggacctgaggggccctggctcacagtgctgggcagctgccgtggcctcaacatgcccacctcggatgtcccctgggaacggcccagctcgggacagcacggggtgtcactgaggaacatgcgggggcctcccgggcagagctggggtcagtcctgtcctcacggccctgtgcgccgccgccccagcttgcaggtccctctgcccctaggtttctgcggtcctgtgcctgcaagggaggtggtctcatcgtgtgaggctctgctgggtctcccttggagggtgtgtgtgccctggggtgggagatggagacaagtttgctcccacgggaagttggacaccagcaggtcctgtgtgtcggggcggaacctgggaccttggtcccccgcccggatgctggccaagggtgcaccctccaggcttggggcccacccgactttgtgtggcctctgtgggctgccgcccagaggtcccccatagggtgaccgccccatggccaggctccctagtccctcccaagtcccctaattttgagttttcttggtctcctgggcccctccagccccagtcacgtgtcacacggaggatcaagtcctgctggtcggccgtggctgactcctcaggcacgttgggctcccaggtcagctgctgccggtggatgctcc

SEQ ID NO: 51056 - DNA, 7129 bp, Homo sapiens
gctggggccctgctgagcctccagtgaacccgggcccctgaggtcctgctcctggcacgtgtgggcgacttctcgacatggactccgggtcccgaatccctgctcccagcacagcaggggtcaggcagcaggagagagtggtgttcccggcactgcctatcaggctgggcgagggtcagcgggaaagcactatatggagggagaacagaggcccaggaagccaggccgggggacagctgggtgcagtggggcaggtggccgaccagggctgtgcccgtgtcctcgtgtttcccgccactttaggttctccctgtgggggctgaggaggccccgttccccttggtgcagctcggccggcagccccagcatcctcatcctcatccccgccccgcaggttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagtaagtgtcccgccccaccagcccccgtccaggggccctcgctcagggtccaccccgacccacagtccaccatcacttacaaacctttaacattccttttttttttttttttttgagacaaagtctcattcttgtcgcccaggctggagtgcagtgacacgatctcagctgactgcaacctctgcctcccgggttcaaacaatcctcttgcctcagcctcctgagtagctgagattacaggcgcccaccaccatgcctggctaatttttttttaatttttagtagaaatggggttttaccatgttggccaggttcgtctcaaactcctgacctcaagtgattcactctcctcagcctcccaaagtgcagggattacagatgtgagccaccgcgcccggcgtcttttccattcctcttcactacgaggagggctgtgaggaaatcttgtgctcggccacccccaggccctggctgtgaggggaggtgatacggagtgttgctctgagacccccgtgtcgggattcgaaggagtctctcctcatgagacccccgtgtcgggactggagggagaggctcctcatggtccactgctggcttctggcctggcctccctccagctgccacacccggccctggagcctcgtggtgtggggcacggctcttgctgctcacgtgccttgaggctgtcaggctccctgttgctggcggtgggtgcagcaggcacggtgggcagagccctccaggtgatgaggggccctggcaccacacaccggctgcctcgggaacactccagatgagcagaggctgctccacttcttggcgtcccccgggccccggtttctgagtccttctgtgcacctgacccaaatccctgctgtcgccagtgatgacaaaagagagcctggttgccgctgccgcctgctccatgccagcccagctttccgggcctcagtttccctatgccctccccttccctgggctcccccacccccatggctgctcgtagccctggcaccatgacttggcttctgtggcctccaggcagacgcttttgctagaagtcggggctccgccactgccagcataaaggccacctgccctgcgggtgctgagtgagcagctgtgggcagggctggtgtgaggagtggttggggccatctccaggccctgcagccactccctgctcagtccgggcctggcctgcagcagggaggatgtggagctgggctgtcagaagtagagagcccctccaaagaggatgtttggcgtgggtgtcggcctcgctgcctgtcttccggcctccacctcgtgttgtgggagctgctgccttggccggcccacttgggaactccttccccaggcgcctgaagctggcccagtttgactacgggaggaagtgctcggaggtcgctcggctgacggagggcatgtcgggccgggagatcgctcagctggccgtgtcctggcaggtgagtcaggctccggcacgtccacccagacgggaccccagctgctgtggagatgctcagttgcgccaggcctgtcccagcaccggtgtcacgcgggagcttctgttgaggggttttcagtgcacagaggtgacacagggccccctgccccagtcaggccactccacgaggcatcgcgcacctgctcgtgccctcaggagggtggagccatgtcggtggctgacagtcacccggggctctctggaggccagtctggcatcgccgtagcccgagctttgccaggtggggctggaggcttctgactctcaccttggccaataggcacctccctgtgtaaatggtcgttaggacaggccccatgtgagttgggggttcggggtggagggacattgtgttttctggaccaagtctgtgggcttggtcctgcttgacacatgggtgggagtggcctctggttgtcccacagccagttgttcttcggggacacccctcctgcagctccgtggctgctccagggctgaggagccaggactcacaggagtgtgggcgtggccatccagaaagctttggtctttgggggttgctggaaaagcaaaaccaggttggtggggcagaaggcaccctggccacgcacaggcatcaccacctctggggtccgcagagtctgtgtaacaacctggttcctcaatctagcagtgcttttgaatgaacgtgtgacagcttaatgaagcagccgagtaccttgatttgaatgttggagccggggttcacagggggctgtattagtcagtacaggctgggttatgccactgtgacaaagagccccagatctcaaaccccgtccttgtgggtcagctgaggtctctgttccaggccatccccacttggaaccaggtctgtttccacaactaagaaagcagaggccgggtatggtggtggctgacgcttgtattcccagcatttggggaggccaagttagattatttgaagccaggggtttaggaccagcctggaaagcaaggcaagaccccatctctacaaaaaatgaaaaaattagctggacctggtggcacatgcctgtaatgccagctgcttgggaggctgaggtgggaggatcacttgagtccaggaggtggaggctgcagtgagctgtgattgccactgcactccagcctggattacagagcaagaccctgtcttaaaaactaagaataatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaactaagaataatttggaacgagtgcggtggctcactcctgtaatcccagcacgttgggaggctgaagtgagaatatcatacacctgaggtcaggagtttgagagcagcctggccaacaaggccaatctcacctccactaaaaatacaaaaattaccccggcacatttgtggtgtatgcctgtagtcccagctactcaggaggctgagccaggagaatctcttgaatccaggaggcggaggatgcggtgagctgagatggtgccactgccctccagcctgagcaatagcgtgagactccatcttaaaaaaatagtaataggccaggtgcagtggctcacacctgtaatcctagcactttgggaggccaaggcgggcagatcacgaggtcaagagatggagaccatctggccaaatggtgaaaccccatctctactaaaaatacaaaaattagctgggtgtggtggcgcatgcctgtaatcccagctacttgggagaatgaggcaggagaatcacttgaacccgggaggcggaggttgcaaagagccgagattgcaccactgcactccagcctggcaacacagtgagactccatcccaaaaaacgaaaacgaaaactaaaaataataataactggggctggacgggcgcggtggctcatgcctgtaatcccagcactttgggaggccgagatgggcggatcatgaagtcaggaaatcaagaccatcctggctaacacggtggaaccccatctctaataaaaaatacaaaaaaaaaattagccagatgtggtggcgggtgcctgtagtcccagctacttgggaggctgaggcaggagaatggcatgaacccgggaggcagagcttgcagtgagccgagatcgcaccactgcactccagcctgggcgacagagcaagactctgtctcaaaaataaaaaaataaaaaataaaataataatttgggctgggcacggtggctcacacctgtaaccacagcactttgggaggctgaggcagtggatctccttgagttcaggtgatctgccccctttgtcctcccaaagtgctgggattacaggtgtgagccaccatgcacggcatcttgaattcttttctcataaaagggttttgaatttggtcgaatgcttttcctgcatcagatgagagggtcatgtagtttccttcctccactcggctaatattgattgatttttgtatgttgaacattttttatgtggaacattgattgatttttgtacgttgaactatccttgcattccaggaataaatcctgcttggtcagggtgtataatttttttattatactcctgaattggttttgctggcattttgttgaggacttttccaacgatgcttatcagggatattggcatgtcatttttcttgtggtgtctttgtctggctttgatatgagggtaatgctggcctcttaggatgagtgaggaaatgttcttcaatttgtccaagagtttgaggagtgatactgattcttcttaatgttttgtgaattcacatgtgaagacatcaggtccaggtcttgtctttcaacttttatagtttgaagattttaggttcccagaaaagttgcaagagtagcacagagacttcctgggcctgggaccttgccacgtggtgaacatcatgtgtcactgttggacccacctgtgactgggttttgccccagaatcccacccaggacgccacgtgacatttagctgtcacttctggtgggctcctgccaggtcccgtgcttcctggaggggtggccccgtgagcatctgcatagcccctttcctctgctgggccctgggtggggtgcagccactcgggtggaccctgagggtccctgcacctgtttgccctctcttgggtgcgctcaagaccaaaaatgatgttgagcagtcctgggccccggacccacagtggtggtgcggctctggtcagtgtctcctgcgctcccaggcccctgacccacagtggcggtgcggctctggtcagtgtctcctgcactccggggcccctgacccacagtggcggtgcggctccggtcagtgtctcctgcgctcccgggcccccgacccacagtggtggtccggctccggtcagtgtctccccacacagtggctcttggtgaggggtgggcgcttgcagaggggacgggcaccacgtggtcatccccatggcaggttccgtcgtggcgacggtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcgctcctgagcacggtgcccagtgggggtccccacaccctgaccctgaccctgacccacgggtgcctccccttggggactccacgcccttcgctggcattgggatggagagtgacccgttcattgcagaagggctggacctgaggctgcctgaagccacaccaagggccacagccccagcagctccagccttcacgtgccagatgccaagccctgtgctcaggaggacagggaggtgggggcagaggtggccttggtgccaccactcatgtgcctcaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcggcggtcagtgaggctccgccttgggctttctattattagaaagtcattgagcaacagcagtgctgaggacgcaggcagggctgtgggcactgcaggggctgctcccggtgtccacacacgtgctgggctctgccgaggtgcgggaagcctgtgtttcacgctcaggccatcctggagcccctggtttggtccctccccacctcggggccctggcgtgcatttggggtggggggttcccatggcggcctccctcagctgcctctctccccactaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcagg

SEQ ID NO: 51057 - DNA, 1089 bp, Homo sapiens
ggctggagtgcagtggtacaatctaggctcactgcaacctctgcctcccgggttcaagtgattctcctgcctcagcctcccgagtagctgggactacaggcgtgtgccaccacacccagctgatttttgtatttttagtagagacggggtttcaccatgttggccaggctggtcttgaactcctgtcctcaagtgatccgcccgcctcagcctcccaaagtgctgggatcacaggcgagagccaccgcgccaggcccatttttcaagcggatggaccctgtgtggagctggcggtggagcagggagggctggtctttagtgacggggaagggtcgcaatgccagtcacggttcaccccaggactggctggtgggtggggagtcccagaccagcttgtgctgagttggagatttgctcaggtttcctcgaaccatcagccgccttcggtttgaggctcattcattgtgctccccaaactgcagagtccagaaaccactggggctgggctgggcctgcagccggcagagctggggactcagccacattgactgcctgttccctggttttggagcctctgacgtctgtgtcaccttgtcccaatcagatctgaattccagagaacaggagacctgccagcctgtgcacgtggtcaatgtggacatccaggacaaccacgaggaggccaccctgggggcgtttctcatctgtgagctctgccagtgtgtaagtacccggctgggcgccgcgctgggcagaggttgtgacagaggggagtgaccgaggccgtgacagaggggagtggccgaggccgtgacagagggggtggccgaggccgtgacagaggggagtggccgaggccgtgacaggggagtggccgaggccgtgacagtggggagtggccgaggccgtgacagtggggagtggccgaggccgtgacagaggggagtggccgaggccgtgacagtggggagtggccgaggccgtgacagaggggagtggccgagacctgaggccggccctgctgcttggggcaaggtctgctcagctcgcctgtgtcgggggcgcctgctggtagttcagtgagtcact

SEQ ID NO: 51058 - DNA, 1042 bp, Homo sapiens
ctgctcactgcaagctccgcctcccgggttcacgccattctcctgcctcagcctcccgagtagctgggactacaggtgcccgccaccgcgcccggctaattttttgtatttttagtagagacgggttttcaccgtgttagccaggatggtcttgatctcctgccttcatgatccgcctgccttcatgatccgcctgccttcatgatccgcctgccttggcctcccaaagtgctgggattacaggcgcgagccaccatgcccggcctagattaaaaatttgaagacatattctctactatgagccaatgaaattactcattttgtttctatcccatttgctgtcccttgcttttggaattttgtgtcttagtgtgactgtgattctttctctccttttgtctttcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataat

SEQ ID NO: 51059 - DNA, 1832 bp, Homo sapiens
tggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagaccccgggcagctggtggttctccagggccaggtaccccttttgtgtgtgcgacctctgactaggtccctgtgggaatggggcagatggcggccatcaccactgggtcccagggcagaagcttagataccggccttgagcagcccgaccttccaccgctgcctggatcccaagcctcagccgacccaggggaccttggtggcaacggtgtgactgacagcaccacccctagcctttgcatgcccaggggtcgagagccagtatccggcccagacaatgccacccgccatggaagaaaagctgaccctgcccacctgctgcagacccgggccccgggccgaggttgctttctgtgacgaccgcctggtgacgctggacaccaggagggttatggcactgccctcccctcctggagcccctggcactgaccacctggacttgacctgactcctggtcactggccaaacacccatcctcaccccagccaccccgggccctggctggtgccgtgtgacacctgtagcccacctgtgtgtctttgctccgcccacccctgcgtggcgccggtcaggcgcaaacctggcgccagtgtctaaatgtccatcattctcagaccaacagagctgtctgtgtgttatttgggaggtgggagggaaggaaaaggtggattccccttctccccacatcccctgggacccttgggtatgggctggtgtctggccccaaaccctctcctggcctgggtggcattggcccaggcagcgtgtgcggcacgctgccttgcagttcctagcaggacaggcagggtgccccctgtttgtctctgcaccttcttgtcctgggccagctgtgttggcgggggaaggggaagacggtacctgccgtgcttagaaatagcccattcccacggcgacacacttgagctgtgacagtggcaattaggctgctccggagggg

SEQ ID NO: 51060 - DNA, 1048 bp, Homo sapiens
cctcagggcttcatcccactccgtgggcctgatctccctggggcacctgggatgtccatctgcgttagctggagctactccatggcctgtggcgtgccacacacagcggcatttcggtgtcattaggcacagctggaggtgcaaggaggagggcagcctcatgtccagttccatgtaacttgcttcttctgaataaaggcaatttgctaactttctcgctaaataggatttggtttctatggcttttaaagcttctccgataaaatacttgcaataagggaactctctcctcctacactctcctgactgatggttcggaagtcctcctgccctctgagagcttgcagtttcttgtgaaaaagagaaactaagcagcaatagaacagacccggtgtctgcttgcgtggttaagacggtaaatgctaaatgtgtgacactgcctttagaaaccattttctccagcctggcttgctggctgcccgtctggtttgctgtgttgtgtctccagtggctttagcttccaacaggaaagcctggtagccgagcgaatctgtgacccaggaagtagcaattaaatgcctgggacgctgcctcgaggctggtgtgtgctctgaggtaagttccgatttgccaaagcacatctgtcgatctgtcgcccgagtcttcacaccctgactgcctccatcattttaaacatcgggagcagttgcctgcagcggggttcagatgccagccaggggcacagcctgtgaactgtgggtagatggcaaagtctagcatttctggcaaaggaaaaaacatttggtaactctctgagtaaatttctgactgagatgaagatacccattgtggggcagcatcctgaagcggaagcctgggctgtatgtttccaagaggaggagcaggagtggccacagccatgtacgccacgatgtacaccaggggctgcgtggccacagctctggtctgctggtctgctccctggagcccctccaccagtgctgggctgtggctgtggctgtctctggtttgtctttctgggaaacct

SEQ ID NO: 51061 - DNA, 1032 bp, Homo sapiens
ccctctgcccacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggtgcgcgccaagggcaggcgggacgggcaggacccgggggcgggaacgcccctctgaccccaccccacccccaggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgcccgtgagtcccgggccgcaccggctcctgtgcggcgggtacccaggccttgccactggggccttggccttcggggagggtgctgcctcctgaccgctcccaggaagacggagcaagtctctccagagccgtggccttaagcagtggtgccatgggcagggcacagagggtggcctctgggtggctctacaggcagcagtggccatcaggcagccagcatcccccagggcggcatgagacctccaggaggacagcccatacccggagccagcacctgggctgtcttggaggctgctgcgctctggtccgagggcatcagctcggggagaatctagcctgcttggggcaaggacagccagaggtgccaccccgtcccctgcatttgtcacctttgtctctggccctccctgcacgtggagggaggtgtggttgtcttgggagtgctgttggccaggcctgctttc

SEQ ID NO: 51062 - DNA, 1947 bp, Homo sapiens
ctgacctgctggaccggccattcccgggcaagagctggggctgcggagcccagcaggctgggtggacagggggcctgctccactgcatcgctctcccaagtggctcaagatgggaagagatggcggttttcttctgagagctttatttgtgaaccctcttgcagtgtcacactgagtccccgccagggcctcccgaggatcccactaaggggcatcttccagggagcgaaggtggtgcgaggccccgactgggagtggggctcacaggatggtgagtggaggcagaggggcggggtcagggctgggctgtggctggctcatggctcagccttagcctgctgggggggcctctttccccaggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggtatgaggctgtcacactgactccatcagccctcctgccttggctgaagtcccagaggggaggggccgctgcctgaggcctggtctgccaccctccgcaggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggaggtgagccgccccgccgtggagccctgtgtgccctgccctcccagccctccgccccctcagccccttcctccccaagcgtccagcccgacccagccacagctccatgacccgccacagtttatcggacagacgggcaccgtgcatcgtatcacggaccgcggggacgtgcgcgtgcagttcaaccacgagacgcgctggaccttccaccccggggcgctcaccaaggtgccgggggggctgggctgcgcctcatctgcttgcttctgtaaccccttccacgtacccccttggccttggggggtcaggcaggactagggtgccagctgcacccacgagtccccagccctgaaggaaggggagggactggtgggtggaggtgggtggggtcaaggagaagagggggttgggtgtgaaggaacccagaggagggtatgtctctgggagctggaatgggcaggttagggcctccctctgttccaggacaccaggaaggcaggacagcttcgtgggcgggagggaggcggctgggctaagatgctcctggttagtgctgtatgggggccgatgggggtggctggttaggacagggaggtggatgcttggcctagagtggtgggggaggtagtgagggctgcctgggaagcaggatggcagggagggggctggaggtggtggcggtggcagcttggatggccctgggaggggcaggcccggggcaaagcgtcagagctcagctctggatctggggtcctggataccaggcacctttgaggaggcgccgaagggagtcatgagacgggcttgtagagtgagttccctgcatatgagggctcaggtggggcagagtgggcccgtcctgcaccccatggtcctggggccccacccccacgctggctcacgggccctggccatgttgcctgctgctggtcagcgtacagcttcccagggccagccacctcggcttcacacctgcccagagctggcttctgtctgcctggacactcctcccatggctctggggctagggacacccagggctgccttggacacctggggctctcgtccagccagagcctctggcagtgcctggggtcggggtcggggccggggccgagtcaggcctgcctgtctcgtggagctcagcaggtt

SEQ ID NO: 51063 - DNA, 2002 bp, Homo sapiens
ctgcaggagattgtggtgggcagcaacatggacaagatctacatcgtgatgaactatgtggagcacgacctcaagagcctgatggagaccatgaaacagcccttcctgccaggtacagccgcgccccaggggcctgtctgcgtacaagtgggggcagggtcctggtcacccccgcggtgacagtgctgcagggagggccagctgcatccacagggaaagccctgagaagcctctgttgctgccgaggcgagtgggccaccctgagtgccctgggctgggggcagccaggtccacatgggagcttccctccctcccaggggaggtgaagaccctgatgatccagctgctgcgtggggtgaaacacctgcacgacaactggatcctgcaccgtgacctcaagacgtccaacctgctgctgagccacgccggcatcctcaaggtgagcccccctccgagtggcccatcccagggagacctgccggggcccactcacagccgcccatctgtcgttgcaggtgggtgacttcgggctggcgcgggagtacggatcccctctgaaggcctacaccccggtcgtggtgaccctgtggtaccgcgccccagagctgctgcttggtgccaaggtgagtcctgggcgtctgagtgcctcccctgtcccccacgcagcctcccacagcttcgcgggcactggccctcctgaacacctctcctgacctcttaggaatactccacggccgtggacatgtggtcagtgggttgcatcttcggggagctgctgactcagaagcctctgttccccgggaagtcagaaatcgatcagatcaacaaggtgttcaaggtgggtctggccctgctgcaggtgcgctgtggggttgtggaggagttgcaggaatggggctgcggggcgcacaggtgctgggttgagatggggaccagggccactgagagccctcctggtggcttgtcttctctgacgggacacaggtgccaacactgtgggccacttggtgtggctgttgaagcacctctgtctttcaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagtgagcccagtgcagccgggtggcgggaggtcccgagccatagcggtgacttcccagtcccaggcctacctgctggctcaccacgttccagaactgctctggtgcctggcgtcccatgccctgagccccgtcccaacacagcccatctttgggggacccagtggagcacacgagcacctcctgggcctctggccctctccccccaggttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctggtgaggggcctggcgggtggggcgtgcccacaggtggggctggcttgggcagggttctcacggtagccgactcgtcccagggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgccagggcatcttcgggtgcccacgtggggcagcacaaacctccac

SEQ ID NO: 51064 - DNA, 1038 bp, Homo sapiens
ttacaagacacacagacctgaggcgcctcacgaggtaaccagcaggtaaatggagcgcgctccacccacccgccactaggggtcccagcggtcaagggggtggaatgcgggcgtccatcgcgaaggcattctgctcgcaagccttggcacaggcgcgggcttcgctaccggaaaagtcccggtaggattccggaagccggccacgcgttccgcgcaggcgcaaactgctccaaaagtgggcgtcgctcccccggagtcccgattcctgcgtcacagcccgcgccgaagtcggaagtgcgctcaccgggctgtttcttctggcgtcctggacctgagcaagcgctgttttatgcgtcatcatcccgcgcagacacaggaagtgccgcacagagcgagcccctgtccttgtctcgagttctgggccggaggtcggctattatatcatcattacgcgccaatacaggaagtgacgatacttttggcgcgcgccggttgctgtttcttctctggctccgggaccggcggcggcggcggcggcagcggcggcggcgtaggggtgagttccgactgggcggaccaggtgtgggagcgcgaggagaactgtgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcacgtaggtgttgttattctggttgta

SEQ ID NO: 51065 - DNA, 2207 bp, Homo sapiens
ccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggtaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatggactgctttgttttcttccttgtggaactctggtgttcatgctactttgttcaccggtgtggctggctgttgctagcaaagaggctcttcacagaagtggctg

SEQ ID NO: 51066 - DNA, 1055 bp, Homo sapiens
gccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggcgccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttc

SEQ ID NO: 51067 - DNA, 1037 bp, Homo sapiens
cctagtgaggtggggagtgagatccacgcctgccatgagctccacccctgccttgcggagccctgtcgcgagtgctctgtccttttgctctgccgcaccctttgttgttggattttcacctcaggaaagccaggtagctgctccacccccagccagggcccatcagtccgggaaactggcacaaagtctcctagctccctggctcagggcccagccagtcctagctccagggaggctgcagcccatggaggtttagctcccagcttgttgtcaccccaggctaagcagtgggactgtgctgctgaacaggaagaagggaatggtgtctttgtggagatctggcactgtcagtggcccgaggagtggatgagtcctttgttattccgaggctgtgggaactggtggaggggtcggccttctcctcactgaggcctggggtgcccttggaggcagctgtcctggtgcaccgaggggtcagggcacacatgggtggcctgggagcgtctgggtggcactgagctggcggtgtgatgggcagacggggagacctgggtgcacagacacacacagcagggggaggggaggagagagaggaaggctgcagaggccctggcattgccgccactggggagagggcagaagcgcctgttcccgggtatggggaggccaagtttcaggcacctctgagcactgctgggcaggtgagctgggggagaggccggcctgagcacccaggcgaggtcttcatgggggagggggtggcgtgcgtccctcagtgtgaacacagaatatttatgtatacatatggcacgcacgcaagtgcataaacataaacacagaaggaggtcacgaatgaggtgggaaccccagtttcccgggggagaagtgagacgaggaggggtactgggtcgggcagcacggccggcaccacacgctcccagagcgccttggtgagacaggatgggcgccccttcagatgcacagcctcccccgaagcaggaagagaaacccaggtgtgagaaacaggaaatcgggct

SEQ ID NO: 51068 - DNA, 1645 bp, Homo sapiens
gcagtgagccaagattgcgccgctggactccagcctgggcaacagagcgagactccatctcaaaaaaataaatacaggccgggcgtggcggctcacacctgtaatcccagcactttgggaggctgaggcgggcagatcacaaggtcaggagatcgagaccaccctggctaacacagtgaaactccgtctctactaaaaaatacaaaaaaaattagccgggcgtggtggtgggcgcctgtagtcccagttacttggaaggctgaggcaggagaatggcatgaacccaggaggtagagcttgtagtgagccgagagtctcgccactgccctccagcctgggcgacagagcaagactccaatctcaaataaaataaataaataaataaaattaaattaaataaataagatgtgatgtatttttacatgcccctgaaactgtcaccacagtcaagctaatgaacctgcccctcaccccctgcaggtcctctgagaggcatttcgttccatctgcacaaaacattgatttcttacatttttcatctgaatcttaagactcctaggccgggcgcggtggctcacgcctgtaatcccagcactttgggaagccgaggcaggcagatcaccaggttaggagattgagaccatcttggctaacacagtgaaaccccgtctctactaaaaatacaaaaattagctgggtgtggtggcgggtgcctgtagtcccagctactccggaggctgaggcaggagaatggtgtgaacccggaaaggtggaggttgcagtgatccgagatcgcgtgtctacactccagcctgggtgacagagcgagactccgtctaaaaaaaaaaaaaaaaaaagatgcctgaagttggagaattaatgtaattttttaaatgatgtttcagcttcgttcctatctgaatcatgcatttttctgggttgaaaaaacctcataatagcctgatgcttttccgcactttctcaagcatgacgcagtgctgttgtgttttatttcagaggagaagaagatgattctttggccatcaaaccaccccagcaaatgtctcggaaagaaaaagttcatcacagaaaagatgaaaagagaaaagaaaaatgtaggcatcatagccattcagcagaagggggtacagaagcatttactttctttgacatcatgttcaagtgtggtttctttcctgttcctactcttctgccttccccagagcaccactgaaaaaccagagaaagcaaactgtagctgaaagcataatggtgtcacagaccgttcagaagggctatagagagaatagctgaaagcatgcatgtgtcacagaccattcagaggggctatagagagcaaactctagctgaaagcatgtgtgcgtcacagaccgaaaaccagagagagcaaactagctgaaagcatgcgtgtgtcacaggccattcagaagggctatagagagagcaaactctagctgaaagcatgcgtgtgtcacagaccattcagaagggctatagagagaatactctagctgaaggccgggcgtggtggctcaagcctgtaatcccagcactttgggaggctgaggcgggtggatcacaaggtcaggagatcaagaccatcctggctaacacggtgaaaccc

SEQ ID NO: 51069 - DNA, 1073 bp, Homo sapiens
gagcaagaccctgtgggggcgcctggtgaggagggcacccgcttcctgttttgttgtccagggaattggtgggcctgtgttgtggaggtgcgtgagtgcccgtgtgtcacagtgtgcgtggccacccatgtgtgagacagtctcagtaggagctggccaggcgggccaggctgtggccatgctggcttcacgccaccccctgccctctccgtgcagtacccacagccgtgtgtgcctgcaagcttcacgccaccccctgccctctccgtgcagtacccacagccgtgcgtgcctgcaagggctggtgtcctgctttgcaggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggtcagtggtgactgttggcggggagagcagggggagccgtgtgcagggcgggggctttgctggctgaccaggccggaggaccgtgagccacctgcacgcccttgggccggagccaagcagagtgacgcagcgggctaggaggcagggaacgcccttccacctgactgtggcctgagggtgccttccctggggcccagccggttccgcgggccagagcggtggctggcgcagtgctggggcgaggctggaggctgggtacttggccaggtctgaggccacgggaacagagggcttggtcccacccggctcagttaggagcagggagctgaagtgtggcctctttgctgctgaactgaggactttttttcagaagggattaggcaggaggaccatgtgaccaatgaggaaactgttttgttttgtttgatttttataagtgtaggaagctcttttgacttagttgcttttacaacaactttaccaagtctcatcacaattgtgttttgctttgagttttgagtatgaagagcttaggcttctagtgtgggcgcacagtcaggaccataccgatggggcggccgcgtgttcgccaagcgtggcctggatgctg

SEQ ID NO: 51070 - DNA, 1109 bp, Homo sapiens
tttgttaatattattttacagaaaaaattttgagatgaagtttcactctagtcacccaggctggagtgcaatggcatgatctcgacttactgcagcctccacctcctgggttcaagcgattctcctgcctcagtctaccgagtagctaggactacaggcgcccaccacagctaatttttgtatttttagtagagacgggatttcaccatattggtcaggcgaggctggtttcgaactcctggcctcaagtgatctgcccgcctctacctcccaaagtgctgggatgacaggcgtgagccacggcacccagccaaaaacctagagtagttcttaaatatctttgcaatggaaacagtctgttttcaaagtactttggtaaattggacttcagccattttttccccttgatgaaatggaacatatgtatgtgtaaattattattgtttcatacatatttatttactttatttacattatttattttattaaattaaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggtacaactgggagggatggttcctcttttttttctcgtctgatttcataatattctttcttaaaacgattatgaagaattctcctgagtagtctgcgtcgatgcatccggaaggtgaggctgggtccttgcccaggtgaagctgtgcccttgaagggggatcctggcccatggacacctgcctggcgcacgttcccaggtgccagcacaggcacagggtgccaccgtgtttctctatctgtctgtatcagcacagaaccatctaactggcgcctacgctgacccttgatgttagactgaagcgcacttggagaggaaacttttttttgagactgagtctcgctctgtcccccaagctggagtgcagtggcgcaatcttggctcactgcaacctcc

SEQ ID NO: 51071 - DNA, 2957 bp, Homo sapiens
gctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggactttggtgtggtgattatttacgggtccacttccagtttgcaacgcgcccgcttccctaagctgtccctgttgctgtgaggtctgacgggcctgctcatgccaggcggtgccatggccgccaccacgtcacagaatccatgagtggcgcattggctcctcggaggggttcctgggaagctccacctcacaggccagcagagcagggaggtccacctgccatcgcccagacccctccccaggcataggccttgcccacagcaccgtgggagtctccacaggcggctgccttgcctttctcctctgccatttccctcccttagaatgtctgaggatgttactccagagactagctttccttgggactgaactgagtgttcctcttggtctgaatataaagaactgcatctagtaagaaaaaaatgagcactggccatggtagtgtggaaaaccatggctgtgtgtgtcccaaatagccgctcctaggctccagaaccatccacttccctgctttccaaactggtgattttttaaaatcttaaataggcaatacaaaattagctgggcatggtggcacacgcctgtaatcacagctactctggaggctgaggcaggagaatggcatgaacccgggaaggcggagtttgcagtgagccaagatcgcaccactgcactccagcctgggtgagagagcaagactgcctctcaaaaaaaaaaaaaaagtaattttttaattcccatggctccagcagctggaactttttttttttttctcccttgatgtggagtctcgctctgtggcccaggctggagtg

SEQ ID NO: 51072 - DNA, 1188 bp, Homo sapiens
gtgtccaagatcacagtgtttgtgtgcctccccagtgcaaatcccctcccatcccagtcccctgtagttcctcccccatccccccacccttttttttttttttttgagacggagttttgctcttgttgcccaggctggggtgcaatggtgcaatcttggctcaccgcagcctccgccgcctcccggtttcaagcagttctcctgcttcagcctcttgagtagctgggattacaggcgcacgccgccacgcccagctaattttgtatttttagtatagatggggtttctctatgttggtcaggctggtctcaaactccccatctcaggtgatccacccgcgtcagcctcccaaagtgctgggattacaggcatgagccaccgcacccggcccagccctctgttcttaccagagcacagtcttgctggtctttgcctgctgtgttctctgcagccctaccattgagcaatccatattcccaatgtttctttctgagcgtttacatgatgtcttgatttgctttctctttccagttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctctgaactctgcttcagggggaggagttccatgcagggacacctctgggtgccgttacagttaacatatcaaaggcaagcgtgttattgccaggtgtacaaaagatgagacttccttactaaaaatggtcatttgggcatttgaatttga

SEQ ID NO: 51073 - DNA, 1007 bp, Homo sapiens
tgctgtgagccatttgtttacctggcattggccttctcctgcctgccttttctgagaccctgtggaggggaggccaagggagggcacagagggagcagccacagatagagtcgcgtcccctccgccatccagggcctccacgtagcttcctgccaccccttccatgcccatccatgaccaaagagggggcacagcctcagtggtgctgcttgaaaagtgcccccagctccctgtttgctggcatttgagttgaggtagcgatcccgtcattctgaagcccaggccctgtgctcatctctgtataattttgcttgctttgctttgtttcccttccaaagttgtattacatttaaatttgtctttaaacaatttacgtttttaaagtaacagtgcagaggctcactgtggccctgggtggtttgaaggacagattgtctgtcacatgactagccacccaagaagttaaggctgatgtccccttgtcattcgctcctgctccagtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcgtgagtctgggtggaggtgtggggtcgggtcctctgccgtctctgctagccgttcagattgctaaattttaaacttttctggattagatgttctcctttctgatccttatacaacctcatgtacagatggggatacagaaaactcccgatgggaaacttctctgtgttgaccacttgtctcacagatactcacagggtgttgtatgccagtccccgttcccacctctacagctgagcagtggttgggatcctggaggggaaagacagtaagataactcaggccaccagtggttacagagcctta

SEQ ID NO: 51074 - DNA, 1060 bp, Homo sapiens
ttagtgttttcaccttacaggtaaacggaagcccacttaaatgctagaattttttcatttgtggcatcaaagtactaaattaaatgtccagatagttattttatgagagtcattttagacttcagctggccatgtgggtttttctggtcttctgaggcatgatttggtggcaggagctgtgcccagcccagggcacagacccctagtcacgcagttggtggggttcaccgagacatgggcccttaaccaacttgtcagcaaagcatctgtggtattataaggtgtcctcgttgtataaatttcatagatttacaaaagatttgtcacctagattgtcaatcttgagaagactttatttattagaagatatttttaaagtgcttctgttcattaatcatttttttcagactcttttacgtatcttgcttcccttctgcagtcagtccctcaggccctagagaggaggctccctgtgcagtgtctgttgagattggctgattggatttgcattgccaggcccagccaggctttcctctgaggctgacatgaacggacagtgctctctggtgttgccttccatgggtcgaggcacaggagaatagtatgttggtgggcgtgtggccctcacagctgtccttacacctgagccaggcttctgctctgtgcagggctctgtcagcgtctcaccttttgacagcttgttaagcagaaatgtgatagaataccaggtatggccgggcgcggtggctcatgcctgtaatcccagcactttgggaggccgaggcgggcggatcacctgaggtcaggagttcgagaccagtctgaccaatatggagaaaccccgtctctactaaaaatacaaacaaaattagccgggcatggtggcgcatgcctgtaatcccagctactggagaggctgaggcaggagaatcgcttgaactcgggaggcggaggttgtggtgagccaagatcgcgccattgcactccagcctgggcaacaagagtgaaattcggtctcaaaaaaaaaaaaaaaataccaggtgtgatcactgagaactca

SEQ ID NO: 51075 - DNA, 1015 bp, Homo sapiens
ggagacaccacgtggtaagtacctgacccggggcaggcagtgccttgagaacccacagcccctggcacattcctctgtgaacatggaggaaataaggttcttgacataatattaggccatctgtaatttaagtggccttaagatttaaaacacatagtagcaatgtgtgaattcattatactttttttttttttgagatggagttttgttcttgtcacccaggctggagtacaatggctcaatcttggctctgcgacatctgcctgccgggtttaaatgattctcctgcctcatcctcctgaatagctgggattacaggtgcccgccaccacgcctgactaatttttgtatttttagtagagaccaggtttcaccacattggccaggctggtcctgaactcctgacctcaggtgacctgcccacctcggcctcccaaagtgctgggattacaggcgtgagcctccgtgcctagcctcattatacttctaataaatttacaaagtttaattttcagcagctgagaactaaaatacacatttttttctttttttttttttttttgagatagagtctctctctgtctccaggctagagtggagtggcgtgatctcggctcattgcaacctctgcctcccagattcaagcaattctcccctctcagcctcccgagtagctgggaactacaggtgtgcgccaccacacccagctaatttttgtattttcagtagagacgggatttcaccacgttggccaggatggtctcttatccgttgacctcgtgatctgcctgcgtcagcctctgaaagtgctgggattacaggtgtgagcccccatgcctggccaacatagatattttaactacaatcaggctcaaagtacctgctcttcttttttttcccctctatatatttgtacctccttaggtgatgataggtgggagtagggtgggttttgattgtccctttctgatagcatcatgtcattgtgaacaatgagcacagactaaaaataaca

SEQ ID NO: 51076 - DNA, 1125 bp, Homo sapiens
tcaggtgatctgcccgacttagcctcccaaagtgctgggattacaggcgtgagtgaccgcacccggcctaatgtggttttgatgagtgggcagcactactgttaagactccacctaatcataagttgtgacttcagtaaaactggactgtgtggattgaatttgaatcccatgtgcagcactggacttctcattaagtatgcttcacctgagtggccacatatgggaatcgctctctagataattttggctcttattttgttctgttacctcctttgcagtgaaagttggagatgagaaaatcctggtgtcagtgttgtttttgaacataaagttgtttgcatcatctgtctttctgtcattaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtccttgttcataagcttcaagtgacacaagctgtttacctggggtacattatatgctttggatactcactttttatcaatcattttttaattaattaattaattattttttttgaggcggagtctcgctctgtcacccaggctggagtgcggtggcgtgatctcggctcactgcacgctccgcctcctgggtgttcacgccattcccctgcctcagcctcctgagtagctgggactacaggcgcccaccaccacgcccagctaatttcttttttgtatttttagtagagacagggtttcaccgtgttagccaggatggtctcgatctcctaacctcgtgatccacccacctcagcctcccaaagtgctgggattacaggtgtgagccaccacacccagcctttttttctttttttttttttttttttttaaagacagagtctcactatgtcacccaggctggagtgcagcagcgcattcttggctcactgcaacctctgattcctgggttcaagcgattctcctgcctcagcctcccaagtagctgggaccacaggtgtccgccaccacgcccagctaatttttgtatttt

SEQ ID NO: 51077 - DNA, 1018 bp, Homo sapiens
ttgttcatgctttgaagttggtctgacatttagagccttcctttcctttctttctttctttcttgaaacagagtctcactctgttgcccaggctggtgtccagtggcatgattgtggctcactgtaacctccgcttcctaggttcaagcgattcttctgcctcagcctcccgagtagctgggattacagagacgcactaccatgcccggctaatttttgtatttttaatagagacagggtttcgccatgctggccaggctggtcttgaactcctgacctcatgtgatctgcccacctcagcctcccaaagtgctgggattacaaacgtgagcaactgtgcccgaccagagattttttttcttataaataagtggctttgtctgaagcacatgtaacatgggagcacataagccaccagagtctgggttttagtctgttgctcttgtacactttctgtgttgtgcggtactgataggtttgcttttgtctgtccctccaggcttctcgtcagtgcctcgcaggatggtaaacttatcatctgggacagctacaccaccaacaaggtagggactggaggattcccttccttgaaaaaccaacccaggaaacagggttttaagctctggattcattttgttaaatcacgtaatacaggatagggaaggcagcagcggcaagctctgtttgttagtagtgaagttgcgcaggtgagatagaagctgagtcacgtgccacctgtcacggtctcttcctctggaccaggcacagttgtgctgttgtccgtcatctccttaccaagctggtgggagctaaggaccttctgtgtttctaggagacctcaattccagttttagcagagtctgggaagtttcatgttttatttatagagtgcagaagtatcacttttcattcagttacaagtttttagaagagatcatctgaaagacatcatactttaaagtgtaatttatgttattttcaagacttaatccaaagtgtattgttttgaataaaaagt

SEQ ID NO: 51078 - DNA, 1033 bp, Homo sapiens
ttattaagctctctgaccgggagacctctgtaaaggtgatcctcctaatctaggaggatgagctgctttagatcagctctgatactcgacagaaagtctcagaagggctgggcagaaataaagctagagtgggaacatgataccattacgtagaaataattttaaatgtttaatatgttgatgacaacctggattgagaagtttgctttaagaattgcaactgaaggctgggtgcggtggcttacgcctgtaatcccagccgaggcaggcagattgagctcaggagttcgagaccagcatggcaaaaccctgtctctactaaaaatacaaaaaagtagccaggcatggtggtgcacacctgtaattccagctaatgggaaggctgacgcacgagaattgcttgcatctgggaggcagaggttgcagcgagctccagcctgggtgacagagtgagactctctctcaaaaaaaaaaaaaaaaaaaaaattgcatctgaaaaataataggatgggagcctgcacttagtttttagttctgtgataaattttgtaataaagtgcaggtgaaaaggtttttatttgttcttaaactcattgacacctgtatcaaaacatctagtttgatattaaaagtgtcagagttatcaacaaaacttgagagagcgttactccagctttaggtcagctttaagaagccacatatgttcacagctgaaatagttaaaacctgtgttttgaggcgctgtggcttatgtctgtaatcccaacactttgggaggccaaggtgggcggatcacttgaggccaggagttggagaccagcctgggtaacatggggaaaccccatctctactaaaaatacaaaaattagccaggtgtggtggcacgtacctgtaatcccagctacttgggaggctgaggcatgagaatcacttgaacccaggagatagaggttgcagtgagctgagatcacaccactgcactccagcctgggtgacagagcgagactctgtctcaaacaaacaaacaaacaaa

SEQ ID NO: 51079 - DNA, 2443 bp, Homo sapiens
gcaggtgtgtgtacagctggtgctccaagtgatggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaacttggggaagttacctctctgtgcctgtttctcagggctggttggccctcgccctcttgtgatgtcagtgccctggctcaggaaatcacagaacctgccccgaggatcctgagggattaagtgtattgagccttagaacagcattgtgctgtgtgtgctttgctgcggcagacacacgggaatgcgctgtgagctgctctcaccattctctcatctggcctgtctgccctgccttcctttggtttaccatcccaagagataattcccttcatgggctcctatttgttcttttcttttctctttttttttttttttttaaagacggagtctcactgtgttgcccagcctggagtgcggtggggcaatctcggctcactgcaagctccgcctcccgggttcacgccattctcctgcctcaccctccctagtagctgggactacaggcgcctgccaccacactggctaatttttttgtatttttagtagagatggggtttcaccatgttagccaggatggtctggatctcctgacttcacgatccacccgcctcggcctcccaaagtgatgggattacaggcgtgagccactacgcccagcctctttttttctttttttttttttttttttttttgagacagggtctcactcagtcatgctggagtgcagtggtgtgatcatatctcactgcagcctcgacgtcctaggctccagtaacccttcctactcagcctcccaagtggcataggccacaggcatgtgccaccatgcctggctaatattttttggttttttacagagacagggtctccctttgttgctgacactggtctcaaactcctggcccctaagtgatccttccacctcagcctcccaaagtgctgagattataggtgtgagccaccaccacttctagcctatttcttgtactttaaattatacccctttcttctccaccaggcatctcccttccgtgaccccacactctgatttagaggctattacaaagtcttatttggtgcctgttctatctaaataatttaataaagtactgtttgatttgtgtaactgtgacatgctcgttgaagcacctgacataacaatttttaacatgcccttctttgagtagtatttctttgtattccgttgttagcgtggaattttctgctaggctttttctttgttcgtgaaattgtccgctttagagcacaaacagctagagaacaaaagattctatctttagtttgttctatatagtatcccatacaattccccatgcaaatgagagctcgcatgatggttccaatgacagcaggagtcagaaagaataaaagtgggaagggggagggtggggaagtggggagatgatattctgagggtacagagttttagttaggaataaattttagaaatgtgccacacagcacggagagtagttcataataacgtgtgtttcaaaattgttagtaaagtagacttaagtgttcccaccacagagcaaattggaagtgatgggtatgttgatt

SEQ ID NO: 51080 - DNA, 1044 bp, Homo sapiens
aagtgctaggattacagacgtgagaccgcgccctccatagaatttagaattaatgattgtttctcttgaaaacaaagtacttagttaatgcagtctgaagaaaagtttttttgggctgggtatctggtcctttttagacttttttttttttttttttttttttaatagaccttttctttgggccacagccttcctgaccctagatgggctttgtaaaaagagcaagtcgtgtgtgccagcctgtgcagcagtgagggcacaggcagcaccagggtcccgggtgtgtgggtgctgccccagcttgcagtgtggtctcctcggtgctggccacagctgtgggtccccaggaatattgtgctgcaggtcttagacagatttgggtactactggttctctgttcagcgtggcctggacagtccacagatggtagtagaccatggggtgttgagatgcaaggagactctgccgttctttcacattctgcttttgctcctgacagcttaggaaagctctctttgaaactttggtatgtgtggacctgagattgaatgtatctgaaaggttgctaatttctcactgtccttgcttcccaggacgccaggaaagcatgtgcagatgcaactctctctcaggtaagagcccactgagtcacgcagagccatctgcctgtgaggaggctagcacggcacccacacctggagcctcgggagggctctgcttgcattctctgttgcgcagtgaggatgccaagccactgcttttattaagaagtcattctgatggtaggcataggaaatagaggggcttattgagataaaaatgagatatctcaagccttgaataatcatctacctgttacagagggtaatagttgtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaac

SEQ ID NO: 51081 - DNA, 1084 bp, Homo sapiens
aactgctgatgtgaagagtaagagaaaaagaggcagacttctcaggaaaaaccacgtcttcagtatgtttttaggttttgtccatttgatgtaagagctttctcttactcttgtttgctctgtcaagctttagctgttcttcagagtgtcgctgtacaggaagctgatgacattcagtacatacctaaataacagtttataagctgggtatggtggtgcgcgcctgtagtctgagctacccaggaggatcacttgagcccaggaggttgaggctgtatagtaagctgtgattgcaccactgcactgcagcctaggtgacaaagtgacaccttctcaaaatacagtaaaataaaataaaaaacaacagtttatttttctgactccagtgcaaggatgaagtcaagtatttccttttaaacggccaattacatgtttagaaagcccaccaggatttggagagagaaacaccaacataattttaggcaacttgttcctgaacttgagaaaaaataatggaattctctgagatttacagccaaagagaaaacaaagtatcctctactgtaagaattttaaatcttaacatttaaaagatcttacataggtgaatagggaagacttagatttttttaatagtttgctctgatcagacttgtttaacatgtcccctccaccaaaattaatcaaatgtgttctgaaatatttagtttgatataaaattattctctgaaatatctatttaaataaaaccaaaaggtattcaaattttgcctgacttaatacttaagcttctgctgttcattttaagtcagcatggtttttggcaagtaaaaaagaaaagcaaagtgttgttatttaataataatctaactgggtttttgggggggttcagaacactctcagctctttaccacctgcttttgagactatatttcatcttatagaaatcagatttttttttttttttttttttttttctggagacagtctcgccctgttccccaggctggagtgcagtggcgcgatctcagctcactgcaagctcctcctcctgggttcacaccattctcctgcctcggcctcc

SEQ ID NO: 51082 - DNA, 1278 bp, Homo sapiens
aatgctgaagaaaagttctctggtttgtaatgagaccatagttctcagactttccttttttttttttttgagacggagtattgctgtgaagcccgggctggagtgcactggcgccatctcggctcactgcaagctctgcctcccaggttcacgccattctcctgcctcagcctcccaagtagctgggactacaggcgcctgccaccatgcctggctaatttttttgtatttttagtagagaaggggtttgaccgtgttagccaggatggtctcgatctcctgacctcgtgatctgcccgcctcggcctcccaaagtgctgggattacaggcttgagccaccacgcccaccttaaactttcaatttacttttctcacctgcttcattaaattatccaacagttgtttattgattgtgcttgtctttctgtttcagatctcacattcttgaaggtggcattgaagagcactaagatcggaagatgagtgagcttgaccagttacggcaggaggccgagcaacttaagaaccagattcgagtatgtagttgtgtgtgcttggttttattaatcatttgagtttcaggttagatgttacttgttttaggaaaaatggtttacaggatgacttgttctatgttttatatgaaattgaatcttagttggcccaggatgtactaattatagatctagatacttagcctagtacattgtttttgggattttgctttctgtatacaatttgttatttgaatatacaccagatgtctccgtagaatttataagtgtcttttgcattctttatcataaccttgaaaatttgtgataccctgggccactgatcagactgtgatatctacctccctcccctgaatattgggactattgacagcagaaaacttgcttaaaagtaagagtattaacaacaataaaaaaagtatttcaggtatatctgatgtattttttcctaattttgaaagatcttccctagcggtgatgattggaatctacagcttctgatagactgctagatggagcagatatatctaaatccaagatagaggccgggtgtggggggctcatgcctggaatcccagcagtttgggaggccaaggcgggtggatcacctgaggtcgggagttcgagaccagccagggcaacatagtgaaacccccatctctacaaaaaatataaaaattagctgggtgtggtggtgtgtgcctgtattcccagctactcaggaggctaaagtcagagaatcccttgaacccgggaggcaga

SEQ ID NO: 51083 - DNA, 1030 bp, Homo sapiens
tttgtcattggcaaacttgcagcctgaatgttgttattggtgactgtgtaatatggggtcctgagggcaccgctgaggtgcccctcctagactctcaggggtctggatgagaggcctgggctgctgcattgccatgaagggtagaggcactacacggagcacattgcattgcaaatatgaaatattctgactttaaaaatcttgctaacacttgactcacaaagatgttgttctaaagtaggggcagatcccttcacctgcttgcttttaagttattcaaatctctctcaaaaggatttccaaaactcagattctgaataaaagccaatggcagatatgggtcatcaggaagactagacatgaggccttagcagagcctgtcttagtggattagacgggcgggctcttggagtcagcacagccagagcttagccgtgacgtcggcaccggaggagaggagcccaggccagggaaacctggtggtgggtgttctggaaggtctgggggactgagggaagcgaagagaaaagcaagagcaattaaatgtgagtaagacttttaaaatttacatttattctttaattttcaaaggaagctgcatcaatattacgtttagtagaaaaacgtgactaatagttataataaaaatgctattctatctttctttaaagtgagtatatttttcttttttcttttcttttttttttttttttgagacaaggtctcactccatgtgctcaggctagagtgtagtggaacagtcatggctcactgtagcctcaatttcccaggctcaagtggattctcccacttcagcctcccaagtagctgggactacaggcgtgtgccactgcgccagctaatttttgcatttttagtagagaccaggtttttgccatgttgttgcccagcctggtcttgaactcctgagctcaagccatctgccagcctcagcctcccaaagtgctgggactacaggcatgagccaccgcgcccagacctattttaattataataaagcagctacaat

SEQ ID NO: 51084 - DNA, 1006 bp, Homo sapiens
gttcaccctgtccttgggaccccgctcagatttctccacaccagagtggccttctctggccaccttctaagagagacctccccatctcacctgtttccccttcttacgtagttttatgtttccttagcaatggatagcagttgatgtatcaaaataaagacttgcactgttcgcttaatgccttcctcgaccaacaagcaagttctagaacagcaagtgctgtgtcttgtttcctacggactcccctgagctgtggtgcctggcacatgattggagatgggcaggtcgttgttgagtgagtgaatgaagccatacaaatacgaacccagatattgaggccactttattgttaaatgttttatcaacaattgacacttctatcctattttcatgttgttatataatatgactatatatgtactcagactcccaagtaaatatttgtgcttactttactctgacctaaactggtgcctggcaccagagtaggctcacaaaatgcttttctcacagtgaccgcctaacaaacctagacattagctgaggtttatagagcactgtgtcattctaaatagcctgaagacatagtttctattattcctgtttccagttctctttctaaatcacagatgatttagaatatgggttataaaaacatttccaactcagggtactttctatattttgtgggttttgcaggaaataagctaagttttggaagcatgtcttttttcttgcttggtggggagatattttacctttaaaaattggctctcattctttgaggcaaaaatatgttcatgtttctaggatttctctttaagagactagtggtcagagttcggcagagaccaccaaagttgtctggggtgttcgtgcccatgtgtttggccctttctaggcttacttgactccctggggaggagtacctgggaatacagtcagtaagagctttaaattaggccaggctaaaaagtttgattttttccgtaggaggagtatttga

SEQ ID NO: 51085 - DNA, 1027 bp, Homo sapiens
tggtcaggtttctgtgggagatgaggctctaaaatcagtcaaattatctcacatattactcaggttggctataaattgcataacttacatgattgggtgttgtcacatactttcttttctttgtttctctgtggccctcactgcttccatttctagccagcaccacctcacaacttgcccatctgagcctctgttactcatttgtttggttggaaaacctctacagcccatttgtagactgatggctgaagaggggcagtgaccaaggattgtgttcatctgatgaacagacgccagtgatgctgttcagcaccctgcaccacccgggatgaccccagtgtccacagtgctgagggtcagacacattcagcctgggtctagcactgtgctcttaggtagagggatgtggcctggcgtggggctgaatgaggtttggttttccctcttgtgtgtgtatggcagttatttgtgtggacttcagcaccactgcagttcaaattcagccaccttgcctcctccgtggtgttttctaagagtctccaaggtgtgatgcctacgtgtaataccttaccggggagccctcctcagcttccttacctttctgctgggtgtatttgttctgcttctgtacaaataaagtactggccaggtgtagtggattgtgcctgtagtcccaacactttgggaggtcaaggcagccgattgcttgagcccaggagctggagaccagcctaggcaacatgggggaaaccctgtctctacaaaaattacaaaaatcgggggcatcagagcacggcttgtagtcccagctactcgggatgctgaggtgggaggattgcttgagcccaggaggtcaagtctgcagtgagccgtaattgtgccgctccagcctgggcaactgaacgagaccctgtctcaaaaaaaaaaaaattaataaaaatgaagtactttacactaccgggtaatagacttaggaaactgattgtctcactcagtgtggggagaagttaatgggtggacttctcac

SEQ ID NO: 51086 - DNA, 1089 bp, Homo sapiens
aaacaaaaccccacaaacaaaaacataagattgtctttgggcctggtgcggtggctcacgcctgtaatcctagcactttgggaggccatggcgggcagatcacttgaggtcaagagatcgagaccagcctggccaatatggtgaaaccccgtctctactaaaaacaaaaattagctgagcatggtggcgggtgcctataatcccagctactcaggaggctaaggcaggagaatctcttgaacccaggaggtggaggttgcagtgagcctagattgtaccactacactccagcctgggtgatggagtgagatgttgtctcaagaaaaaaaaagaaaagattgtttttgaatctgaagacataacaaagcagcattacaagttgtgttgtacaagtgtgttagcgtaggttgtccttgataaatggaatataaatagctctgaagtttttgtatatattgacctattacaaaatcagagactttctttcggggttgggagggcagtttgagggtagttgggtcatctggaagaagaggcagaaaagaggaaccagctacgtgatgaataactgtgataagacaaataggctcctctactgccacctccttgttttttcctgcttactatttctgtggctgtgattgttgggattcacgggaggaggaagcagggacagtaggaaaagctccagttcctgatggacctgtgttgctggtgctgcactgccttttctctgacttcatcccacccacctgagagacactaaggtgggggctgaggtccaccctgtaattaagctcttgggcatgaatggttagctgaaacaagactgtcaccttctagtgaaattctgttttttggattcttatagaagtcagtagtaagtgtctgagataatgaatggtcagataacaacataaaggagcagtggactgactagagcctctggtctttgtaagtttgcttcttttttgtaagtaacttattcttttttttttttttttttttttttttgagaaggtgtcttgctctgttgcccaggctggagtgcggtggtgtgatctcagctcactgcaagctccgcctcct

SEQ ID NO: 51087 - DNA, 1045 bp, Homo sapiens
acaaaagcccctggggtccttaatagttgaggatgtagagggggtctgagccgaaatatctgagcagcgctggtttagagaatgggccaggcccagggcacctgtggggaccagagaagttctcagctggagacaggcaccctgtccctgcccccatgtgcagtactgtaggattgtgccttttcctggggaggagaactcagagatttgtcagaggtgaagacccgttggtgtagcttgagaagaggcccttgtgttagggatgtgcagaggaagagaaacacttaaaggagtgaccagactttgggagactctcagcactagtgtcgcagaacccacagaaggtattctgagagcagagggaatggtccgaagttggagatggattcgtcagtggtagagattgctgagggccagtgagttccagtggggtgaggagagtcttgtaggaaagtagtcggagagagaagtgtggggctaggggaggctctgtctgcatggattttagatgggaatactgagagggcagcgcccataaaggggaagagaggagagatcttttgtaaaatgcgtattcagggccaaagatgtgccaaggagaggcaggtgatgggcagtgaataagagatgccaacttgccttggtgagaggaatgttacctatgcgacagtggaaaaggctgtgtgctgaaaaagatggcggacgagtctgctgtagggctctaggcattgctggtgcttccatgttgaaaagggtggtccaaacatttgaggagagagtaggaggaggtgagaagacaaaccagacagacatctgggaaaagagggttccaggcaggagaagccccaagtcagggctgtgcttggacttggaattgaaataagtcctggaaaattggttaatccccgcttggcatacatattatgtaaagtgtgttgggagaggtacttgaaggttttcctgttgaaataaattccctacaaccttagccttccagtccctctgcctgacactcccatggcagttggtgcacttgcgttttgcc

SEQ ID NO: 51088 - DNA, 3153 bp, Homo sapiens
caagaaagtggataggcggttccttctttgctaacgctgggttcgaggctggggatggaggtggtgccactgacatggagacaggtctgagagcctccccagggtaggactgaatggtgggttttgtcttggtttatgctaaggcagaactttctttactttttgagatggagtttcgctcttgttgcccaggctggagtgcagtggcgcgatctcggctcattgcaacctccgcgcccccgggttcaagtgattctcttgcctcagcctcccgagtagctgggattacagctaccaccaccacacccggctaattttttgtatttttagtagagatagggtttcaccatgttggccaagctggtctccaactccagacctcaggtgattcacccgccttgatctgccaaagtgctgggattacgagcgtgagccaccgcgcccagccggtaaggcagaactttctaacgattagagctgcgcagaaatgaactgcaactgcagggtccagaggctgatgctgtcaaccctgggggaaggctggactgcaggtgttgggcggtggtcccaggttacgagcatttggtttcatcaacactgaaagtgctccccccgcccgcctttttttttttttttgagattgagagtttggaaaaccagttaagttctgaggtgcctgtgccccctcccagttaagtgcgcactgcccaggcccagtgtgaggatgacattttatcttctgcgggaacctttcaagatgagtcttatagaggaaactgttccaacatgaaatttcagctcagaattgactttctcaaaagagcacatccactggccaaaagctatttctctcgcgtaatctgaatttatgacagaaccatagttatctcatcagacaagtactgacagtgctcttcagtgatacctttaaaatattgttttttctttgatatcttcagttaattctgtttttttggtgggtgggaaagttgaagtaaattttctcagatttaattttaatcttagaagattcaagagactgcagaatagtgtgtggtttttttattgtttgtttttaagagtaaaacccactgggtgtggtggctcacgcctgtaatcccagcactttgggaggtggaggcgggcggatcacatgaggctgggagtttgagaccagtctggccaacatagcgaaacctcgtatctactaaaaatattaaaattagccggcgtggtggtgggcgcctgtaatcccagctactcgggaggtttaggcacgggaatcgcttgaacccgggaggcaggggttgcggtgagccgagattgtgccactgggcgacagagtgagactgtgtctcaaaagagtaaaaacctctgtaaatccttttgatgcccaatgactttgatttcaaagctagtatcatctaggtagatttatgttgatcacttgagaaacagaatttgaaaagttaatttatttctcaaaggagatgttgtactatcctgcaaaagtaccagagctttgttctcttccctttgctttgctaaaaatttctgggtcttttggtttattttatgtgtgtgttggtccactggaaaagttgtagctttgtagctaaaaacagctttgataaaaggatgaaaaaggtcttcagggcatctctagacttcatctaccatcagttgactttttgtagctaatactttaatgaataacattggtattattttagaagtgcagtgttggcatttattatagttttgtcgttgtttttctctgcccgaaagatttggctcatgttggtctctaaattggattacattcttactgtctgtgactttggctttagcattagtggattggtaatagatattctcaatttttaaatctggcttgaccatatggcaggccatgttattttgaaacccctatttagtgtaagtctcacaagacatggaacaaaaatttttataaaattttaaactggtttgaccgggcgtggtggctcacacctgtaatcccagcactttgggaggccgagtcaggcggatcatgaggtcaggagatcgagaccaccctggctaacacggtgaaaccccttctctactaaaattacttctctacaaaaaattagctgggcgtggtgctgggcacctgtaatcccagctactcaggaggctgaggcaggagaatggcaggaacccgggagggggagcttgcagtgagccaagatcggccactgcactccagcctgggcgacacagcgagactccgtctcaaaaaataaaaataaaaaaaattttaaactggtttacattctgatttcaggtttgcatttgttaagagtggttggagagattatgaagtaggcaattcagttaagtgtttggtttaggaacacagaatgaggagataaaataaatttaaaatggaaactatcagaaatttatgaaactgcagtgttcaacattactgaaagaaaaagcagggccaacgtatatgggagtgagtgtgtatgaagagagagaaatgcaacatcacatcagctgctctgggagagggacagagcaccacctatttcaaagctatgcattttgttctagaactttgattgaagaaatagagacaatctatagacatttgagtttgctagtggattagtggaatgctgaaagctttttttgtgagacagagtcccactcagccacccagtctggagtgcagtggcgcaatctcggctcactgcaaccaccatctcacgggttcaagtgattctccagtctcagcctcccgagtagctgggattacaggcacccgccgtcatgcccggataattttttaaaattttattttagtagagatggggtttcaccatgttggccaggctggtcttgaactcctgacctccggtgatctgcctgtctgagcctcccaaagttctaggattacaggcgtgagccaccgtgccctgccggaatgctgaaagcttttttaaaccttttagcctcttgttcttgtgtcagtgcctaccattgggtgccatggtaatcagtggaaattactcctggctttcagtggtagaaaagctttctgttttatagagcaatgttgcttgcttgcttttttttttttttaagattaagtgggccggg

SEQ ID NO: 51089 - DNA, 1050 bp, Homo sapiens
gggctgggttgggcagggcagggctgggcagggctaggctgggctgggcagggctgggcagggctgggcaggactgagcaggactgggcttggcagggatggactgggcagggcagggctggggtttaagcctggaacctctggcttggcctctgcccatctgcttcccactggagcttgcgtttagctccaggaccaggaagttcccaccccaagagccctgctgggtaggatggagtccccaggagggagctagggaggggccgccaggcgctgtctcacctggggctgctgggcaggaccggagcccccaggagggcgctagggaggggccgccgggcactgtctcatctggggcaaggtggaggcaggggacctcttgcactcatctgagaagcgactccacgcagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggtgagcaaaacgccttcctgtagacagaagccgcacacctgtggagggcaggtggggcctcagggctcaggtgtggtgagacatcctctgaggacctcagcaccatggccacctgcagggggttgctgagcccgctgagtggccgccactcagctcaaggacaaggggacaagacacactacggacccaccacatgagagaggcccatggccgcagcatccccagcaagggtccagtgtcctcctggtctcggtgtgcccaccagaccctgcgtcacccccagcagtgttgctgcccaccaggctgggaccaccttgcctggccctgtagagctgggtcagccgcctgccagggagatgtgcacagccgttcagaccacatgcctgggatcaccctgctacaaagcactcctgatagcacctagaggacagctttcctatc

SEQ ID NO: 51090 - DNA, 1020 bp, Homo sapiens
agctgggccctgtggtggtccctcccctccacgcagggtgagaccagctcttgctcagtgcaggaggtgaggggggacctcgggtccctatcagcagggaagtgccagccttcaaagggtgcctgggagtccgtgagcttccccagcccctggagttcaggtcctgtctggggctgaaaagataaaacacactgactctgtgtgactcggttttaaaaaaaaaaaaatctgccggggcttctgccgtggctgcagcaacggacccagtgcccactccggggtctaaagagtggcctttcattatggaattatttaatccccgccacttcaccgctggcaccgtcgaggtctgggggcaggtctgactggtttcctttaccttagtgaagccggcggcctgcaccgacccggctcgcgcccatcccggggtcacccacatttgggtgaacttgaacgagtgcccgaccaggtaacgttgccggacctcccacaagagggcactttcttttctcccattttgtcctcattctttccagccaggtaggtcgcgcttttttctctgtgcaaggaagttgatggtggtcatttttttttttttttttttaatacggagtctctctctgtcgcccaggctggactgcagtggcgcgatctcggctcgctgcaagctccgcctcccgggttcacgccattctcttgcctcagcctcccgagtagctgggactacaggcgcccgccaccgcgcctggctaattttttgtatttttagtagagacggggtttcaccgtgttagccaggatggtctcgatctcctgacctcgtgatccacccgcctcggcctcccaaagtgctgggatgacaggtgtcaggcactgtgcttggcaatggtggccattttttaaactatggttatggttaatggttctattttgtgtgtgggaggggggagggggtggggctgtcatattgtctttggggaaagtttcatttatctaatcaatgatttggttagttggtaa

SEQ ID NO: 51091 - DNA, 1052 bp, Homo sapiens
ggtggggctccccgtgccccgtgcctcagtttcctcctctgtaaaagggggctttgtgaggctcgacagggtttagaggagctcctggaacatagtaagtgcttagcaaggccgtcttgccgtctctcccacccagggagggtcaagtgggaagagagcggccccaccgagtgtgttccaggccccggcggcgtctgagaggaggcggccaaacctagtggggctgcgcgaccgcctgtggaacagtggggacgctgctggtgtcctccaggcctgggtgggcgggttaccacggaagcctatcaacggatgcctgtgattccctggtatttataggtatgtctattgttttattaaaaaatccagtttcattcagctttgtctcaaattatttgcaacaaactggaaaagctagttttccccctaaaataggcttctaataaaattggcaatttgcctgctgagcctgaatatcctagagttctgcaaagctggatattttgggatggattagaagagaggagttggctgaaggacagtggtcgtgctgctgagccggccgtctgtgtgaagtttacactggaccaggataaatgcgtatttcctgtgggagctcagcgtggccatggtattcggtggtcttatgattttataggcctagccaggggtctgcgagctgcttctgtccagggccaggtagttgaagcctggggttctgagcaggcgtgggcagcacccaaggaggtgcatggccgtgtcctagtgaaactttatgcacgctgaaatctgaattttatagactcttccggtgtttcaaaatattatccttttcattttattcagccaattaaaagcgtagaaatcctagcttgctgatttggagcactaggcagtgtaggttgccagccctcgttccccatagatttgggaagtcgagtgaaacgcatgtgttaggtttatatgtttcacattttacggaatgcccctcatgcagctggtcagccgcctgacgagggaagcttggccctttggagaagtggccgtgcctcgtg

SEQ ID NO: 51092 - DNA, 1138 bp, Homo sapiens
gacttcagagccactggtggttatgtaaggagttgtgtgttcctctgcccaactccgagcttggtcccacctcccagactcacctctgggctccgggctctgctgcgatgtttccgaggctcccagttaatcagatctgtcagcccagtgtccacagggtgcctgagagcccagcccatccacactgggtgccccagaccttccacggggtctggtggggacctgccagggctgtcaatggccccagtggagaggcccactgagcatcctgagaagttcccgtgcttgtgacctgctctcgtgtgtgtagcagcgggggctgcgtctcatctgccacacgtttctgatcgccgaggactcagccgggcacatggaggttgaactgttggggggcgggaggaccatccatggggtcaggcaccaacctctgctgaggatcccaaaatgtggggtagccatcctttcttgtgctggcgtggagcttttcccaggagctgggcagggagctgtcacagggccaggcccctgaatgggctgtttggggccggggctgagggggtgcccagtgccatcgaggggaagcctgtgggaaagtgtgatgacatctgaaaaaccaggagcaggtcccttgctgtgctggtcgtggtgctcgagtgtgggctcagcaggtctggtctcctggcgcccactcactccctggccatctccccacctccctcacatggcagggggaagtggaacgtgcggccactgctcccaccgtccctcacagcacaggctggacaggcaccctgaggcatccccatctcccagcccctggggttggcatgatgctgggcctccagaaatgtttgtcattttatgcaaagggcagaaaaagctttgttcaggccaggcacagtggctcacgcctgtattaccagcactttgggaggccgaggtgggggatcacctgaggtcaggagttcaagaccagcctggccaacatggagaaaccccggctctactaaaaatacaaaaattagctgggcgtggtggtgagcgcctgtaatcccagccattcagggggctgaggcaggagaatcgcttgaatccgggaggcagaggtcacagtgagtcaagattgcgccaccgcact

SEQ ID NO: 51093 - DNA, 1030 bp, Homo sapiens
agcaaccccttcctggtcggattacactcctgcttccagacgacaagtcggtaagaaaaagaagggtatttctgatattctgcagatttcagatgtgaactgcacagaagctaagtctggtgtgatgtgtcaactgtcacctgtaaggttctcccagttgctgtacgggtgttttcaggccagcagactctctttgttgttctccttggttggtgtcatattaagtacatttcatgatctgaagttatttaattccatttacgaaatacttactggaggtatcccactgagtgcaggcattgggtcaggtgctggggctacaaaagtaagcaaaagaggtggatttctgtgcttattaaaatatgtacagcttcaccttcaagctttatatatactggaattctgtggctttgaatacatttgaaagctgatgatctaggatattaaatgtatgccctgtttaaaattttgggggccagttgactttgacctacctgatttgtttatttgaagagttattaagtatgttctgcattgagtcctcaagaccatccccaggttcgatgattggctaggaggactgctgggatcaatcatggccgcactgggggccacagctggcatactgcactggggagataaaggagacttggccaaggaaaaaggcacatggggaaaattccagaagaaaccagtcacaagctcccaagagccctctcccagttcctccagcaatgaattgtgacaactcatggtttttgtcaagggctggtcatgcaggctgcacacgaaccaaaattccagactcccagtggagagcaggtgttcagcattgcgttagtcagggttctcctgagaaacagaaccagttgtgtgcacgtgtgtgtgtgtgtgtaaagagatttattataagatactggttcatgggattatggaggctgagaaatcctataatccgccatctgcaggctggaggcccaggagagccagtggcacagcttgaaggcctgagagccaggagctgatgggg

SEQ ID NO: 51094 - DNA, 1004 bp, Homo sapiens
ttgaacctttttaaaaaacaaaatggctgtagaaggaaacacaggagagtatttccgttactgcagcgaaagggcttcttcaagcttagttctgtagaagcagaaacgagagaggagggtcgtccgcaggttccaccagtgcctcgtgccggtgtggtcacaggtgccctggcaggaccgacagcccagaggcagcctgggagacctccgtagtgtcagggacggtggcagggaggccgagctgccaggtggaggtgctggttctgtttgggaagtggaagtcacagaggcctgtgtgccgcctgctcaagcctggctcacactcgtgtcaactgggcatgaaaaccaacgccagccaggttcgtcctgctgccggcccatgtggccccactcggtgatggctgtgtgctctcccccagggttcagcgtggactggtgggcgctgggagtcctcatgtttgagatgatggccgggcgctccccgttcgacatcatcaccgacaacccggacatgaacacagaggactaccttttccaaggtgcgtgccccgctgtgcgttcgtacccctcacctgcacgactgtcttccttccttttcaaaggtgcaggtggaggggtcccgcgggtgcctggagcggcagtgccatgcaaagcgtaccgggaaccattcctcctggccagaccctgtgtcacatgccactccccgggccgtggggtggggttaccacacctgtgggtcagcaggaaagagaacctgtccccattcagctccaactccctcctgccctggccagcagcacatgctggagccccagcatgtccttgaccgaggctgtaccgagctgaaagcacagcccccacccccaaaacccacagccaccatcatgggctccttcccacctggaggccccgggacctgctcctggtctggaattcagtgctgtggggatgtgggatctgggaacgcggctgtctccgcggtgccctctggtggccagcctgca

SEQ ID NO: 51095 - DNA, 1007 bp, Homo sapiens
cacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtgagtggccccaggcctgggagctggggaggatgcgcttggggtgggggccccttctggactacaggctctggtctccgaaggctgggacctgtgcttctgccgtgccccatgtctccagtcttcgctttgttttagggaaattcagagtgttccgactggcagggccagagagtttggtaggaaggccctcctgcccgttccccaggacgagcctggagtgcgggctgtggcggtggggtggggggccaggcctggtgtgtggggaaggcccgcaggcccacaggcattgcccagataggaaggcacaggcctcatgctcccgagaaagcggcctgccccaggtcagggaagttaggtccagctgggccacggcccggatgcctcaggcccaggtctttcttggggttggggtgaaggtggctgtcctcgccccgaaggcacccagcctcgaagacggagggctgcctgcctttgggccccaggagacagagcttgggtgaggcgaggcctggttttgttactggctcccgctccctgtttggtgccttgaagttttgggacacagacacaaaatgaagccaggtgtccaggcttcagtggcaggggcccgagacttggcggctccagcactgtgctggttggtctccctgggcctgccagggaccaaatcccagagtccgccgtgtggggtgagggcc

SEQ ID NO: 51096 - DNA, 4034 bp, Homo sapiens
ctcagtggggtcctcaggaactttccgttgcgtacctccccaagtatttgtaacttttcttttaaatatccaggcttattaaattgcacacacagaatgctgcattggctcagctattcttgggaggcctaattaattcagctattgcatcaaactttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcagagctgatggcagaggatctcggttgagcagggtgtgtctgcgtttgtttttgtccgactgtgggtcatgtgtgtgcttgtggtctttctgtcttcctgggctttgctgggggcccattggagtggccagtggggcctcgttgtcacagctgacacagagcagggcccaggccacccggcttctctctccctgtggttgtgagcgccggggtccttgggccgccatagagacaggccagacaggctctggtcatctcagcggatgcctccgagccgcctttcccttttgaagtccccagcactgctctgaaatttcatttaccgattaaaaagcaattcccaggccatactgacgacgtgcacggtgtgagtgactgcgtcctctaggcctgagtggcagccacacagcctggccctggcagtggtgtcctccgcctggctccctgaatgttcaccagctcctgcgggttttcctctcctcatgctcctgggggtggggcacccatcctgcccgtgttgcctcctgctctatgttcttgacgtgggatggcggccagggactctgccctcgctcagtgcctgccctttaggctctgtgactgtgcacttgggagttctgggcttcagggtccccttaagtctcctcaggacagccgtgtgcgtgtctctgtgtgcacaggagcgacacatgagaagggagtgtggtctcagggtgggcgtggacccacagtgcccagaccctacttgtcctagaaggagtggcctgggaggccccgcctccgccctcactggccgccgttggctcctcccactcgtgtcttgacagcttattctcgggatatgttttgatttcttcacttcctttgtagcttattttaatatttttgatctgccgaagatgagggcagaacaaagaatgtactggaactctctttgcagggctgctgctcccagcaggccttcgggctctgcggagccggagggggctgaattgccttccgggtgtttgtggccaggccagggtcgggtctcctgcctgagtgggctgggtcagcgccactctcctacccatggtgggaggtgggagagggcggagatgttcccgggtcccaaaccaagtgggaggcagggctgcagctttctccttggaagcctcctgtgacagcggctgtgcctgagcctctggcctgtcggcagtgcagtggcagcatgaggggcagacagtcttcctccagatgccccctcatgtcacggggttacagaggaagcctccgcttctgtccagtggctgtcgggcccggccagcttcctgctgctgtatcttggaagaccatgtgggctgcatgggtgcttggcgagtctcctcttagggaccctggggctgctatccttgacaggggaccttgtctcacctccccactcggtcccacactggctttgtgaccttggacgagttgcttaacctctctgcctcagtgtaaactggggactactgtttattgatcttggactttatgttttgagtggtacaggtggggcacagatgggtcattgtgctgctgggagcacttagccaagactggagcctctgagccttccccactcccacccctctttcttctttccggtcggctcgcctccttcctcgggttctctgatagctgtaggactccattggactacatttttttgtcagtatagacagctgtcagagacggagacaaaatgtggcagttggagctgccgcttggcctgctgcctgggacgcggccccttgtcccgcagaacgtcagccaagcgctttccgtgcaggctgataacagggtggtgccgtgcttcccttgggccgtggcaggatcctgctccaagggggggtcctgctccgagggggccggggtttctgttccaacagggctggtggggggggtcctgttcccagaggtccgggatcctgttctgagggggccagggtcctgttctgggccgggggtcctgctccgagggggccgggcgtcctgttcctaggggcggtgggctgcctgtgtgagagctgttcttcacctgccacgtgcagtctgggcattctggtgactggagaatttgggttgtgttacagtgttgttgctctgtcctgcagatgcctgaattcccaggggtcttgcaggtccccttgcccttgcgctgtgtgggctggcgtgggtctcagtgggctgtgggttgagggtcgcttggttgggaagctctgcgcgcttcccagtggagggtccgcgacgggggttttctgatccctcatgctggcttttgacccgtgtcactgcaaggctgcccctggccccaggcagcgtttcttcaggcaggtgcccagccaggtggtcgggcttgagacctttgagtctcgaggtctgttctggggaatgactgagcttgtggaggccaggaaggggttgctgggcttggagagcctctggggaggagttgtgttttgctctttgctgttttaagctgaaatgatcacaggaagggacagcatcaagagtttctttctgggacacccctcactcagctcagcggccgtgtgtgggtttggggctgtgctctcccagacaccctcaggtccggggagcacttcgggggctatctgtccctttgtccaccagcttcctttggaaaaagtgtttgctgcaagtgtttttctccagcttttcgtggggttccctgtagtcttgggccatgctctggggtcaggctcccggcaggccctggtccccgtgcagaaggccagggtctgcgggtttgggctggtctgccccccaggtgagggttccggaaagacggccggctgctgagtcttctcaagcaggggaaacagcagctcgagagtggttcttgacctctgcccaccccagctggctgtgcacggactggggagggcatgggcagctgcccccaggtggcttctgcagggagcagagcttagtggtcattttcccggcatggtctgtcatccgtctgtctgggacccctctgggagctgggctgggtccctcgccttctggggcagcagggtcacggtgggggggctagtcctctctttcagcatcttgtttctcagccgtccctgcggctatttgtgcaatgtctgtctgtctgagtctccgggtgagggcagacaggatatggtgcgaggaagtctggggtaagtgtgagccgaaccccgccctggagtctctcggggttgtggggccacagccccagcttaggttaggccttcactgctgctggcagggcctccagagagaaggcggtggttccggggcctgggccctgactgtctggcaggaggtgtccacgccggcggcccggctctctgtggcaataatg

SEQ ID NO: 51097 - DNA, 2412 bp, Homo sapiens
cgaactcctgacctcaagttatctgcccaccttggcctcccagagtgctgggattacaggcataagccactgtgcctggcccctggagtgggttctgccacggaaggcatccccggggtctgcgggctggaggggtcgcccccactgtgccacctgttctctcgaggcctggttgccctctgcagaccaggtgccatgccaggtgaccctcaggaagctctggctcaccccgggggctggggggcatgataagcgatagctcttaggtgctgctgctttgtgaatatgagagagttccagaagggccccgcttcccagagcctgcatgttggtttcactgtgtggtacttgatatttttccaggctgccttgctggggtggcctcgatggggggcccagggagcctccagctctggggacatgctgccacatgagcctgcttatttacgaaaatgaagaaccaggacttgagtgtgaattttaaatgagattgtggggacaatagtaaaatccagactaggaccagatggactgagcacctgcgttggccatggcccggaggtggcgtggtggtgcctggcgcctgtggccctcagcatgtgtcctgccggccgcctagtaggccttcgcttgaagtgcttattcctttgagtaatgctcctgtcttttgtttggggggaaacagataaagggggctttgagaggcgtctcggcgtgatcctgggaaacggccgagattctgttcggtgcttggtgttcgtgtcttctctgattttacctttttgactcataaagatggaaggagtgctctgcctcggtgcctctgcagctgcagatgctgaatcggggcgtttaggcctgcctcttgggctggcacacctggcggccttggtcaggccttcttgggctgcctctgctggggtgcttgtctcactggccgtgggggttgttgcctgtgtggttgtgttgctggcttcaggggctagggttagggacgcctggtcacgtctgggtccccagtttgggggccagattcaataactcactgaatgactcagtggaactctgcaggcactggcagtcaaggtttattggcaggtccattctttggctagaaggagaatgctgtttcttttctcactgtttcaccatttttttttttgagatggagtcttgctctgttgcccaggctggagtgcagtggcgtgatctcggctcactgcaacctcagcctcccgggttcaagcaattcccctgcctcagcctcctgagcagctgggactacaggtgcgtgccaccacgcctggctaattttttgtattttagtagagacggggttttaccatgttggccaggatggtctccatctcctgacctcttgatctgcccacctcggcctcccaaagtgttgggattacaggcatgagccattgcgcctggccattgttccacctttggaagaaattggttcaccgtcttctgacctggggggcgcttctaccctggttccatattgagggctgggaagttgctggaatattattacccttggctggtgaggctgagtgctgatgctcctcccagctctcagccctgcctggaccaactgcggcttctgctggaacgtcggcggctgacttagaaagaaacagctcctgttctaggcttcctgcaggtcccacggtgctgcttgtttcagagaaacgcagctcaggctggcggcctcaggtgggcatgggtggcaggggatgccatcacccaaatcagggatctttctctgtcctgagggttccaccccaggacccagggcactaactgggttcttgtgtggcccttcccgaccagacctgacccctgagctgcgtgtgtgaggtgatggtgactccacgacagcttgtgtgccgttatgggggcacctgaggactggctgacctcaccgggaagtgcgtcaggagtgggtgaggggtggtgggagggcagggagcgcccagcaggtgtccagcggtgctggcgctgcctctgtctctctgtccacgccctgtgtgtatctggagtggcttaggtgctccctgcggtgctcctggctgctgtggttcctgaaggctgcggctgtgccggtggtttcctttgatgtcagtcttcttctacaggggaaaccatgttgccaggagagccaggtgtccgctaattacgttgtgttgttctgcccaggagtgaacctgtaagtgatgagaataagaagcggctgtcagcctgcagacccgccctcaccctgtcctggttggggtgctgcctgctgggaacccctggtccagctgttgagaggaggctgactgggggcacagttgttgcagagtctgatgcaggctttctctgccgggaaagtaacatggaaacattgttgcttttact

SEQ ID NO: 51098 - DNA, 1134 bp, Homo sapiens
gttgggcattttttcgtgtgcttattggccactcctatatcctctttgaggaatgtctgagtccctctttgagtcgagttgtgtgtgggggcctttgctcagttgtacgtctttatctactctggttagtgatcctgttctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtgccattgggggagggagtctcagagagtgcggcagtcgggcctgatggggctgctcttctgtgaaggggcacctaccgtgtgcctggcctgtagcagcagcaaagaggaacctgatggggggggcctcaggaacctccacctcgcccactgtggccaggctgcttctgctttctgggaggcctgtgcaagagccatgggcacaggccgggcacggtggctcacgcctgtaatcccagcactttgggaggctgaggccagcggatcacaaggtcaggagttcaagaccagcctggccaatatggtgaaatctcgtctctactaaaaatacaaaagttagccaggtgtggtggcatgcacctggtcccagctacttgggaggctgaggcaggagaatcacttgaacctgggagtcggagtttgcagtgagccgagattgtgccactgcacttcagcctgggcaacagagcaagactccatcttaaaaaaacaaaaaacaaaaaagggagccgtgggcatgtgtgtgcacaggtgtgcatgggtgtgtgcagctggagagggaagggcctgggtcaggggcgccctcagcctggagccagggaagggcagcgagaggaccccagactcccaaatgaccaagggcctgtttgcagcgtgcttctccctcctttcttctggctctgaagt

SEQ ID NO: 51099 - DNA, 1744 bp, Homo sapiens
tgccaaatgtgggtggtgtggtggacccggggcaaggggccattctctggcagcccctagaaatgcctccctggggttggggtgcagccaccaggcaagaagtatgtacccccttgccctggccacttggggtttctgggacaatctgctggcttggccttgactttttcctgaacctaggagcccagggcctgctcctggcatcaggacttgctcttcctctttcctgggccccacaggtgcccttggggagcacacagctgccccagcccgagtccagtctggctctcgggaaggggccttactgctggctgcacaccttggcctccttcccctggatgcgccattgccaacgcagctgggacagcccttggacgcagcgtgcccgccccttttaccagggcatgtgggctgggaccagtttcagccccatgttgacttgtttggctctgctggtggtgacgggggggcgcggtggcggggggccttggtcgcgtcgtgtctgctcttgtgcaccggtgcctcacggagaggctgtggtgagtgcgcggaaggaccctggtgcttttggggactttctggagcagcccacattccttccccagagccctaggggcctggccagctgcctttccaggccctgaggccaccaggttcttggggggagctcctaggttctgctttggcctggctgggtggtgcccacactgccgcgtcccctctccggggctgcccggactcagcctggctggcagccatttccgttacttggtttccaaaggccccatcttggaatcaggagcaggctgtgggactcagggtgggttctgagcttggtgacccgctctgctcttttgtccggctttgtcctaactgttgaatattaatgaggggcgccgcagggtggctctccagtggagggtcctcactttttgttttgcaaataacgctggggcccctgcgccactggggcaatgcaactgtgacggtgctggttggattcaaaaggaagcctggcagtggcggggcctggacaggcagcctttgacctgaggcggggcggcgctctgcgctggttcagaaaagccgtggggcagcctctctggcaggcactggctgtacctgttggttttcctttgcccacagtgaagtgaaagtcactgcagctgggtttgctgtttaactcactgtctttccttctcacgtcttctctgtgcaaatagtggtcagtgtactttttgattatttcagtcaagtggaagtttctaggagcgtagagaggcagcgtggcttagggtttaggagcatggctgggctaccttcctactctgagtgtgggccacgttacttttctaggcctcagtttcccattggcccctctcctgtttggaagaggcagctgggtcccacaagccatctcaggagccgcgtctgggcgctggcacggggactgtgcccacagccagccagcctggtggtcagctgatggattcccgtaggtacttagcaaaatgcctggagtgtgcgaggctgtcaggccagtggcagatgcggtcgagtgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaa

SEQ ID NO: 51100 - DNA, 1100 bp, Homo sapiens
ggttgttgttggccagtgacacaaacctgcagcttctccccttcttgcttccctccccgccccttggctccgggcacagcgtggctgaaccggcttatctggcctcgtctctggaggcctccccagctgtcatgtccgttgacatttcactgttcctggcagtggctgtgcccagacgcgccgtggcacgtgggagtgatgctggtctttgccagtgctctgcacacctgtggggaggcctctcggggtttcctgccaggtctctgtgcaccccccggtgagagatctgaggaggaggaggaggaaccgagggcaggtagggcgctcttcagatgtggagggttggaatctccagtttaataacaaactttatcctaccttaagttttcaaaagtcttgtaaagaacgggtccattcatttttagctgctccgtgaaaggtgagaaagctgagtagggggctgtgtcccaagaccagggtttgctgtggcctggctcgattgagaatcccctgggccccaggagggtgctgtggctgctgaggaggctgccccacgttctgatcctggtgcagggctgcactcagcctccccagaagcagcttggtcccgggtcccacctggcactaacctctgcagggcccctttatgtcatggtgttttggcctgtggaaggctttcgtccgtctgagctgctgactgagggtctttatttccacactcgagagaaacctggcggcccagcagtcagtgcccgcggagcaggtacagctcagggaagggagcagccccttgctcacggtcctttctggcacagtctgtggccctctggagtacccggccagcgtcctcacagctgtccccaaacgcgtggtatgggttcctccctcagggccagcaccaggctggtgctcagctcttctggaagagccgtcccatggtcccagcgcatccgtggaagagtgaaatattgaacgttacaagaaggaagtgaggccaggcgcggtatctcgtgcctgtaatcccagcacttttggagttggcgatgggcagatcacttgaggtcaggagtttgagaccagcctggatcaaaatggcaaaa

SEQ ID NO: 51101 - DNA, 1696 bp, Homo sapiens
cctgaggacatcttcccagcgcgtgtgcacttactaaatgagccacatgcccccagttctgacagctaggaacggtgcgagcagatggaggatggagctggtgctgctgcccacaggggccctgggagtgaggctgcgggtccctcgtgccctggtgcggccctggcttgaggccttggtttgggggtgttgtgccccccctaccagggctgagagcccacagtgacagcagaggggaggtgtgtgcgggggccgggcatcgatgctggacttgctgagggttgctttctggtggtgtgcacacatcttgggccagagtggtgtccccagagtgcctgctgctggaagagaaggctctgggtccttctggatgcccatcctggctgtgtggaccacggcggcaagggccacgtgcctggtcgtcaggccacggatgcttgtccggagctgcctcatgtggctcttgcacagaaggcaccattctagacattccaggtgggctccagtgaccatgaggggctggggttggcactggcgctgctcctctgaggtgttggacccacgtgggagctgcttgttcccctccagacactgattgtgaagaatctggaaggtccacgctagaggaggccacgacctgctggtgcgcctgcaagagtgctggcccaactggtctccatgcgtggtgcccgttggagggggtgggagggctcggctctgctctccccccgtgggtcttcgtgtcacagggtgcttgggggactctgctgcactgagatctccagcgtgacatgtccccgtcccaaacagccctgaaatggcaatgcctcatcctaggattaccgtcccttcccgaaggcttgaggtcctacttagatgtctactggactgctttttattttaatttacttgatactcagtctgggtgcgttgaagacgcggcctctggctgtcagcctgtccttgtgtgcagtgaccggtctacctgtctggccttgtgcctagacttgtggccgtcaccactatctctggggaggggtgaagtggactgggaggtaggagccgaattggagtcttctctttgttcctgaagttatcacagtcttggccagactgtggtcactgcgtgcgtgtgtgtgtgtgtgtgatgcgcagggcatttgctggtggaatagcacgggccattggcatttgcacctgaggcgtgcagcccccctgctgcacacctatggggtccctgcggtcaggtgagctctggggggtttctgagggtggagacagccacaacaacacttctttcctccaaatgcctgtgctgtgcacttgggtgcaggtggcttttaggggacatggctgggcactgccccacagtgtcacctctgtgtcctgtggtgcgtgctgtggactggcaccacaccccacgtgcttgttaggccagtttctctcaggtgtcggtcaccctaccatgcggcctttcttttgtcttttatctttagctaaggagtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctg

SEQ ID NO: 51102 - DNA, 1925 bp, Homo sapiens
agcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcctgtatgcaacacactgtgcccggactgcatttcctgtctggagctctctctgtcctgatctcatttcctgtcaggagcactctgtgtactgacctcatttcctgtctgtgccactcttgtgtcctgacctcttttccagtctgtgccactctgtgtcctgacctcatttcttatctgtgccactctgtgtcctgacctcatttcctgtctggagcactctgtcctgacctcatttcctgtcttgtgtcctgacctcatttcctgtctggagctctctgtgtccttacctcatttcctgtctgtgctgctttctgtcttggagttgcgtgcctgacctcatttcctctccactgtgtgttcctggagttaggcatcatcttggtttttactcccttgcttggttttctcaggatctctggctgctccgtccttgctccagcgttcttctctgccccctccctctgtggtccagaggccgatggccagctggccctcacctgcccgccctgggtatttctgtgctcttcctggtgagggattctaggggttcccctcctgggttcatccttacctgagtagccacagcacactgtgcagttgggtgcctgggaggcacgtgctttgggtgttgcatggctgacctggtaactgggcacccgtgtatggagggctggaacagaacacttgtcggcgctcctcagcgtcttgcctctggtgtccccatggcgaagtcccctgccatctgctttgggctctgacatgtgacctgactgtgcccttcaggagctttcagaacctcctcttagatctggcattcaaaatgtcttgtcagacacctcgaggcggcttgtgtttggccctgtgttgggcgcctattgggcccttgtcaggtttttgttgccaggaggctcgcgccccgatcttcgggatggtgcccgtggcatcttctgctcggtgctccctagggctggacgttggtcctcctggcactggtgctccggttgctgtggtctccctgctgttcccttgtggctcaggattactctctggaggtctccgccttatcatgagcactttctttgttggctacttttagtttcatgatttcattttcgtttctaagatatctatctctttgtaaaagctcccaccttttgtgacttgtggatgctgtatctttctcctgttgctgcagacattaatgatgtttttcttgacagtttgtcctgctggtttcctctgcattcctttggttggtttcagacctcggctttaaaggggcatttccccacattgccaattcttgaccatctggtcacgtcaaggctgacgtgccaatggctgcaagggggagggcacctgggagcccg

SEQ ID NO: 51103 - DNA, 1001 bp, Homo sapiens
cagctcatcacttggccggttttctagaccagcatattcaaacccaaggtttggaatcttgggctggcttctgaaatgacatgctgtgggctccatccccagaattctgggttcccaggtccgaggtagggactgagaatgtgcatctctagcaagttcccagatgacatggtggctcctccggaacccctgcctccttttgtgggtaaagttttacaggtgcatggccacgccccaccgccctcgccggtgctgtctgtggctgttttgtgccacagcagaaaggctgagtaggtgcgagagagaccatgtggcctacaaacccaaaatatgtgtgatttggtcccttacggaaaacacttgcaggttcctgatctagagaaagaataattgtaacgcagggctacattgtttttgtgaaactctttaggatggaaaagggcatctctgaggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcac

SEQ ID NO: 51104 - DNA, 1702 bp, Homo sapiens
gtctcgaactcctgatctcaggtgatccacctgccttggcctgccaaagtgctgggattacaggagtgagccacggcgcccggctggacatgcctttctttaagattgtctctttgtcactgctttgagccactttgctgtggtttccccgtgccgcatgtgtttggagtacgttgtgtagtttttgtcaggtttggaaggtgtgtctcctgcgtccctcctctgggcacttggtggcccgtgtgtcagtcatgtgaatgttgtcagctcagggtgctcttctcatcttctggattcttttttttcctctatttccctgtgagtagtttctgttactctgtgtccatatcacaaaccttttcttccacaatgtctcctccacggttaatcccatatagcggatgtttcatctctagaagtttgatttgggactatattatatctttcgtgtctttattttactcttttaaatatgtggaatacactgtaataacagttccagtgttctctgtgaatttctatgtctgtgtcaattctggttgtttgcgatggatggatgattttcttcattgtggtccacattttcttgctttctggattctagacgttttgaaatgtgcctgtttgggtgctgaatgtttttgtattcctataaattggctgggcatggtgactcacaccagtaatcctagcactttgggaggctgaggtgggcagattgcttgagtccaggagtttgagaccagcctgggcaacatggagaaaccctgtctctacttaaaaatacaaaaattagccaggcgtggtggtgcacacctgtagtcccagctactcaggaggctgaggtgggaggatcatttgaacccgggaggtggaggttgcagtgagcttcaatcgcgccactgcactccagcctgggtgacagagccagaccctatctcaaggaaaaaaataaaattaaaaaaaaatcttgagctttgtctagactgcgttcagttatttggaggcagcttgatccttttgagtcttgcttttgtgatttttttttaggtgggtctagagctgggctcagggctcattctaggcctgataattcaccactcctgtggcagaatcttctgagagacataggaccccatgaatttgggcaatttcctgtctgtcgggtggagacaggctctctgcctagcctggtgcaagcctcaggcctgttgtctctaaatctttgtgggtgactcttccccagcctcgtggagtttctgcacatacatactgtgatctggggtctgcggaattgccaggggcctctgcagaccccaggccctctgtgtggtgctcccttctctgctgctccgtcctgtgaattccagccgccatgctctccctgaattgtcagctccatctcaacccagtttctgctgggccctgcctgggtcctgcttcctgtaccatggctgggaactctcgggaggcagtgagctggggctgccagagggcttggctccactttgaattttggggaccaccgtcctttgctgcctgacctccagggtccctggggccattgtctcccatctcctgtcttgtctgcgtttttggcctttccagggaggagggtgatgggtctctgtgacttcaccttggctgcaggcgggccctggcatcgcagtccatgagtgacctccagcttctctcatcagcc

SEQ ID NO: 51105 - DNA, 1090 bp, Homo sapiens
tttaaaaacatcgctgaattgtgctgactggcacatccattgtgagcggatgtgttttccttctgcaataattttggctacattaaattcgttttgttaacatcttcatcaccgccttttcagtttcagcgggaattgattatgaacaaagtgccatgattttgactattcaggcgagcaactgcatcgagccagcactgaactggttttgtaacaagcttggtgtccatatcgctcttaataacatctgcaggcacaggcgacgatagcagttgtgggccagccgtcaggaaaggggggactagcacgtaccactcagaattcagcttgcgcgggctgcggtggagttctggggtttgtttgtgggcatttccaggtagtctgatcctgtgaggagcaaggaaggggtgtgttgacagggccgttcgggccggagcaggtgcgacaggaatgtcccacgtcctctcgtgtgctgtcgggagacaaacctcttcctgcttcaatatcccattcgttccagagcctcctttcagggtggaaggggtggtggatggctttgggattgggccaggcctgagggcactgagggagtggggcattaggggccacgtggtcagcactgcactctgctctcatcggaagctgggcagtggccagaggcctgggaaaggcttgttgtgggggcggggggcgcaccacacttcagggatgcagccggcctttgggcttcaggaaacgcagctgggacatcctgaggtgtgtgaggctgatgcatgggcctttctacttccagactgtcccaggacacgggtccacggtcacacggtctccaaatgagcaggaacaccttgcatgccctgcgagatgtgtttgaaagtcacactttggttccaggtcacagcttgaacctcaggccacctccagtgggaggctggaggtcctgtgtgccacccggggcctgtgtgctgtggtggtcgtggctctgtgggtgccgggcagaggcctcccaggctgggcagccgccacccctctgtggacgctactcacccttagaagcaggttcccacaggccagggcactcccaacagca

SEQ ID NO: 51106 - DNA, 1096 bp, Homo sapiens
ggggcttgggggcccctgcccgccccaggccaccttgctctctctccaggcctgcgtcctgcaaagaggccgggtcaaaaggtcactgccccgatttttattgctgtctcttacgttctcacgacctcttgccctctgcacagatgggcggggctggagcttccacgagggccggcctttccggggattaaaaacccactgaaaggtctgagcctagctaccaagcttaaatgtcttagtagcttaaaaatggtgttaaaaattaagcaaaacacacatagacttccaggtttagcataaatagaaaccagaggtgttgagaccgtgctgccccctcaaaccagcgcagtggaaagaggggcagagccctccacaggagccctccgctggggggttggggagacggccctggcccagcgtctgcagctcccagcggcactgaatggcagtggccgtccctgtggtctgggggcctccttcccccacaggctacacaagccctggtcctgccaaggctcggggaagccctttgtgactttagaaaaataataatggagggtgaactggttcctatttttgcattgtaattgattgccaagaacccctgaaattaaatacaaccatgtattttaaatggtgtccttaatgtagaatgtttttatcaaaaccaaaactccctgttgaggccttagtgttctgtcaatagcgtgttggagtctggttcccgtctcccctgccccggcctatgtgtgctgaccctgggaccggtgaggcagttctcaccacgccccgagcctccccctcccacgccccgagcctcgccctcccacgcccctcctgcccccgaggctcgctggcgtctgtgcttcttccaggcggagggggaggtggtaggcaccttgggtcttaaatcagagaaactgtcccagcagtagtaaaagtcatcagctggccccaaagagcccctggaaacacaggctgtaccccgcctccatggagacatttggtgccacctgcgttcagtgcagatgccacacggctcttcctgagatggcttccgaggccatttggcccttcatctcgggaacagaccaag

SEQ ID NO: 51107 - DNA, 1041 bp, Homo sapiens
agccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtga

SEQ ID NO: 51108 - DNA, 1026 bp, Homo sapiens
tttcccccttgtatcctttggccctaatacggggtcccgtttaccaatgagggcaaagagaccagtctaaggggaggctgaaaactcacaggcaggcctgtctggccttggggtctgggtgctgcttccaggcagaccacatcccaggtgaggtgcagacattcagagacagacgtggccgatcctggctgctgtatcaacgcgcccaccaaatggggccttctttgatcatcagtcaaaagcaagaatgtgcctgtggtgggcgggcgcgtgtgccagcttccaggccgtgggctccttggtgcccagagctcaccctgtggtgcttgcccactactcactcccgcctccccggagtcttgccctggggggtcctggtgtgggagctgccttctctagttgggtggagccttgcctgctggtgcctgtgagccctgggtgggtggatgccgggtggtcgtggaggttcacagcaggctctatgtggttgttttgtgtggatttggggtgtgaattctctcagcaaaggctgactcagaccccagtgttcagaaggttcaaggaagcgaccgtcagcgccgagtggccagcagggcggggatgcggcgttgagccccgtcattcagcttcagtgtggagaaggcccggagctgtgggcatcagctcggggacccgagtgactgtccctgcctcggggagggggggggccacacgggcaggcggggcagcagcttgtgcccatgtcctcctcacggactctggaagtgagaggcgctgaggccacagtgggggaagtggcccagctgacgacccgggctctcggtgccctgggaggagctgttgttaggacatgtgcagactgggttcagcctgtctggagtggctcaggtgcctggggacagaggccagctgtaaccgctgctgcactcggttctggattcagtgccctccgcctctgcggcgtctccctcggcagctgtccaggactccagcctccctgccagggtaggggacatggagcgtctc

SEQ ID NO: 51109 - DNA, 1611 bp, Homo sapiens
tgggtgcacgtgctgcaggggaggccacgggctttggccagatcttcccccagggccctccatccccataattggagcaccttgatggacagcctgccctgcgccccatcttccccctagggaagcagggtccctgctgcctccaggaggctggttcctgatgcagcgtcttctcctagagtcctggaggtgggaagagcccccggccctgagtgtgctctgtccaccaaggcttcctggctgagggcaagggcggagcccccaccgcccgactttgctgcctcctcttgaggttggcctcggcagagtgagtgggacctcacccctgtgaagggccccttgccctgtgtggcctgttctgcattggcctgtggtgtagacctggtgccagctgccctggagactctgtgctgtcctgtggggtctttggcagtagaggaatggcccattttacggagactgccctgtgattttgcttgggaagagaccttgggtctcagttgtgccttgcgggcagcaccgtctcaggggtttccagccgcagggctgtgggagttcacgtttgcctgaggctggatgtaccggctcaggcccccagcacacaacccacatcactcactggctcttgggggatgtgcctcagcacctgacacacaacacctggttctgagtgggctgggtccaggcaccttcgctaagcttcctccaccagcgggacctggttctgggtgggctgggtctgggcaccttcgctaagcttcctccagcaccggggctggcaaggagcgaggcaaaggtgtgtgtggtgccatcctgtaggagccaggctccttggggatggtgtccttcattttgaaaatgtttccttcccatggggagggggcagccagaatgcccactctttaatgcacctgtgccagtggcccacagggacacggtgtcccctccccgcgaccacccctgtgccgcagctgcccttcccagacgcatccgtcgtgagtggctctcgccgtgctgtggctggttgagctgagtgcccagcgctgggcaccctctgaggacacactcgggttctaggaaaggggtttggcaggagaaggacgagggactcctggccaggctgagccgctgtggaaggggagagtgggtcttggtgctccatcccaaacctgctgcagccgtgggtgaggtcacccggaatggcaggacaaggtccactctgttctctcggagatgacttgtccctcagcacagcctccacgtgcctgttgcgcgtggcctaagggcctttatgcaaagtgaacttggtctcctggggggtgccctggaatctgccttctgcgccactcagggtcgtttgtggccggagtgcatggggctctgactgccatgtgccagccacggggctggtggagggaccctgccctgggaaccacaggtgccaacaaaacctttcattgatcgcaggtctcctctgagcctccggcctccataagacccaaaacagatgacacctcttcccagtcccccgcgccttccgaaaaggacaagccgtccagctggctgcggaccttggccggctcttccaataaggtgctgtggggcctgtcg

SEQ ID NO: 51110 - DNA, 2086 bp, Homo sapiens
accacgttccgtgcgtgcccccccgacgggcacagggtgggtggttgctgggccctgcgtctcgtgagcctgtgtcctagcaggtggaggaggggccggcacgcggcactggggagggacagggagcggcgcaggagcctcgggtgggggaagcagcgtcgggccggggcagggcagcgagcaggcgccgctgaccactcggctccctttcagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttcttt

SEQ ID NO: 51111 - DNA, 1088 bp, Homo sapiens
tccccgaagcttccccagacacccaggcatccattccagacagcaaggcaggcagccactctcccacaccttctagaagcccagagccagtggcaaggctgcgtctcccagctgcggccatcctcgaggctcccagagcccagggcggcttcatcacagccatggctccagcctctggtccctgggagccccgtgagcgcctggcggttctgacactgccccttacccttggggttggctacgcccgtcggaggggaggctcctggcctgccaggcctgctccgacctgggtcaccagcctcccaggaggccaggcagacatcggccaggccgggcccacagaggagcccccgtgaaggacagataccaccgcgtcacgctgaccctgatcgctgcgtgtgagcggcgctcacctgggcctgccccttacatttggcaaattgctctgtagctgtttttcacttcaggatgaaaccacatttgtgtcagaagaaaaatagaaaatgatgtttcaatttagagaaagaaaaattgctgggaacagcagcagctgctgggtttccagtgtgttgagcggcgtcctctgggatttaattcccaatcagcagcctcggctttcaaagtcacaaaacccacgacaggaaatccagcgctgttttctccacacgggtgcggcggatgtggggatctgcacctcggggggctccttcgtggctgacaggtgcatcttgccgtccatcgaggctgacttttctgtaagctctctgcaaacacagaagcccggggccgtcagcttccttggttatcacagcaaaaccccgggcaggcatcggtgtcccctgtgcttgctgccagggccactgagggcccaagaaggtggccaggtggctacctggccatgctcctctccccatgcgccacccaccaggacaggccctggggaccctgggagggagcagagagccgtggcttcctagggctgctggcgcctctctggccagcatgcctgggagctaacgggcagccagccttggagagacgcagcgcctgggcctcgcctggactcccgccccggccccactcaccct

SEQ ID NO: 51112 - DNA, 1009 bp, Homo sapiens
tgggaagcacttctggtccattcatgctgttttctttccatgctttattggaagctatgccctctgttttcaggccctagtcaggcatccaccctcccctggcaccatcaggcacttcctgcctctggccctcctgggggggtcctgggtctggtgctccttggggttcaacagccctgggaggtgggggtgaagagcaggggctccagctttccccagtgttggcctcgagggtgctgtggtctggagaaagtaacccccaaccattgccaaaccttgggcatcaagagacggggcctttgctgaggttcacggcctggtgcaccaggtgggggctccgaggaccagctgcccagccccctcaggccacgtcatgagtgaggagcctgccggacccttctgcctgggccctgcgactgctcaggggctggtgtgccttggtggcacgggtggggctagctctggtttctgaagaccggccatttgcatcacttcatggtaacagtgaggaccaggggtcctgcatttgacctcgctggtcccatcgcaagtgcctgggcttcaaggtgtgaactgtgaggagttccagaggggacatggggcctgccctagtgtaaccctagtgcttccatgacggccccaacagccggccccctcctctgccccagggtggtggggggtccacatgaggcaagccggccagactccccacaggccatgcgtgctcaaacaccccaaattatctacatgattctcagtgttacatgcaccccaggagtcccccactggcccaggcttcctggactgtgacccctgggtccaagggcagtaggcccaaacgtggaggctataggccccgtggaggcccccggttgggcattcccacacacgcccagctgaggagaggaggctcggggactgcggcaggcaaagccgcccagaaggagccacctgctccgtgcagtgagcaggtgctcggcacccagcggcaactccgggaaagctggcg

SEQ ID NO: 51113 - DNA, 1076 bp, Homo sapiens
gttcagagcctcaccgagccgtgctgaggcctctgtgtagccaggtctggagggtctgtcatgttcctggggggccctgagccccatgcctcctagacttgctactttgctcctgcccgccctccaaggagcggagggcagatcccttctcagatgcaggaggaggcacaaagccaagtctgtctctcggtcccttctccaggacacgggtttctggtggaccgggatggacaagtgtaccagggctccttccatgacaacaagaggcacggccctgggcagatgctctttcagtgagtatgagtcttgtgggtactgcctggcgcatgacagatacacagggcaggtgtgaggccatgtggcctgggggtgtagacaggactgccatgggacaccccgggcctgttccggcccctgctgtctacccgccacccccccagtgccaagttgttgaaccacattctgtggtttcggtgttattctgtaattttccccttgtttattgaaattgaccaattgtgtgtttagataaaacatcccccccccccccgattaaaatacctcctgagaacgtcaggctggcggcaaagtggcaccacaggagcgtctccaggtctaaatgaggatgggggtgctctccggccagcagagcctcccgcctccgcctcccaagtgctaggcatcttcagcccgtgtggaaattcccacggcggagtctcagcctcactggctgtggagactgcagccccctcccgttgcctctcctgggtcatttcccattttgagtagcggaagctgagtgcgtcccgagcaggcctaccatctagggtgggggtgggcggacgtgtccccaccgcctgtcgtcggcccccagctggccctggcgaggcaggagctcttggggccatctgctcgggcctatttttgcctcggtcccgcagtgcctgcggagcccggtgggaggagccggtctgagtcactgccaccacccggctccccctgttgagagtggactccgtgcgtgtgtcccccaggaacggtgacaagtacgacggcgactgggtccgggaccggcg

SEQ ID NO: 51114 - DNA, 1856 bp, Homo sapiens
gttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacaggtgggactttaagccaaacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaatgtgacctctggcacctgggttctcaggtgaattcctcatggcatcacagcagtgttgaaataggagcagatacgttacctccgcttgccagataagaaactgggacgcagatggatggactacctgagagttgtagataacattttcctgttcatggggtggaggacctggccctgagaggacaggatccctcctgctcctgccagaccagagacccaggacagggcgtggagcagacaaggtgcctgggcgggggaaccctgagggatccacagagggtgcggtccttggagggaggacatgcagtgccacgtgccatggaccagccagtggaccccatggccagcaaggctgctcctggggccagtggggtggacagtcccgcccacgcaggtgactgaggtgccagtgtgggaatgaaaatgcggcctgtgctcctgggcccatgcgtctcacgctgcccttcctctccagggaagcctgtgtacctgctactttttcccgaacaattcatggtaaaaacacaaatggtatatggacaaaatactgaatgtggaagaaacctacttgacagtgttggtgaaaatagggccaggatttcacacccgtgaatgctttttactgaaaagtattttgtgtttttctcccagttacagaatgtctgaaggggacagtgtgggagaatccgtccatgggaaaccttcggtggtgtacagatttttcacaagacttggacaggttggtgggttttttagtagatgagtataaatatttgaaaaagaaacgggactcccagcattttcgggaaggatctgtttgctggtgttcctgatggagaagttacttcgcctcaggctcaaacttcctgaagacagcgttctcttcactgtgaagggccagctgtggagagatcgggctctggggccacacgtggtctatcaaacatatgcgttttctgtttctgttttccttttaccaagctttaaaaatataaaacccagtctcagctcccaggcaggacagatgcggccgtggctgccgttctgctcttgctgtccctctcccagccacccacgtccccggtgctggtagccccacctgccccgtgtcagctcggcggttctgtccttgagggtgagaggctcttgtgtgggctgcgtgtgcattgcttggtgagtgagggacctagagctgcctttgaacgctggagtc

SEQ ID NO: 51115 - DNA, 1023 bp, Homo sapiens
cacccggagtcgcctcgccaggcttctcagtatacccaggccgtcctgagcccagcctggccctgccctgggcacgtccaggcctggacagtggagccgctggtgtccctccgaccctgctgcatgatgctcaggacaaggttgcgctctgtggctgcctcattccttgggtgaagagtccatgccttgggtgtcatgaatgactcggcgtccaaagggtttatgtagcttttcctgagctctcccttgtgtgaggccaaagcacagtgcaggttgagacgccgagtcaagtaagagagacagtgaccgaagggggtcttgagggtttccttcgtgtgttttcgggcacccctaggtcaggtgatgtcgtctcagacttcacctgggtgctcctttacttgctggtaaacacggggtttctaggagcaaacctgtaagatgggaattcttcgtcggtctttagaggaggttacataatcttatgtgcagagcagggcatgttgaaagccttgtctgggctattttctcctctggggactgtagaagatacttccttgtttaaagcacacaccttaatttatttatttatttttgtttttaaattggaactgggtccattctctgatggaaagaatgacctagaaatcttgaatcagggacttcaggcaggagcagggggcgggaagagtgcagcacccacaggtcagttttattgcgttcgaaaccaagctcgtgcctcatttggcgtctcttcaggtgtggccctgcagccgaggatggacacacagacatcagttagccctcacatccggcgttcagccgaggatggacacacagacatcagttagccctcacatccggcgttcagccagggatggacacacagacatcagttagccctcacatctggcgttcagccgtctgactggaaaagcttttaggcagaaagacttcttgtttgtataagaaagttaaagcatttatatttttatttattgttttgagatggggtctcactctgtc

SEQ ID NO: 51116 - DNA, 1930 bp, Homo sapiens
tctgtggttagggcagtacatgtctgtgagctacatgcaaagggtcctgctgctgctgtgcccagggtagacccctcctttccacagggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaaggtaaagcagaggcgctgccgccacgccggccgcaatcgctgttctgttacccgcagcattgggggagctgtgctgggctgtggtgggtggtggcagagtctgcctggtgtgaatgtggagctaagtggcaccgtcttgtgtgtgacgaggacactgctccgttcccagcacggccggctaactaaacggggagcgcagctgtgggagcgggcgggctcttggtggaaactttgtggaagccgggtgggagagccccggcgagtgcagtgtcccggtggctcctcttagggtgcccagtgccccgcgccagcctgcccgaggaggagggtgttagggggaagttagccgagactgcggactgtgcccttgacggtgtggccttcgtgctgcgggcctcactctgtgcccggggtgttggctgcagagagggccctgggccacctcacatcccccttgcccttcctccacgggaggctcacgaagcactgggattgatggggtttcaaacctaggcctcgtgggctgtggaaggtcttgctgtgttgatgtgggcgcaggaagccactggggctccgattccacttgtctgatgtatagaaaagatgggggacctttggccgctcagatttggggacagtgtgactgactggagagcggttgtgcagtaactgagtctgtgtttctctccccagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagctggcagggagcagactggctttgtaggttcagcactcggccccccactgcgggagaggcggaacccacttgcatgtcagcgtttttgat

SEQ ID NO: 51117 - DNA, 1055 bp, Homo sapiens
cccatacccccaggacctggctcgtgagtgcgtctgggtcaggaagagacctctctgtgcgtctcaggctgagatgcagatttctgttttctaaaactggaagcgaccttgacgtgtattgaaggtgtgtgtgccaaatgcttccgacggaggtgctggccttggttggtttctctctgccccgtgtggtcatcaagtcctgggggatgtgctctgcccagccgccctcggggagagcagcgccgcctcccatggggccgtggggctgctgttctcactgcactggctgaagcaacccgccagcctccgtgccccaccccacccagcacgcactcattcagtccattgccttaacacaagcctgatggggctgttttctcacaatataaacgaataaagtgtcttctggcctacttctgaattacttctcaactgtatggtttggggaagggagggaaacctaaaatcccgtccaaataagtgaaattcctgaagaagtggctgagtcctaccaggttggggttagggaaatgttctgggttcaggcgcccctcccagggctgagaaagcgcagccagggacagctttctgttctctcccagggtggctaggttagtatcttacatgacaaaaaactgagagtgttctaacttctgtgcaagcaaggttaatcctgagactaaatcttggcgttcagactcccgtagaggtcatctgtgtccaggcccacccgggcgccggctcagcggtagtgccgaaggtagatgagcttctggggagggaacttctcccggcagaggggacactccgcctgcggagaggagaaagggggtcacagcagctggggccactgggccatgcccatccccatcggcatttcttttcctgtccacattctctgcacatgacacacaacataaatgttgtatttccttcaactaatgaccaagaaagccagccttttttcagaaggccgagtcccagtgggggctggggcggggctgggggcgtagggctcagggtgtggggctcggccgggaggttccctcctgctc

SEQ ID NO: 51118 - DNA, 2701 bp, Homo sapiens
ccagctcctgggaaagcgtgcgctctcaccctgccggcatcttcggtgggtgtgagtcagtgtgctagggttttcaagtgtggtgaggaccccgggaggaagggtgtgctgggatgcgtggtgcaagcgtggggcctttcagggctggccactaccccaacctgcattcggcaaagcctcaatacacgtgaatttggaactttaaccccctcaacgaacccacatctgacctacctgggagcctttaaaaagatgcccacctctgtaccctcaaaactggagggtgctcagagccagactccccacttctgctgcagccaggtgcatcttgccggcacagccgctgaccaccccaggacggcagcaggctcccacctcaccttgctgctgcaccacgcggtgatgcactcccagcagaacaggtggccgcagggcgtggctgttgggtgcctgcgctcctccaggcacagggtgcacagggggtttctggaaacggctctctcctccaaggaggccctggggaaggtggggcagagcgtcaaggtgggtgcaccttacaggtccttgtgaagtgcccaggacacccccagcccccatgtgtggcccccgcacgcacctgcggtgagacaggccgcggtgcagcctccactccttcctggctcgctgccgctgcctgaaaccgtacagctgcagccccatggacagcaccaggtgcagcagtgagatgacccccagcagcctgtagctaacacgggccctcaggtcctctccgggcaggctgcggacacggagctgtaaggcagatggcgccacactcatcaggaccctgaggggatctggcctcagcgcctgctgggagggtcacacgttcagttggcacagagcacgttagaaccaggcctctcactggcatggggagtgcccggcagaaacgatcaagccagggggcaggttcagggagtctgaggtgcctgcttcgtagcctagcatgacggagaggcctgagctccagaccagccttggcattaccagtgcagaaagagtcttagctatgaggctggcagagcaggtgaggatgtggggatgtccagggaccacctctcagaaaaggaggcggggagcggaaatgtggggctgcagacgctgcccaccagctaccctgctacagggaccgaagccccagtgtaacaaggcacgtggccccagggacactgctgccaccctcctgctggtgacacaggtagcttctgaccgtgccactgaaggacagctggctgccctcggcttcccgtgtcactttccactggctgggaaatggagacagccagacagcctcggcccagggccgggaaccacatacagaggtggcaggtcacaccgccagcatgggccctgggtgtccagccacttcctggctgtcctaggagagagggagcctcccatctggtttgagccccacttccatgcccctgtcacagcagctcatcaaatccctcaccaacatggacggggcaagaaaccacatcaaatacgcaagtgaggctgggtacgctgaggacgaagacctgaccattggctctgcgacgaggtcacggtggcctcctgtttagggtgtgtgtggaggcggggttgcctggcaagtaggggctgaggggaccagtgcagctctagggacaaaaggaagggggttcctcagagggctgttctggaaggagctcatgcagtagtggctctggtgggccagggactaacgctgtggcaggtggacatggtggtgggaccacgggggaggcttcgttgctgaatctggaagcaggggcatcagctgggggtcaggataggcagaggtgccaacggctgtggaggggagaaggtgggaacggccgtctgatggggcagactgctgggccaggcaggggcgaggggtgaggggctggggccggggctgcagtccatgctcccacactgtctgggagaagctgtttgttccccacagcagtgacataggcagtcacgggcccaggttcagggatctgtggtgaggcgtgacccggggccccccggtcagtaaagagctaagcgcagggcccggtgtccatgaggggctgcagcaggagttcattctacacttagggtctggacttccttggatctttcagccaagtgtaattaaacaaaatctgctttttttccaagcagaggatttgggttcctgccttgacacagatgctggatgtagaaccctgttggctgagaggcctggagggccagctctgtgcatgcacccaagtccagtgggggtgacaaggacggcctaagcagctgtgccctcagcgcctgctacttacgtacgtgatccccgtgagcctcttggccaggtggtagaagacaccgtggatgtaaaaccaggcaacatgtagccgctggaggcaggcgaggccctgtctgaggacgaagaccgcccgcagcagcgccctcctctgctgctcagtcagggtggccgtgtggtgacgcatccagcgccgcgcccctgagcagccacgcccacctggccccaggctcccctgcaagggtcgcccactgtcggggtcagcctgcagctcctgctccagggggagcagggccttgtccagcaggtagggcaggacggcatgcagtgtcaccagcacgccacggcgcagcgaggagggcacatgtatcc

SEQ ID NO: 51119 - DNA, 1166 bp, Homo sapiens
gggtcctgtggctctcctcccctgccctttggttcttcccacctgactcttcagacacagctacccagccccactgcgctggcctatttacctatgaggggcagtgaagctgggctgcaatgcagcgcctgccagcaggggtcactgggcacacactgtgctccctcccccgagttatgcacctgcctggacagacctcacccaccaactccctctggccttcttgctctctctaggtgtgtgatgcgctgctggcccaggctacaccccgacaagggacaccgggggccccgggagcagagagacctcagagcagcctcctcctgcctcctgtggacggccggccccagctggtgatcccagccagtcccagctttcagttgctgcccccaccgacagtcctcagtccctccatgatggctcccccgacagccggcccccttcctggcccagctcttccgcctgaggacccagggccggatccggagagcaggtggcttttcttgagcgccaacattctgcccgtgggtgagtgaggccctggctacccacaccaagccagagaacattgttcttctcctgctgagtgcgtctctgtttcctggagcccagggacaatacggttcagggttcagttcagtgaccctgatgtcccgtgatgtcacctggggagaactggggctctgctagcaccccagggcaggtggggccgccacgtgcagaggagcctggcgtgcaattcaagagctctcagtgtgtgtcccttcgtgtgggcagagagggggtgggttcattcttgggggatggctctctgcccacctgctgcactgggggggtctgggagaggtgcccctgcagctcacgatgcttccttcttggtcgtgttgtcactgtcagaagggcgaaggcctcccgatgtggcggacagctctggggtctagtgtggagactttggggtgtggagctggtcccctgagctcctgagcttctgctgggatgccctggagtggcaggcctgtggctggctgccctgcgtgtgcgtgtgcgtgtgtgtgtgtgtgcacaccgctatctgccgcttctgctccccctgggggcccctgctgctctctgggcggccgctcccaggcaagaaccatggcagtggtgagcgtgtgtgcgtgtgt

SEQ ID NO: 51120 - DNA, 1049 bp, Homo sapiens
ttttccagccttccccaggggagaggcggagatgctgagccaccgctggccccttgttgatgacagccgcgaggcccatgctgcctgctgtgttaggacaagatcgatctccgccataaaaacaaaattaagccaacaccgccctggcttctgacagcgcgcgctcttcctctaatcagctgccacccgcccggttccagccttgggaagaaaggaaggggctgcaggagcaaacctctcacagtggggaaactgaggcactgagacagggaggacaacccaaggtcggggggcaggcccaggacccctgcttcccagcagccaccagggccaggcagtcagggtgggccggtgcagcccaggtgcgggggctgagcccaggggatcacgggcgcattcctctgcgtgtcaccgtggggcccgcagagccctcccatgcactctccccaactggggtgcagccccgtctgcccgtctgtccacccatccgcccatctgggtgcatctgtgtgggaggcttctccaggcccagggctgaagccggccagacccttgagagctggaccctggacaccagtgtggacactggctcccgtcacctcctcagagcaggcctggtggccttagctgcctctgtcctgcccgtccctccctgtccacctgtgtccagccagcgcctgctacgtgttggatcatggcctcacagggacagagcagggaggaggacttcgaggtccctgccccagggatgtcccggggtcaggcagtgctctgaggactggggagccccactgtgctgtgcagggacctgggggagcagcaggtgagccagggccctcctctccccgacggagcctatatctgcccgaccaggactgccggcccttcccagtctggcctctggtgtgggcccacagccaggtgcattgctacaatcccacctgagctcccacatcaggtgtcctggctcaggctcacgggaggggccgaggcggcctgggggtgggtgtggaccatggctgagggctgggcccctgtgtggaaccaca

SEQ ID NO: 51121 - DNA, 1037 bp, Homo sapiens
aggcttccctggccccgtggctccgagtccaccttgagaaacagcctgtgctctctcagacctttgcttggtggccccctgagccttctgcggatcgcagcatgttaagaacgctgtatctgttctgcctgggagtgatttggggtcttcacgttgagcagctgcctctgtcccacctgggagggatttggggtcttagcagctgcctctgtcctgcctgggagtgatttggggtcttcacgttgagcagctgcccctgtcccacctgggagggatttgggatctttacattgagcagctgcctctgtcccgcctgggagggatttggggtcttcacattgagcactgtggctgaaggtttttgttctgttgtcttaattttcttttctcctcctccatgcagtgtccttgaatccgacccctactttgggtttgaagaagcaaagaggaagttacaaggtacggatggccaagtaacttggggccttgccttgtgctggggccatgcctggacgttctctgcaacagcgaatgcagttgcggtcggggtccaggcacctcccctgctcaaggctctgtcagctgggcttcgggggcggggagaacttgcttcctggagagacgaacacctgaagacgcgtctccctgacccctgacctggagcaccgggctaatcatgtgtccctctctctgtctcagaaagaccctggctcgtggattcctacagcgagtggcttcagagattaaaggtatgtggaggggcctcccacctctgctgctggggacacagcggggcccgggggggtggtcactggagggaggtgggcatgggctgcctcgggtggccctcccctcctgttagagtctcaccatcctgcgagccaagggtctcagcatcccctgccccacacttgccctcctgtcgtgactgcttcttaggtcacctgctctaggcacaaagccttgccagaagagacaggcactggcccctgcaggccaatccgtccctggcgcctctggggtcctgaagccccagt

SEQ ID NO: 51122 - DNA, 1001 bp, Homo sapiens
ggcttcatgaatgaatgagtggatggtttagccatagtttgttaagccctcgctgtgtgcaggagccagggctgggcacatggatggggcccagtgggcgggaggggggtggcgaggctgtgagctcagagcctctgtgggaggggcatcagcgcccccaggcttggccatgagagtcctcccactggcggttggggtgggggcggggttcaccccagcgcagcacatggggcggggggcgggggagcctgtgtggctgagggcccactgagggcacacctgccctggctctgttgcaggtggagacggaggacaggttcgagtgggtcggcggcagctccattggaggcggcaccttctgggggcttggcgctctgctcaccaaaacgaaggtatgcggcagctgccagagaccttccaggggtctgcggagatgtctgcttccttcccccgaaggcctgcagctgggcggtgcaaaagctgcttccgggcctccctcctgactcgcgtcagtgggtctctggcctctgcggcttcactctttgcgccctgagggttgggtgtcccagcaacccagagcttctatcctggctgggtggcccgagggtcccgcttgccgcctcctgcctttggtcccacgcgatgagggcccatttaccccctgcccgcgcgtgcctcctgccatgggcttggtttctggggtcgtggggattccagcagctcctggcgcctcacccgccccctcgccgtgtcctgcagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaaggtgctcaccccggcctctgccgccagagagcaggatggtggggacacttggggtctcacggacaggagcttcccccaccattgctttc

SEQ ID NO: 51123 - DNA, 1045 bp, Homo sapiens
tggtgccaggtatgagaacgtgtgagtagcatctttagggaccgctgataggacttgggactgactggttattgggctgcaggtgctgagcttgcagccctagcctaggggattgtctaccgcaggcctcaccagaggctccccagccatgcttcccagccttctgagaccttgaggcccggtagagcgtgtgctctgcaaggttctgctgcccttacactgggggattctgttactggaagcaagtcgggattaaatgtttctgaaatgcaattgcagttgacctgcataagtcacttggggaatggccaggagaacagggctcaccgtggatgttctgtgtggccccgagaggccagtgaagccgcagagctggggctgtccaggaagggctgtcgcagccctagagggccctggagtaccagcctgttctccaggctgagcccagggggtttcttggtagaaggatactctaagaggtctgtttagtgctggtatttatttcccctcttcaaagtttctccctgcgtctgggtcctgtgtctctggttcttaagaggacctgttgactgatactgagagaccttttgtttgttactcctgaccgagctgctgggaggccacgctcagggtggggtgtcttcaacccaggaaccctcaaagccaaagtgcttgtcaacagtgttgtttaaaagcaggcttctcccatttcctcttcccttgcctgtgtctggatctaggaaagctcacctgccctgtgttctggcaagctgttttcctctcgatgggacgctgatgtctgctgagcagattcacctctttgaaagcagcagggacgttgtatttctcaaaacatactgcagcttcgatctgattttaggtttctgcgggctgtggggagggttcctcagaggcaggtgagacaggaaggggccacggggcggtggtgtctgcttggctgtcctgccctccattggtgcccaaagaggaaacacaggaccagagagaatggcagaggggatggggcctgtgggacagggagaac

SEQ ID NO: 51124 - DNA, 1069 bp, Homo sapiens
caagcttacagcaggcactcgctgaagggcagggctctctgacagtctgcagacccacgtgcccccttagaagcaggtgggcggcctctgcggcctccctcagcagggctcagagcacttgagttaagcctgtggacagcgcggtaaaagaacatcagtccagatgttctgtgctgatgcgcgatctctggaggataaccgcccgcccgcccgcagccccgggcctctcggacccctgcccagcactggccctagctcgccctgtagcggccgagacctcagaggccgggggtgggggagggaaggggcggggccggcgcctcattaacataatctatgcgagggggcgtttggcagtcaaatatatgcgcatatatctccatggctgatgagctggccgggcactttcaaaatggcggagtgtggagcgagcggcagcgggagcagcggggacagtctggacaagagcatcacgctgccccccgacgagatcttccgcaacctggagaacgccaagcgcttcgccatcgacataggtagccgcaggccgggcgccgggcgcgggctgcgggggcgggcggggcgccggcggtgggccggcgagcgggggcggcgggaaggacgaagggcgggggcgcgggcctcgcgcacagcctcacgggccttgtagtccgcgggcccgcgcacagcctcacgggccttgtagtccgcagggtcgctgatgcgcgggctcggggcgacggccggactacagctaccggcaggcgccgcagggaccagagcggggcctgccgggcctggtagttcgcgcggccgtcctgggtggctgggggccggggtccagcgttacccgccgcgaggtgggagggtcggcggaattttatgtcttcggccacatcggcatctgggcgccccggctccgccgcttggctggtggctggcctgagatttggggtccttagttctggtcgagacgaggacgagctcggcgggaagcccttggcagagtggccccgaaaaggccgcgcgttcccgcggcgtggccagctgtggcccgcgggccggacag

SEQ ID NO: 51125 - DNA, 1027 bp, Homo sapiens
aaccccggcccttctgtctgctggagcggccttgatatgcccacgggtcagcgtccctcatctctccctgcctccccgccccgcagctggtggctgggtggtgccctgcacagacctgggcccagcagcagagtctggacgagctctgccccgccggctccacctgttgcctctgggactcagcccctcttctgaggggaggggggacactcagccccgttttacccctccctgccctgcgggggtgggctgagcacggagggtgggcagaggaacagagggtcggaaggaggagggcgattctttgtggtgagtgggttgggggctggttctgcgcctggggcacacacatgtggcttccgctttccagagctctacctggatgagagcaagcagctttacaaggagctaggcttcaagcggtgagtgggggcgggaacccttgggtagcgtggggtggggggcccaggggttcccaccgctccctgccacctcctctccctgctgccctctgtggtgctgtccactcgggccttcctgggcaaggcggctctggtggcactgttgaccagcccttctgccaggccttctcttgggtgctgggtgactgtaatgagccacctcgtccggggcttactctcggtgtccagaccacctcgtggggtggagcctcgtggcccatcaggggccatcctagctttctggtgtctgtgccacaggctgcttcctttgcttggcagttgccagctgagccagatccctgggcacacccagcctggggccccatccatgctccctgcaccctctgtggaccctcggctagcagccactgggctcggtgtccaacctgccggtgggctgggctggctactgatctggtcgcctgtgccatctctgagccctggtgaggcgggtgggtggggtggggcctgacctaggaactggtctcatggacactggagcaggctctggacccaggcttctccggagtttggccaagcgacctggtgtcttcgcaggtacaaca

SEQ ID NO: 51126 - DNA, 1074 bp, Homo sapiens
gcctatcttggacagagtcccccatcaccctctgctttctggggcccaagtcgcctcctcctcagggaccccaggaaggaaccagatcttgggataggcctgggcccttgctctggtgtggccagggtaggccctggtccatcaaggcagagagagcccagagggagggtccccggagaggcggctcccagagaccggcttgtctatcacagctggatcatcggggcggcggtggtcaatgcgttctactccccaaaccgaaaccagattggtaagttcctccccctccctgcctgcccaggccctttggtgccagagttgaaggggtggcttgcagccccctgcccatcccttcctcctgggggcaccccagcctgttcttggaacattctcctatgtcaccccttgctgcccccgtggggaacactcactcccgtgcccatgagcggcttcgggagggacttggcaggcggcccagagcctttcctgcaggcagaacaggatggtgggaggaggccggactgaggtcctgggtctgccaggcacgagcccgcccagcctctgaacctccgtgtcttcatctgtaaattgagggaatcctgacctctgcctcccggtctgtgggatcaagtgtcagaacccctggcagcgccatccctgagcctggcacacaggagatgtgtccactcacagcttattctttgtcccgcccttggggacagtattccctgccgggatcctccagccccccttcttcagcaaggagcagccacaggccttgaactttggaggcattgggatggtgatcgggcacgagatcacgcacggctttgacgacaatggtgagcggccgcccctccaatcacacacgccctcccctctccgcggagaagcagccaggaaggggcctgggggcgctccattcaaccccttcacggtttcagtggggacaccgaggccaggtcctcagggagctgtgggggcagagcaggctttgaatgccaggctggggccctgtctgggggcactgactcccagcatggaggaggggacccagggactccagcccatgac

SEQ ID NO: 51127 - DNA, 1044 bp, Homo sapiens
ctcataaatcaagttgaaaagcattttctcatctctggaaagttttaataagattggcagttttccttaaatgtcagatagaatccactggtgaagccaaatgggtctggaaatttctttattggaaagtttcaaattaaatattccatttatttaacctagaagactattcatattttctatttctttttttgtcatttttgctaagttgtgtttttctaggaacttgcctgttatacttaggctttcgcatatatctgcatgatcgcttgggtttttacagctgtaggctctgtaataatgtcacccaccctttcctgattctgattacctgcacttctctcttattccttgaacattcttcaacaggggctgggtttcttagattcccaggaactgtttctccctctctctctctccctctttctccccacttcctctatctgcagggatttaactggactctgttcatacaaactgtgctatcctctgtcaaaatcaagctgctgccagatgaggaagtggtggtctatggcatcccctacctgcagaaccttgaaaacatcatcgacacctactcagccaggtgaggcccagggagggtctccaaaggcctcagcatctttgcccctgctctcccatcctccccaacacagcttctgctcccaggaggggaccctatgaagcatctgccctgaggggtgtgggacatgaggggttaagctttagtggccagtggagtcttacattaaaaatgtgtcacatcccaagcacccggggcagatgggctggatcttggaggtggttgtcctggaggttttctccagcacccataactctctggggtggaacgtgctggccaagggccctaagccatatctcctcccttgcaaagacctctcacctgttctcccctcaccctctaccttctgcccccaggaccatacagaactacctggtctggcgcctggtgctggaccgcattggtagcctaagccagagattcaaggacacacgagtgaactaccgcaaggtgagcccctt

SEQ ID NO: 51128 - DNA, 1012 bp, Homo sapiens
gaacaggcatgaggcatgaatgccccagagggccagacacaatccagggggcctcctggtggaggtgggctatgaactagactttgaaggatgaccaagcccagaggaagggccgtgtggccaaaggtggagcagtggggctgagagaaccacgccagagcaggagggactggagtgtctcaaaagcgccatgtctggccatgtgttcagaccaggcagctatgggccaagcctggccagagcattggcctgcactggggaagccctgcccagcgcgaggaaggcagctccctgaggagcaaacttcctcaggatcccactccagacactcaggccgggaagcacctgggtagggaagcccaaattagccctggcacccaccaccccggcacccaccaccctggcacccacagccccggcaggcccaagttagccctggcaccccaagcccagcaccccaaccccagcactgagagccccagcacccacctgtgcaaacccttataggcagccacacagtttaagccctgagcagccctgcagactaggtaccccgtccagtggctcgggcacaggtcacgcgtctgagacgctcccactcggcactctgtgtgcccgagagcctgctggtcaaggtgggtggacacgcattaggggcttccccatgtcctacgcccaccccacccccacagaaaactccctgggggccatggtggctgaggccacccagctctgcccggcgtcctttggcccaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggtaagggggccggggcgggtggggagcgggcagcgagtgggctgggagccccaggcggtgtggctggccaaggtgagggggtgctgggtgggccggtagcaggcagggactgggccaggagc

SEQ ID NO: 51129 - DNA, 1153 bp, Homo sapiens
gactgcaaaagccctgcttgtcggggccccaccgtgctgagccgagacacaggacacacacaggccccagggctcccctgcctaccccgcgccccctcccagcccacccaccgctgcctgagtcctcgccgaggcttggcctgatcccagagcctcctctcctctcccaggctcctcgcctgctggccggctcccaggccccaggggctgcctcccatcatcctctttgtcccccggggctcatgtgcttttctcagcccccaggtctcctttcacgcccgtgtccagtctcagcctccgcctcctgcgctgcagagctgccaagatgctgacctgtgacgggagggtgcaggtgtaaaggcccagaggctgggaggccgcctctcgcggagcactgcaggggctgtggggacctgtgacgccggccaacggcgcccccacagttctgtgtcgtggcacgtgagccacagggaggctgggagagtgaccactgcgtcccttctcaggtgtgatagagaagcgaggctctcagcccctgctggacatcttggaggtggtgggaggctggccggtggcgatggacaggtggaacgagaccgtaggtaaggccgggcctggcagcagcctcacagacagacaaaggaggaccaggaccagggctccttcggtctgaggccttccaggaggggaccccacccccacccccagctggctgctctcaggagccccaagaggcccaacccagccggggcaacctcagggtcctgggaggtggtttaggttccatgctggggagttggtgccccgtggccagtcccatccagccctgcagaggggtgcccctcctcggcccctaggagcgctcgacactcaggccccagccaggctccggccaggccctggccccagggctccccactctgagcatgtgctccattcccccgggggcaggagtggcacctcacgtggctggcagccctgacaaccccatgctgctcccaaccccctccggtcacctgggggcccgcctgtggctcctgggctgttagggaaagtgtctcccacatcccccagcccctaaggcgcacaggtgagctccccaccctatggccccctagttcctggctccggaggccagattcaccgacaaggg

SEQ ID NO: 51130 - DNA, 1099 bp, Homo sapiens
gattcaagagaatatcaaagcccagagaagggaacctagcatttatgatgacttttcaccaggggcttctaccaatttcggaagatggggctgggagactcatcatctcaatgcctgacattggattaaagtgatcttggattgctagtgtttctatctagtaacatttagtaactatttagtagaaattatttagtaacaagtttctaactagttttctcccagaaacaaacataaattctctagaggaagaaaacttcactcttaggcttatatttcctttttgtagttttaaaagaaaagtaactggtactcaaccaaaaataactaggtatacaaggagataagacagtgtaaatgaaaaccaggaaaaaataggaaatataaacaggcctacaggaaccccaaatattggacttatcagacatagaaatgaaaacatctgtgcttattcaaggaaataatgcaaatgagttagaatttcaacagaaaactggaaactataaaaagaggaaccaaattaaaaaatcaagaactgaaaaatttaataatcagaattaggaacttagtggatagggtgaacaaaacaaataagacacagatggagagatatgcacagaaagggacccacaggaagctgtgaggatgaggcagggactggccaagaatcaccacgatgggcggcttgaagcagcaacttgagttgctatgatttttctaaaactgcataacacatctaaccacagatctaagaagttctacaaaccccaaacaggtctatgaaagttagggctgtgaatatgaggtggcctacagaaagatggagggagtaatcatcagggtgaggaccatctcctacccaagttcactgggcaaatgctgtctttctcatatctatacccatctctgtctttcctatctctacctttcctgggccttcatagaaaactgctcaaaaccagagaacaagagaaattctaaaaacaaccaaaaagtgtaagacccattactttcaaaaaagcttcaactagacagaaagctaggtaatagacacaactgaagcccaaagacaatgaaatgatgacttaaatttttgaaa

SEQ ID NO: 51131 - DNA, 1079 bp, Homo sapiens
ttccatgggcagcagggcagcaagggagaccacctccttgctgccctgactaaacaccagctttgcaaaagcaagaccctgccatccctagctcccctcacagacccagaggcagaggccttcagggccagcagtcaggatgggcagatgaagccacagtgtgccaaggcagcggcaaagcccccgtgagcaccaacccaagccttgcacccctgacatgtggaggcttctgaaattcccttgacgcctcaaatcgaacaccgccagcctccagcctcagaggtggcacctggctttcacttcccaaatgaactgaagctccaccatgttagatgaccttggaccaaaccacgggaacttgatgggcaggaggctggcccgggggccctggtgtgaccaggaaggtgggaggcccccgcggccaggccctctgcagtcaggtcctgtgcagtcaggccctgtgtggtcttccttgaggggaagttttctgttccttgggttctgcaggagcaggcaggaggccctgtgggtccaggagggcgcctcggggtctgcctggccaatgtcagaggggtaacggcccatctgcaactggactcagctgtggccacaggatggggacaggagagtggccacacgtaggaaacccagggtgagggacctcagcctgcagggtctggggaccattcccaaggagcccctgagctgggctgaatggtgttcagagatggggttccggggaaacctccctcaccccagtcagagctgaggctgggggtgcagctccgagggtcactcctggactcccttgctggcatccatgcctcggctgggtcaggacagagccggggttgggggccaatgcccagcaaccccctcccccaggatctggagctggacctggggggctggaggcaccctgttgccgcagcaaggagaggtggggtgcgcttcatctcagctgccccagggctgagctcagctttgcccgctttgtgcggagtccaccgagggggcctgggggacaggcgagattggaaagcgatggggccggcgcctgggtgctgcgtgggagcaag

SEQ ID NO: 51132 - DNA, 1001 bp, Homo sapiens
ggcccatccttggtgcctgctttcctgctgtgccctctctcccctctaccaagcccagaccagaagacaggctctgaggacggctcccaggagaacaaactaacaggggtcatttctaaagggcccctagtcagggaggtgcccaggaatcaccagaccagaggagtgaaccagtcagcctggggccggggccagccaggccagagccagctccagctccagcggtgctcagatctgctcctcttttcttctgagtgggaacaggggttgcccccacctggcctccctgtttggtgcatggtgacccctcccctgccacctgagggatctgcagccctcctcacccctgtagctccgtgtcctcaggcaatagctctggagtggtgagctctgggccaggcagggtctgggccaggcaggtgaggaacgtgggcctggggagctaaagcaggccccggagccctgggctgggtgtgcacatgtgtgtgcttgtgtgtgtctacacatgtgtctgaaccagtgttgaagccacatggtttgcactgtgctggcaaagtggtccatgtgcggctagacaggacgggcgggcggttccccaggaagagaagctccccacagcgcggtccccaggctggaccagagcggggctcccctggaagcaatccatcatgtgctgcaggagaaacggggcaaggacaattgccgggtgtcttttggaggctggtcctcaacgctggcaacagtttctctcgctatgagttggtcccagagagccccgattcacccttccggaaaaggcagtcctgtttggatcaaaaaataattagctgagctttaagtgggggtttcaagtacacatttaatttacactgattaacagtcatatgctaagtaaacaccagctgaatattaaacccgcaccattgagaagcgtggaacgcaaagtaatatagaaaacgcagtaaatacacagtttctataaccagtaattatattaataa

SEQ ID NO: 51133 - DNA, 1009 bp, Homo sapiens
ctcaggcacagggactcacctgggctcagggacagggactcacctgggctcagggacagggactcaccttttttttctcccagtgaccacaccattccgttgtggacccaacaaggtgcatggtgagcaagtgcttgggaaggggctccctggggcatgtcgggggcctgggatggcgggcgagcccctcctagcccctggtctttcctgttcctgggtctgagtggcgcatgggaacctcaccttgctttccgtttggctgaaattcattaactgccaggaaatcatggatttccaagcctggctttttccatagccttttgcttagcagagaaaatcaaatggatgcaagcaaataatgagaaacagctcccgaagagctttgctcaaacacggggctgtctggtggtgggcgttctgcggaggcaactccgatgcccacgaggggtccctgccaggtgccacaggccaggcgtctgaccgtggggaaccctcggaggttttccacagtgagcgtggacaattctagcaaggagagccaaacgctgaggcgcgtccgggcgaggctcacacgtgctgccaggtgacaaactgcttttgctaagcccacttggtttggcggctccctttaaatgaggccttctcaggaatacaaccccagggaacacatttcactggcctcaaaagagaaagtgctcacgaaggggacagtccctcgcatcgccagtaaccgcagcctcttctcatctgcacactggccctggctccctgacccacaaggttgaacagaatgcccacctcccatcacccagggatgacggctggaaagggaaccacagcgcggcctggggcccggcccaggtggggagaagccagaggactcactcgggtgaggttctttgcctctctgagtggccccatggttctcaccggtaaactggagttgccatgaagctcactgtgtctggcgctggccgtgcaccctggttcaattgctctgtcctcacgg

SEQ ID NO: 51134 - DNA, 1058 bp, Homo sapiens
atgtcacatttcccagcctattttatcctgcagctcgcctgatgcgactcagaaagcatcagaggtcctcgtgggtgcctgtcagccctgtaggccacgcccactctctcccggaaatgtgtctttcatgagctcatgtcttaaaacatcccgtgcttcccgccggatcccaggcgcgaacactgccatcgcggcagggcagggagattaataggaagtcccagaacaggcagctgcactccagggcttcattccaggccagggcagtgtggagccgctcacaaatcacacctggtggccacgctgccccggctgccgtcttccccgcctgccccggtcagccagtggcctaagagcagcctcagcttctccaactccaggggcacaggccccgacctgccagggagggatggctggctgtttaaattttcccaccacgacgtgactggccttgagggtctgaagctggcctggtgatcctgctgcaggggtcaggagagagggcgtccctgggacggctctgagagggaagcacccggagtgtcctgcccaggttgtgagggacgctaggccccggtgttggggtcccttgagtggtcctagggggactaacagccccacccccccacaaaaagtgcacttcctggtgggccctggcccttctgccggcctcacgcagccaattgtcggtggtatttttggcagggcccctgcctgggtggaaaatgggaacaccagtcggattccccctgtgcctcccagcctctggagtgcccggatggaggtgggctcctcatgggcaaatggcctgagcagggaagaggatccccagacgggtgggggcagggtcctgtgtcttgcccacctgctctcctggtggctcgtggctctggagaagtccccagccaggtccatgctcactgtcaggcctgccccaactcagacaggccgtggggaggttcctgtggcctccagcagcccttgagcacctccccgggctggcggcattaagagccctttgtaagaacaccgacggcctggggaccagaggctgcccc

SEQ ID NO: 51135 - DNA, 1043 bp, Homo sapiens
agaaaggcccagaaacagggaggatcccaggggcagtggggagcaggagcagggatgaggtgggctccatggcagagcaggtttttacccagctcttaaccatcccccaacgctggtttctttgttgggtatggggaggctgcctccccagggcaccaaccttggatcaccaccccagtgcccagaagaaagcctgttctgccattcgaggtgccttctgggcaggagtggggagcagcagtgacacttccacatctcttatgatcctacccatggtgcccttggcatactctgatctgtgtgtggaggaggtgcacatatgagggtgcgtgcacatgtgtgtgtgtgggtgggtgggtgtgagtgaatgtgtgtgcacatgcatatatgagctgcatctataagggtacatgtccatgtgtgtacgtgggtgggtatatgggggctgcatatataagggtacatgcccatgtgtgcacatgtgtgggtaggtgtgtgtgtatgtacgggcacgtaagtgtgtgtgtgcatgcatgtgtgtgtatggcctgcatctatgagggtacattcctgtgtgtgtgtgcatgtggcaggtgtgtgtgcatgggtgagcatgtaagcacatgtgtgtgcatggataggtgtgtgggggttgcatatataagggtatatgcctttgtgtgcatagcgtgtggctaactgcataggcatgtaagtgtgtgtgtgtgtgtgtgtgtgtgtgtgtgtgtatgggctgcttatatgggggtgccagcctacgtgtgggtaggtgcgtgtgcacgtgtggcatgtaagtgttgtgtgcgtgtgtcccaggcaccgttctctcaccgtggacttggtatggggaggtaaaaaaaaaaaaaaaaaaaaaaagccactgaaagggaaccagccgcatccatctctgatgggtgaattaggatccaaatttttaactaattgagtacattaaatagaaagtccctaagaaagaagggaggaaaagacgaatacaagacacttttcaaagcttctttaat

SEQ ID NO: 51136 - DNA, 1020 bp, Homo sapiens
gccttacccagtgggcatgccttcctgggtgcagcacagacactttattgtaatctttttccccagtagaatccaaattttaaaacaaaaagtcaacatgtggccacatacacacatccctgtcaggttgagacaggccacgcccttcctacctccacctcctcacctgtacgatgggtatcatggtggcagccacctccacagcggctgcagctgttaatggagatgacacctgcccggcacactctggggcccaaaggccggatgcctgcagtgtgcacacacctttcccctccctcagccttgggagtcgagtgccccccacccatcttcctaaagcgacccggtcaccgcccctgaagcgccctccctctgctgagcccggtgaccctgagccgtctttcaacggaaaccgtagtccctgtgcctcctctgagctctggccctgtttctggcatcacaacccacaggggccctcggagctgctgaggggtctcagccaagctccacttggggaggttgggctccccagggacacagcatccgtgcctggggagagaatgtttgaccgagccgggttacttggtccccaagtccctccacctgccaaaccagcaagcacgtctcaaccagggcctcctctggcctccacgctacctctccaggccttcctcctctgccaactcttcatttggcctcagatgacatggccctggcgtggagtgtccctgtgtaggaatatgtgtttgcatgtatgggtgtgtatgtgcatgcatgtctgtgtgtgtgtatgtgtatgtgcatgtgtgtgctggtgtggattgtgcatatgtgtgcacatataagtgtgtgtgcatgtgtgggcatgcgtgtgtgtgagacatgtgggcatgtgtgggcacgtgtgcatgcatgtgagtgtgcgtgtgtgtctgtgagacgtgtgggtgtgtgtaggcatgtgtgtgcgtgtgtgcgtgcgtatgtgtgtgtgtgtgtgagcgccagcatggttggtgg

SEQ ID NO: 51137 - DNA, 1042 bp, Homo sapiens
ggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagc

SEQ ID NO: 51138 - DNA, 1934 bp, Homo sapiens
cgtggtcactgacccccactctgagacagagcaagcatccccggctgccccagggctgtgtcccaactcgcagggtaaatgacagcttataccacttacgggtcatctgttcagcgctcacagccctccccaattcacaggcccccccttacccacccttcaaaaaatagtgacttacaacttaacaaaggctagcagcagaaagatttatttggtctggtcccctcccagaaaatgagctgtgtgttttttctgtaatgagagccgacttctggacagcgttgtgtgctaagagcccctagagggtcggggtggtgtttatagaagaatttaattatcattgatttcttttgctctctccaatctgtgagtttcgactttggtaacaataattgctttgcaagtttgtgttgcaaatcctgactttatctggctcaaggcaggtctgtgccgaggggtttggagcgtgtagctttccttttgataccactggtggtttctggactggctttgataatcagaaggattttaaattggaggagggaaagtgccggccatccccagaagcctgccaagaggagctcaaccccccatgcccgccccagtgtgagcccctttccggtgccagcacccacgtgtgtgcccgccgcatgtgcatatgtgtgtgccctggagaggtcgggctgacgcagccccgcgcaagcaggaggaagcaggcttctcatgggttgcctggagtgatagggtaatcaaaccagatgacattggaagcctcttccgtttaagtccttgcctcagatgacctgaaatcgttcagaatgtgtttcaaagccctgaggtagggaacgtagagcctttggtgcaccaaatatgtttcttggaggtaacttggcccctagcttctcctggcctagaggtctttgagtgaagcgggaaggtgagattgagttaatggcagtcttatttcttaaaaaaaaagttaagcatataggctttgcgggatttgggttggagaagcatgaaaattgaactgggagtggggagaggggctgctccttggtcttcgtcctgacagccggcccgggggtctctctgggaggctgcccagtggagcctggagtcacagcctggatgcgagcagggctgcccgggactcctgctgggaccgagattcctgcctcagggctgctgactccctagtctgccgtgtgcttccatcatctccccaggctccatcctgccttctgtgtgaagctggagcgtgcaagggaggcacagttgtgcttccatcgggggctgcacgcggcccgtgcatgtcctttcttttttagttgtatttttacggctgggtttcaaaatctcttctttcttcctcttccctcacttttacagtcaccaaaagcagatccccctgtagtggctgcaggagacctcactggatcctaggaaggatgccgctgcccagtgctcaggggctcgggggccctggccaccccccctgacctgcccatactctgttgttcccctgccaatggcttctctgggagtgcagcaggcacggtcacagcaaggtcctctcaaggccctccgcattgcaccagggccaggctaccctgcacgttctccttccttttggagctcacgggcgtgttattttacgcagtgagaccatcaatttcactggccgcttgtcagcttatttacaacgcagaccccagctgctcggagaactctgctccctcgcagccctgggctcacggctcccctaaatttcaaatggacttctctgtctgggccatttatttagattagaagcaagagagggccacgttcagggctctctgcaaccaaattgaacgcacagccctgttcgtggctctccccggccccagagcttcacacaagggacttgctctccagttttatgaacaagc

SEQ ID NO: 51139 - DNA, 1024 bp, Homo sapiens
ccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggag

SEQ ID NO: 51140 - DNA, 1030 bp, Homo sapiens
gcctctgcttggcggccgtgaggccctgtggagctgacatctattgggcacagcttcgcatgtggagccgagaggtctctggggtcccagggcagaatcgccgtgggcaacacctgccccggctgacagctgcggtttctgtgtctctcttttgtgcagaagacgctggggaggaaacgtgggcacaagggttccttcaaggacggtgagtgtggcttcgggaggcaccgcgggctgggctccagttgaaactggtctcactggggcaccctggggttcgggtgggcctcagtttggtgtctcggggtcaccaaagctgcttgacagggtccttccagaggctgaggtcccagtggctggtctgttcatgtagccctgatgagtctagaaaggtctagaaagttcccttggactctattctgtgtgttctgaagggcagggtacagacagagcccccagtcttgccctgaacaccccatgtgtgtgctgggcccagcctacagtggccgtgttgggggaccaaggccagatcagagggcaccggccccacaccgcgggctctgcccggactcttcgaggctgaaggggagccatgtgttggggcctccagcatgggtggcggtggtgcacactcagcctgctcgggggagatgagaacatcccacagggaggttgacatagggaggtgcctgctacctgggtccaaatgcccgggggtgtaaagagattagaggcaatgaagcccggggagggctaaggcctcgagtgcccagctccaggcctgaggctccaagacacaatggccccttccagcccccagaagctttgtggacaggcatgggcccaggagggggtacccaggtctcctctacggaaatccctgggaagtgtccccaggaggcagcagcgatgccccacgtctcagggtaaggctggttgggggctgctgtgagggtttggaggcaccctgagccgggaccagcccatttcaggtgggacttgtggcataggagaggtcttgggactggtg

SEQ ID NO: 51141 - DNA, 1055 bp, Homo sapiens
cagaggggacccctgggcggtgtggcagccctcctggtcctgacgtgctctaccaatcgagccacactcccgccaaggcgacccgccagctgtgggccccgaggaggagggagcccgggcggaaacagcgtcacccatagcttccaggcagggcactgactcgcctcgcccaggtggggtctgagtcacagtcctgccctccacactccctccctgggtgggctccgcacctctccatctgccgggaagatctgtgggacaagatccccccccgccctctggcctctccctctggatgccccatgctctttctgggctgctttggggctctggcggctggggggagcggggggctgacccaaggcgggttacacagagaggaaggtgacggggataggccctcggcaggacaggcctactccaggatcggacctacctgagccctgtggggtggctgtccatgttggccctggtccatcaggaggaggaaagaagggagactttggcccaggcttctaggacgtgtgaccgagagctcctgggcctgtgtccccccaggtggtggaattgggcatcctggaccagctctccactgaggagcggaaaaggcaggaggtaaaagggccctgggcgggagggctgtcccccatggcctgggccatgcaacacccggggaggggcagcagccacggtggcaccacccagccatccctctgcggccacctccagtgccaggccctgtcacgctgaccagcgcctcacacagccccgggctgtgcttccacctgcgccaggccctgacggagccccttcacgtcaccgggtgaatcctcggagtccaggggctgccatcacccccttctctgacaaggacgggggtcgttgcccagcttcagccggctcataaggcacccagccaggggcatccagggacgtcgggctggcatctccaagctggccattctgacagccccatccaggggtgtgtctggggttcctgtccccacctgcccctgccacccgggtcacgtcctcctgttccaagcattggtcac

SEQ ID NO: 51142 - DNA, 1035 bp, Homo sapiens
gtgggcaagggtgtctgtgcatggctgtgtgtgcgtggtcaggggtgtgtgtgagtgggctggccccaaggcccggagggtggctcgggagcatccggcaccctggtgtgtatgcatgggtgtatgtgcatggatgtgtgtgtgggcaggggtgtgtgtgcgtggacaggtgtgtgtgcgtgggcaggggtgtatgtgcgtgggtgtgtgtgcctggccaggggtatgtgtgtgggcaggggtgtgtgtgcatgggcaggggtgtgcgtgggtgtgtgtgcctggccaggggtgtgtgtgcgtgggcaggggtgtgcgtgggtgtgtgtacctggccaggggtgtgtgtgcgtgggcagggatgtgtgtgtgcatggacaggtatgtgtgcatgggcaggggtgtgtgtgcgtgggtgtgtgtgcctgggcaggggtgtgtgtgcgtgggtgtgtgtgcctgggcaggggtatgtgtggtctcgaccctgtgctgctccctatatgcaggaggaccccggagcatcgagtctcctgagcctcagcctcaatgctaacctgaggggcggtgcctctggtcccctcgtgggcttgggtggcgctgggagatgattaggggcctgtagtgcctggcacagggctgccccaacagtggtggttgctggcgcattcttatatcagccccgcccctggcgagtcccacccatctgctgcctgtggggtgcccttgcggaactttggggccctgagggtgggcagggagccgccttgtccctggagacaggggcttcctgtagagctccagggaccagctatgggaaactcccaacctctgactcagcatgggatggggctgggggagggggaggggtctgggatagcggctgcccctcccccagctctgcccccagccaggcaggctttgtgttctctgagctctgtgtcctccggtcccctctgcctcaggcagctgcatgtttgcctctgacctcctcagggctttagattgctgccctggggcgggaagctccggcct

SEQ ID NO: 51143 - DNA, 1048 bp, Homo sapiens
gcagactggccacaccaggggcgagcttggggcgaccacacatgacacggcacccaacacaagggggccatgcacagggggcctggtgccggcccgcggcatcctgagtatgtccctggaaaatgtgtggccacggtctttgcctgggctcagagtcactgtgaaaatccaggttcttaagaaataactttaatgtatttagaaacctcaaaaccgaaatctccctgccgggtcccctccctccggccggccccttctcagaacgtggggcactcctgggcactcagggcccttcttgtcccactcaggggtaggaagggcataggaggagacctcgcattgcccccaataatcgctattggtgcctcctgtgcccatcagtccaggtggagttgccccctgggtgcagtggggaggtggggcccagcagctgaggggcccagccagccaacgggaataggctgggctccctgggacacggtgtggccccctcgagcttgcctgggggtgcctctctggggacatgtgatcttccttccgtgaagtgtctggagcccggcaccacagccacaggctcttgggaagccccagggaaccatgctgggtccttgagaccagctccccacgctctctagagccaggcacgaccacttgctgattggagacaggctgtgctgccgccggctggcctcgccagggctacacgtccgtctccacccgcagacgctccatcctgcggacattgccctccacggccacacggctggtgatgaagcgggcaaagtcctcggggaaccatcccgtctctccgtcccggagcctctcgccatagagccaccctgaacccggataggggtgggagggaggtgaggggaaggccgtgggtcccccggcccctctgagctgctatgcctgagcacaccagggccaggcttctcctagaactgaccacctgctcctgctcagagcagacagctgctgaggccttgctcatggtcaccgggcacccagcccctgctcaggtgctcgccactgagaagggtgctgg

SEQ ID NO: 51144 - DNA, 1149 bp, Homo sapiens
tcactgtgaggggcgctgtgcctgccggtggggaggcccctgccaccttgccaccggggcctgcctctgccctccggggtggcggggggctccaggtgtgagaatggtgagcacagcccccagttcagccagcattgggtgggtcgtacccacagcacctgctcccggcctgtcctggcccacagatccccacgggcccctcctagaagcctccgcagccctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcagggtaggtgctcccaagcccccaccccgaggagcggctgggcagggggaatccagagaggctgcctgttccttggcggggctgggccaggaccgaccctgcctgtctccacccagcctgcccacccggcagctttggggaggactgtgcgcagatgtgccagtgtcccggtgagaacccggcctgccaccctgccaccgggacctgctcatgtgctgctggctaccacggccccagctgccagcaacgtgagtgctgcccgtgcccacccagggactcggcagtgctgcctggcgtgctgggccccagttcccctggtccccgggaaggccctcatctgagggggtggaagatggagggtgtgggggtctcatgagagctgccttgctgtgttcaggggcactggggaagcctccagccccagcccctgcagctagcccctctccctgcaggatgtccgcccgggcggtatgggccaggctgtgaacagctgtgtgggtgtctcaacgggggctcctgtgatgcggccacgggggcctgccgctgccccactgggttcctcgggacggactgcaacctcagtgagtggctggtggcagcagtgctgagtggcgcctcctgtgtctccagggtagggccagccagcctgcaggaggatggcccccgactgcccacctccctgcccttcagccccctctggctgggcctggccccaagtggggctaagccagaggggcagaaaggacctgcagcgctgggggtgtctatgtggccccaggtcccacagg

SEQ ID NO: 51145 - DNA, 1019 bp, Homo sapiens
cagtgaggtccctgttcctggaagcattcaagtagagctggtgatggctgggtgaggtttgcagaagggattacttgggggccagtggctgcaagggatgatgttggctcccttattaactctgaagtttcagcctttctggaggaattagtccagaaaatgtttcccaggtggctaaagcttcatctttaagtcttcagacttcatcatttctgcctctttcgatggagagtgcagctaacgtatcataaactttctgcctttgtgagaggaagacagccaaccctagaacctgtcccccaggtggccccgtgagctttcctggccgtatgtgctgggctctgcagggctggttgcctggtggtggtggggaccccaggcagccacacagggcttcctacctcttccctgtcagtgtgcctcccttccccactttgtctgccctttctattctacagggtgctggggaacccccgtattcattcctgggtgctgcacccctgggatcgtgctgtaccctccaggctgcctgcagcgttgaggggtcacctccccttctccaggcctcctctttctgtctcggcttccgcctgcctctcagatgaggatgtttgtctttggattcagggccagcctggataatgtagggctactatggcaagcactgttgcaagaaatgcaactgtgcctagtctccaggtcctggggactaggacgtgtatgtagttgtgggggtaccttcagctgactaccgccttcagtaggaggaaggacgtggggcaggacccagccagagagaattgtttggggaagaaaggcgaggacctttctagctctggggccacctgcggcttgggcctgggaccttgtctactggggccacgtgtccttcccgctttgaggctctgagatcaagcttagtgaccaccaggggacagaagtcaggcggctcctgatgggggccagactttggggagagtggggcgtgagctttgtgcatctctccagtgtgggccgag

SEQ ID NO: 51146 - DNA, 1079 bp, Homo sapiens
gttttgtcgcctgactcataggggcctccaagctcctttcggcctttgctggggccccgctaacctcaggctcaggcccccacactggcctctgagtctcgggggccagtgcttcctgggggccctggtcccactacagggctcagtgggcagcatggtctgtgtgtaggcagcacgggatggtcctggatcacaggtctgcaaaggagggaacccagggagcaagcttctgcagggcacgcggctcccgtgaacctggctgtgtgaccagccccacagaggcacaggagtcggggggccggtctggcagagctggcactgggagccccgatttccagcccagatggtccgagtgtctgtgactcctgagacgacagtggtatcttctgcagttgtgccccgtgggtgcggtaacaaataaccacacactcagcacttaggacagcacggatttattacctgacagtcctgcgaggcccagtccaaagtgggctaaaatcaaggcgtgggcagggctgtgctccttctggaggctctaggggacagtctgtctcttgcccctttcagctttatagaggccgcctgcattcctggtcttgtggcccctcctccatcctcaaagcctatagcacagcacctgccaatccctgcctccctccgacctctgcttccacgctcacatctcctcctccccgccctctgaccctcctgcctccctcttataaggaccctgtgatcatgttgggcccacctggatatgccaggataacctcccatccagatcctcaactcagtcccatctgcaaaggtaggtccctctgccatatgagggtctgtggatgaggatgtggacatgtctgggggacattcgttattcagctgaccacattgtcctgaaaggccactgcgcctacggctcttcagatcacagccgcagccagggtcaccggctcagcacctgcggggtccttggagccgtctgggaatagctcagccctgccatcacgtggggtgccttgggagtggggcagagagggtttgggtgacgcgttcctaccttgctttctgagtgaaaatca

SEQ ID NO: 51147 - DNA, 1044 bp, Homo sapiens
ttcatcggagtgtctgtgggacgcgggtgggctctgtgggatgccacccttctcaagagcaaagggacctgctgtaagggggtgagctcagggtagcagggaccaccagagactccccccacggtgcccccagggagcccctgtgcccgggagtctgtcgctctgcccttcccacccatccccgcccactctctgctgccactgtgggctcggcctttcacacccttgcctgctgcctgagggcactgccaggttcccactgtccccagggagaggaaggcatgtgggaagtgaccgagggctgcgggctaggaagcctgggcgctgaccggctgcccccctcgggccagctgtgcctctcccgcggagcccaggcacgggagaaacgagtgggcaagggggcctgatttggaccctggtcctggcacccaggccaggtgcccgcatgtccgcctgcactccatgagccccttggtgctggagctttttctctgaccttcctgtgggagcaacactttgtcccacccatggcagggcctccacccaggagaacggcatttccacgggagtctcctggggaggctttaatgcttccaggactttgttgcttcctgggacgatgtgctcttgctgaaccggaagagtggtcatggtggccgaaagcctccgcaagccctgtgcgacccacactccatgccaagcctgggcggcagccccgctctgtgacgctcagtgctgaggccccccacggggcagtgccatgggggatttagagaatggagcaagaggcccagagggcgcaggagcatttgcggagtcagagctggagggtggcagaggggacaggtgcccagagccctttgaagtccagggccccagcctgcgcctggccccaccccgccctgacacctgggctgctgactgtttggccccaggatgccatctcccctttctagctggtggcttctctggatgtggaagaggcttcttactcattcccagtccccatgccagaagcgcccagcccttagtgggtattccaca

SEQ ID NO: 51148 - DNA, 1025 bp, Homo sapiens
cagctcctcctgcttgctgtctttttgggcagaagaggccccttctcggccctgatccatagccctgggtgggtgggtgggtgggtggtggggaccacctgtgcttctctccggccagcaggccccgtgcgtggggtgttggcctggtgggatccaggctttggtctttcctgctttctcccattgccctggacaagagggtgtggctgggttccaggacgggagagggccgggcaggacctgggatcagcccttgtcccactcccctgccagccgccctgtcttttccctgagggagctggaagaggccaacccccaaatcagtggccctagcctccacactgtggtttccagaatagtggccccgcgatgtccacagcctaatctcagggaactgtgacctttaccttgaatggcaacgactttgtagatgtgatcactttcaggaatttgagatgggaaggtggccctgggttgcccaggtggaccctgaatgctgtcactcatgtcctcatggagggagagaggctggcacaggagaggaggggcagggggacctcagagacagaggctagagtgagaggatccagttgtgggagaggctctggagcacctgcctggggggcccagtcattctcactttggacttccggcctctaaaactttaagagaggcttctgttgtttaagccacctggttagtgacactctggtacatcagccccaggaaagggatgtagctgcctcctgtagcagctgggaccctggggcccttacctgactccaggtgaattacctgcccctcttcccccaggctgaagccgccctcccctctcaccgggacacctggagtgccgtccccctcccgcctggcccggctgggtccccaccccttgttagaccccgctggcttttccagtgttcctgccatcccccagcgacactctctcggagccgcctggtcggggcgctggttgatgctcccagcccagtgttggaacccagagtcctcaccgtctcctcctg

SEQ ID NO: 51149 - DNA, 1026 bp, Homo sapiens
agatgctcgctctttacacggcccctgtgcaggacagacgctcactctttagagggccctgtgggtcagggcttggctctgtctctgccctctcttttctcaccctttgcccccttccttgtttctccatcaccctccagcccctgctggcaggggagggacaggggaggcccctgagccgatgatgccccccagcccccagccgttgtgaaatttccttgcttccgtgtgacctggacacccggccgtggaggacaatgtcagggcctgggagccctgccgtgtttgtgtaggagcgaggagtaggctaacgcccgtgagactggccggaagctgctaatcgtgttatgatttccctgagagccacttacttagtgccgggcggggcggtggggcctcatgaccggggcttccagagcccacaacgccttgcggagcctgtggcccgggtgcagtggggttcggacccactcctcttgctgggggggtgtccttcctgctcatggattctctgaattccacttttatcctggtccggtgccaggtttttcccagaccctgcccatgtttcagccggagtctccctggtcctggcagcaccatttaccttgggcacccctcctccaagccgggctccccggtgggcagagtggcagatgagcgccagcctggagcagctgactcgctggtccttccgcatgtacaccctgagatggaaccgtggaggaacaaagcccaggaataccctgcctgcagccccctgtaccccgcaactcctcatacgggctgtgctggcctggcccaggggagggggaggccactggacggagaggcagggcctcagcatacagttaggagctgcaccagctccatgggctgtgatgggcactgggaagggattctgtggtccagtaagcgcttcctaaaccagagttcagcagatttcttcttttgcaggaattttcagagcctttaatatgcgaatgtgccctgtggattcctgagacagactatacaggctttccc

SEQ ID NO: 51150 - DNA, 1029 bp, Homo sapiens
aaatgtctgtgaaaattcagaaaagatgctggattattttcttggattgacagaaatgttcgttcggggagctttcagggatgttttgcatctctctgtgggactctcagctctggaaggattaaagtcaggctgcagggaaggagcgtgcaaccgccagcccgcggaccggacatggggagcagtttgctttggaaattagcaccttgagttatccactgagctggtagtttgattcttctttctccctacgttatttctcctccatccaaaggctgtttttattatttccagcagagaatgagacaaaaacatggaaaggtagtgtcttttagtaatgcttttcaggcaagctagaggaattgtttgccagatttaaaaatggaagaaatggaagcctgtccactccttatgtctactggggagaggctctgagccaagcccagttctgcgtgtaacccaggagtggtggcctgggtgccccaccaggcctgaagcagtcgaggccaggtgggataaagaggggagaagcaggagagctgagcccactggatagggtggggggtggagaggctgggaccaggtgggtgggtcccacacgcgggcttccatgccaggtgctgtggctcagggccctcttgcaggcccgggtgcgggcatctacatttggggtctaatatagacctccattcggcctgcttcccacctggtgccttcccaagaacacgcagggatgtgatgactcaccgggtctgtacttcctaagtggagttggcatacctaacagtggaattgggatgtttggctatgatttcctgaaaggtgtttaggatggaacttggtctgggagctgaggcctgagctgcagctgtaacccaacaggtctctgaagccatgggaagcccccacttggaaagaggaccagagggaggccagtgggtccagccatgggaccagcgggttctaatacctgcgctctgcaccagggggcagtgccctgcaacaatctctgcagccgccctttctctc

SEQ ID NO: 51151 - DNA, 1036 bp, Homo sapiens
ccacgaccccacgcgccgcgcccgcgtcaaggagtacttcgtgttccgggtgaggcaggggccagggccggggcgggggccgagggcgcggggcgggatgggggcgggtggggtcggaggcgggcgccgggcggtcccgcagggagcgagctgtgacctgtgatctttgcccccgtcccccaccccgcaacccgcccagcccggcagcatcgagcaggcagtggaggagatccgcgtggtggtgcggcccgtggaggacggcgagatccagggagtgtggctgcttaccgagtaagccggggctgcgctctccttggtggggggactcgccccgagccgccgcgcagcaccttgcgaggacttcccggggtgctcgtgccacgctcaggcgccccgtgccgcccctgctgcccttccaggcgggctggccttggctaagtcgagacagccgcgtccagtgtggactgaggcccctcctctgcctacagggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagtaagcctgttcagagtccagtatcactggacctaagcaccagagtggaccttacaattcagcccttttaaatcagccccccaagcggtgtgtcttctctgtcattaattataagcacaaaggctccagctccaaatatcaatgggaagttccttaaaaagaagcgacttctgggcaattgagtgcattaaaaggaattctggcacagaaggcagctattaggctggtagtaaaaagacttacatgagttcaggatgcattgaagtagagcccagcgtgttaaaaaggaacttggatgttcttcaggaaaagtccaaactctgcatttttctccagccagggacagattgcatatgacacatcaagtcttg

SEQ ID NO: 51152 - DNA, 2125 bp, Homo sapiens
agtgtctcagaatgctaattttttcaagtaatagacattcttatcttgcctgacagttaaagctccatgtttttctctctttaaagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaagaaagtgtctcttccctctttgaaagcctgccccatctctgccggctctgcacctgtgggcctgttctgcctgtaccatgcggactgcctgtcacagcagtgccgagtatggttctctgcagaaagagatcacgatatgcaacaacctaggtttgcaaccctgatccccccacctgtggtgccaaccaagtctggctgcctgccgagcaccagctggagagattgatggaatggttctgggtggttctaggcacttcctgcaaatagccagggtggagacccacgcacactggttccgaaaccagagtagacatgagact

SEQ ID NO: 51153 - DNA, 1054 bp, Homo sapiens
gtggtaggaaccaaggcaggcatcagctgcgtcataaggatctggtagatggagtctcgctctgtcgcccgggctggagtgcaataagtggtgccatctcagctcactgcaacctccgcctcctgggctcaagcgatcctcctggctcagcctctcaagtagctgggaccacagatgtgccaccacgcctggctgctttttgtctgtttggtagagacgggtttcaccatgttgcccaggctgctctgcaacttctgagctagagcgatttgtctgcctgagcctcccaaaatgctgggattacaggcatgagccaccatgctggcctgatacggttccttgttttaaagtgcattattcaacaagcaaagtacccgattccctttaactatgaatacaatacaaacttcgaatccagagaggtgtaaaacttgtgtgcaaagaactgtcaaggtgactttctcaaattaataaattgtcttacaatgattttctgtaaagctttctgggtctgggaaacagacctgaagtattaacacaacttgggttaattgtggaaaaagtgtcacttcaggtcacccatttccaaaagagcagcgggtcaccaaggggcccacagccacagaccggtctcagtcaaccggtctgctggctgcttttggatgagctgaagtaaaaatggattacattttaaaatacaaaattggacaccaggtgtaaacatacttgcaactgcaggcactcgagataccaggtgcctccctgttttcagcaacctaggcaagcgctaaggggtgtgctatgggtcccgcgtgctggggcagctggggtgggaaaaaccacgagaagccaagtagatactcaaggaaaacaccagaactgaagttacagagaatgaaataccagcagcacagggacagcgagagtcttttggcttttgtctgtagcttatatgagcagagtccaatatccaattaaatagatagaattcactttacgattctaattgtgctgagatccctaaaggtgaaagatccccatccttccagcagca

SEQ ID NO: 51154 - DNA, 1035 bp, Homo sapiens
gctgtgatgatggttcttccacagccggaaagtctaagggtactgacgctgaggtggaagggattgtgaactcagatgctggtagtcgacagaaaagtgctgaggagttggagctgctgagattgcagctaggacctgtccatgtccctctccagtcagcccctggcacgtggggtccaccccccacctagtcgggcctggcaggtgatggtgccactctcatccggggcacttgcgggcaggcccctcgctgcggctgccaggctttgcttagctcttcctgcccttgggccgcactttcctcccctttgaacagaggagctgggttcgcgatgcccgatgcaggcacagcagcctctcagccgcgtgcgtacttcccgaaagggtgacaatggcgtgttcttcctgttggtgttctagatgagatcgcctctgtcccagtctccttacagacactgaaacctgttaccgacagagcaaacccgaaaatcggcataggaatgctggcatttagtcctgacagctacttcctggcgacaaggaacggtcagttgtgctgacgcaggtgctgtctcaccctttactgtgtcctgtggccccaggtgtagaagcgactggaaaagaaaatgaagttgggggtttccgacacgtcacctcctttcacgtttctgcagtagccgaggtgctcacagaagctccttggaggcgctgggcctttgtcctgcagcagccgcaggtccgcgcatgagtcaggaggcctccaccctgctcacttgctccactctgctgagtagaaagcagggctgggcacactgcagcccgccttttgttaagggtttctccatttgtaaagggctaaaaaaaaaaaaaaaataccaaagaaagaaacacatttgggccccttacagcccgtgatggccaccctggccctggccaggagccctacagggcccaactgaacccagactgcagggtgcagccgccccaccccaccggttcttcccctcccctcctgtggtgtcaacagcagagcag

SEQ ID NO: 51155 - DNA, 1082 bp, Homo sapiens
gtttgtggggtgtggacagcacggagcgtgatgaaaggatacaggcggctgggcgtggtggctcacgcctgtaatcccagcactttgggaggctgagtcgggcggatcactaggtcaggagatcgagactatactggctcacacggtgaaaccccatctctactaaaaaatacaaaaaattagccaggcgtggtggcgggcgcctgtagtcccagctactcgggaggctgaggcaggagaatggcgtgaaccaggaaggtggagcttgcagtgagccaagatcgtgcaacaatgcgagactccatctcaaaaaaaaaaaaaaagaaagaaagaaaggatacagacatcctgaaccgggggctggggccaggtctgaaggctctgatcttcctttcttctgggtctagggcacatgagggtctgtgacctaattcagaggaaggccagagaactcttttatggcctgcctcagggtgacagggagcaggagagagcatacctgctttccctggcttctcagatgccaccgtgccaggttttggggtagtggtatgtcttgagcccaatcagtaccctgggggtcgtggccggcccccctccctccatgccacaggctctctggagaggccactgctgtatccccactgtgagctcgatctgagctgcctatgggaccacacctgagaacccccaagggtggcactggcagacttgaggtgcccaagtgaggctggtgcagcccctctgccctgccagtctgggcacgggcccctgggcatcgcgactcctaccttcctaccagcccagatgcagggcctgagccggcagggcttccacccagcccagggtgtgtccccctaccagaggcgctgcattggataggaaggacccacctgtttccctgcccagtaccagctggcaggccccccgtggctcagggtgcctgtgaggaggggtgggggctctaattgctcacctgctgctctgaggtgtcaggcagggttgggggtggcacctggggaaggctgggctgagggggcaggctgcccctcctgcaggagaggtgcagtatttcactgggt

SEQ ID NO: 51156 - DNA, 1039 bp, Homo sapiens
cacctggcccgggccaggaggagcatcgggcaggaggcgggtctcagggccgggcagtctgggtgtgcccacccctctagacgtgagtggccagagccagtcagcctccaaagggccacagaggggacggacttggccctgctggtgagatctctgccaagactggccagcggcttccccatgctcaggtgggatctttggtttgaaatcctgtcctggacagaggcacgggctctgctgccaagagttgtctgtccgagacaggcccacagccctagggtctgcagaacctgcctcctccaggcagcgagacgcatctgcgggtgggtggatttgggctttgctggcactgtctctggagtgtcatttccaggaattggcatgcaccaaggagatggggtggaaccaccgtgccaagggctcaggtcctcactgcggtgcccctggagacagactggcccacggtggggatcttgctaattctgataacatcacctgtgcacaaggccagtctcctcgagccaggcaccatgctcagggctttgagttgagctaactcttgcacccaccaacaacgcacagggctgactccatcactgctccccttttacagccaaggaggctgaggctcggggagggaagtggttcgcccagagttctgctcatagtaagtgggggcagccacctctgcatctgtattcctaaccactgagctgccctgcccagacagcttcaggggagggggtctgtcaggaggggcaaggtgaaggctgcatgaccccagccaggagtggagggcacgcaggggctgggcgggaaaagcagccccaagagccctccgggtctcccctcctgcaccgaggagggggcaagtgagccctgcctgggcacccaggccatggctgcaggaggggctctatgggacacatgttggtccggcccactgggcagcgtcccctcccccacgaggccccgcctccccgggcacagctcagtgctggccccctgaagtccatgcagggcggccgcattcccaccc

SEQ ID NO: 51157 - DNA, 1563 bp, Homo sapiens
ttatcacctctccgctgtcctcctgcccaaacctgcccgtgccgggcacccagctgccggggagcgaggagcgggcacaaggaaattagcagccccccgctgcaccctcccctcacccacccccgcaccagccctgccaggcccagggctcccagccaggccgggcccatgttgtactggggcgggggaggaggggaaggagaggagggtcggagaggagccggcagcgtggggagggatgggcacagtggcgtttgggcaaaccctttcctgcaagcaggacggtgcacgcaccctgggcaggcaagtccaggcggctccgtgtcaacagccgaagataaatacgattttatcagctcggaatctgttgaaacacatccatctagcggttctagggaaggagaaggcaggaggggggcggcggaggggaagtgtctccacgtgacctttcctatagaataggctccaccggagtcctcctcctcctgcccgttttccacagggccaagcccaggcctgaagcctagaggcctgctggggagacaggaggaaggagctgggggagcgctggagccgtcctgggctcagccaccctctagaaggacctggatctctcagggctcccttccctcctgtggccacctgtgtcacccacccccagatgctgccagggcaggggacatcacagacatcctccccgaggccacccagctccggcccggctgggcacctggggtccagttagtgccagggtgaggtctgccaggcatgtatgccccaaaggccatgtgagcactgcactggggacacctgtggggaggagagccaggcccaggaccttggtggccttactggccagaggggaggagaagtgctcacatcgcctgaggacaggggcctccttgctctccaccctgaggcctgggcctccctccgccactggcccaggtcgaagacctgtccgttctaggccgctccacactccagtccgagcccccacttcccggggtgggtggtccggccgccgcctgcaccgagtaccagggacagctcccggcgcgcccaagctcctccccggggcggggcggggcggggcatccacagtgctccccgcgcctgggcccccaggacctcttgcagacgggagtccctcagacagtgcagagacgggagcacgcactgggccctgcacccacttcgtagcgccctggcctgggacgccccaccacgcagcttccagagcaaggatcgccacttcaccctgcccggagacccagagggagtggggcgggctcagcagggcgctgctgagaggccgctgcctaggtctgcgaaatgggagcactgctgaccctgaggcccaggcgggcgggagctcaggctccgcagaggactatggccgggggtgctggggcaggggcctaggggaggggctgcaggggccaggcaggagctgtgaaacccctcacgctgttgagactccatggggctgtcagggagcgacggctgccggggcctctgcccgcaggcttggttgcacccagagccttactccatctgtgt

SEQ ID NO: 51158 - DNA, 1032 bp, Homo sapiens
ccacacagttttgtagatttttcctgagaacaaatgttgcagttgctgatgtctacatttgataactgttcttttctgaaatgtttttttcttttaaggttaagaaaacgacttctgatttgtttttggaagtaacaagtgccaccagtctgcagatttgcaaggatgtcatggatgccctcattctggtgagtgtggggtggctcctcctgagaaacgcttttgagcgtgagtggtgctctgctccttgacttcccacccgtcctgcttgcctcttttttgcttactgtgttggcagacagcagcatgtcttccctgggtcacctctcatctccaggttaaaaaggtattttttatttgcagaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttgagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctg

SEQ ID NO: 51159 - DNA, 1115 bp, Homo sapiens
gctgttcttgcaaagacatgaaataatgaaacagaccgcgtttgcggttactcgaagcggtgcacagctgtgagaggactcggcggatgagcagtcgttgggaaaatggtttccttcactcgctcactaccttttaatcagaaattttggtctctgtcccgatagtaaaaccgtttgcgtggggttggcagtagggtgagttgctgtgtcgtgctgtcctgggctgttgaatctgtggagtgcacgaggtcccggctgctcagcctttctctcctcttttggccttctgaggatggcagacctctggaaacagttgtgcatgagctggctttaaggttaagccctgcctcagtaggatcggtgtgtttgggcgtcaggtctccccgggacgctgcagtggcagcccacatgcagcttcttgctgcgtggtcccgtgggatgctccctgcctgctgtagagatgaatgagggcgggagtcgggagggctcattgaggcttaaggccgtaatcgacacgatgggcgagttctgtggctgtgaccctagtggagtttgtgggtttctgcccgatagattgtccccttggggcggaaagaagccaaggccaaggagctggtgcggcagctgcagctggaggccgaggagcagaggaagcagaagaagcggcagagtgtgtcgggcctgcacaggtgggcagcgtgcctggtggggtggggccgggcccgggggagtgccgcatgctggcctcagctgagttagtctgtgctcctcaggaaccgcctaatgctaccagaacccagaagcttcttaacagggtacaaagaaagcattctctttccaaaggagacgttgtggaaccagtctgtcatctagatggccctgacgtgagggaagtggaaggtgttaggagcggaggtattggccattccacagggggcgggtggccctcaggatgggacaggacaggatataaactagccattaggaaacagacataaatgccagcccaacccacagcattttatccataccgtgcgctgttgggtatcatccaagtcagggtccttggtgctgctctaagcaagatgatcatccgtaactagcccagtgatttc

SEQ ID NO: 51160 - DNA, 1007 bp, Homo sapiens
gaagtccacgagagccgggtcccgcacgcccctggggtccgggtgctgaggcgccgcctggccgcctccccgggccgcggcaccgctccgacccagccgccctctccaccggggccgcggcagcgccagtcggggcccttccctctaagcaggtaccttccgggccgctgcggcgccggcccagggccggagtggggagcggggcgcggggcgcggggcgcgggcgccgcgggggcgcggtccccacctgggagctgggtacgaagcctgggtgcgcggtgcaagcgcggacggtgtggagttagatgccggccttgctgtcgccgaagagccggcgcggccccgtcgtgccgtatgccggggagctcagcacgggtgctgggaccgcctgccccggccgggacggcccatttagcgtggaatattgttttcagatccggcttttcctcttctggatgcgtagcacatagggggccagtttcagatgtgttctgctgagcaaaagtttgaggaaaattgctctgtccctatagagattaaagtctgatggttggttgttttttgttttggagtttgttttgttttgtttgcacttaagttcagatttctctgaagccctttcagtcgctaagatgacttgatcagaaacccataagcctttgagacggtctcgctctgtcgcccaggctggagtgcaatggcacgatctcagctcactgcagcctccgcctcccgggttcaagcgattctcctgcctcagcctcccgagtagcccgactaatttttttatttttagtagagacggggtttcaccatgttggccaggctggtctcgaactcctgacctcaagtaatacgccctcctcggcctcccgaagtgctgggattacaggcatgagccaccgcgcgcagtcacacttaaaagtcttcttaaaaagaaaatcagagacaagttttgtttcctagtcttgtaacaaaatggaagttgctacactgagtttccgttt

SEQ ID NO: 51161 - DNA, 1340 bp, Homo sapiens
aagaaatactagcctctggattgaggcctgttttatttgctagatatgtctggttccccttacattttttttcttgacagacttcctcatcccacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcaagtcttcctctcggtggctgcagagttgtgagtgactctcgcttagcaaagactagagatggcctgtccgtgccaaaacacagtgccgggtccggagcagaagaatccaacagcagctccactgtgcagaagcagaatgagccagggctacagacagaggatgtgcagaagccaccacttcagatggacaacagcgtctttctagatgacgacagcaatcagccaatgcccgtgagccggttctttggaaacgttgagctcatgcaggtaagagcggcgccttcctcctcccgtgggtactcaggcagcagctgcacattcaggtcacacactccccactcagtgcaggtaaataatgcctcgacacaacattaaacataaactaatcattttaacccacgaggagaaaatgaaaccgttggctaattgggggctctccctgcatctcccgagctgagaatcactgctctcgggaaaggtgtgtttccatgaaatcaggtttgtggtttttttgaacatccaccccgcgcttgctgttaatttcttttgttttgaacccagcacctttccttctctttactcgatcagcccagtagggaggaagttctcatctagaggcgagtgctgggactcaggcattttcacacgtctaaaagggaagagcgctctgcgagccctagagccgctgggtggggcacattgcaaatgcgggtgcagatatgtattgctcatgactgaagtcatgttttcttctccactaaggacctcccacctgcgtcttcatcttgtccttcaatgagcagacgagagttcagaaaaatgcatttcagagccaaagatgatgatgatgacgacgacgatgatgcagaaatgtaggggccatacaaaataatgtccttgagtatttagtaccattaacaatttgacaatttagcacattacaagatttatataaaatgtatctccaagagaatgtcttaatcaaacttcagaactgacccatctaagtcaatagtgcaaagcacccaatacctgtgg

SEQ ID NO: 51162 - DNA, 1092 bp, Homo sapiens
cgggggcctcgattcttgcttcgtcgagtccctggacagacgagggtaggagtcccatggtcactataagtggcctctggaaacccctgtggttcagaggaactagaccataacaggcaggcacgcaggacacttccctctgcagacttgatcagggatgaaggacaagccagctcgtcatttccagcttgtacacgtgcccctgggtgaggctgaggacaggggctttctcactcatcagctttccccaaagacaggtccattgtccattctgagatgaaggaacggaccaccccaacctgtacccaaaggctcccacacactctaggcccctctggcaggaaggacccaccacagcttttatcccgtcgaggcgttcgtggggaaactgagtcagcaccatggtctgactgatgctctttagttaagcaggtccctagctctgcgatcacacagctcactacttacccctcatcctccctgctgtaatagccacatttaaaattcaaatttcattttttttttttaaaaaaaaagagttgattgcttgattgtggttgatctttctgaagaggctgggaattaccgtttaatatgaaatgatgcgtagctcacgcctgcaagcgaaagacccacagtggaagtctggagttgtgtttgtgggtttccggcctctgcccgtccccctaccccaaactctttctcttccagctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccggtaagctcgggctctgctagaccctgcagctgtgaagctcttggtgctcctgacccccgggggccggtgtggctgagctgagagctgttggtcggtttaggtcttccctgaggtcgctttgaggggcccagccaa

SEQ ID NO: 51163 - DNA, 1052 bp, Homo sapiens
gcctctgggttggggctcctggtctcccgatcccagtccagggtctttccctgccactgccgctttggctgcactcttgcattccagctttgcccagctattcttgcattttgccgtcagtgaatgcatagacttgagtagttcctgtgactctttcttttgtttgagaaggacgaagacaggtaagaagcagcctgtcctccttctagaagcctgctgtgcttttagtagagatggggtttcgccatgttggccaggctgctcttgaactcctgacctcaggtgatccgcccaccttggccccagaatgctgggattacaggcatgagccactgcacccggcctagcttgacttcttaagatgcagagctgtggggaaccatgctttgagttcctcaccagaagatttactgtcatatccttggcagagaggagtgtgccttggttactggaaggaccaggagttgaacggtggtgcaaatgagctgtagcagcataatctacttctcagtcactgtttggggaccagcaaatctacatggatggaccctgatttcactgagtttatttaatttggatttatggctgcattcatgtcacattaaatgattaccttcagcccaggttccaagcattggaagacattgcctctcaaaacccaatgtaagagacttttaaatacccactagtgtttaacttatgatggaaacttttcatacttcagtatttcaccaacttatatggttcctttggagatcttaatgatatgcggctgtcactttaagtgaggtactttggctctcggttatgaataatcctttttattttctctgtaacattgcaagggagcaaagtttcattcatcacttaccacagaagagtgtgcattgagccgctagagggcactcagtctttatttttttgtaacttggaatttccctgacctatattttgcttttgaatgttcctctggtggtgtcagaattttggtttgtttgcttaatagatttgaaaacagccatgtagaaggggtcattgcaaacatgtaattg

SEQ ID NO: 51164 - DNA, 1031 bp, Homo sapiens
aagtgttgggattacagacgtgagccgctgtgtccggctgggtttgccatttctaagtgacttaaggaattgttctttaggccggagtaagggctggctttgaccaccagtgatggatttgaggtagtatggatatgggccaaagttgtactctagcactgattctctgtgggacttcaggtaagtgatttgagctcttggaccctgaatttattcatctgtatatgaggagtaatgataatgcatatctcgtaagttctgcttgaatattgagcgatgtgtttttcacaggtgcctggcaggcagtaggtgttcattcagcacacgctggctgagtgtctgtcgcgtgccaggctctgtgtaggagccgggcatacgggtggataggctggcgcatcatcctttcagctagggttaaagcctacatgtttactccaagtcagggtttctcaagcttgacaccactgacttgcgaatggataattgtttgctgtcgcggggctgtcgtctgtgctgtaggatgtttatcagcatccctggcaacgcactagatgccagggcactgcctccctgctccctggccctgttgtgacaaacgaaaaaaaatgtctccagacattgccaaatgtgccttagggagcagaatcatcgctggttgagaaccactgctccagatatacagctgtggaaattcctcagatgttgtcttgagacatttcagagttttgtaaatttccatggtgttttccaggaaagctcctcaattctcaggctgccttggttggggctgcgtgtgtgccagacatgcttggccacaagcaccaacggcttggggagctgctgctggcctcagctgcctctgccttccgcagaggatgggactggtggagtttagaaagctctagtgggcgtggtggtggctgaggcctccatgtgctttccttctgagaagtgcgcacgtggctgacgactgttctctgggtcctgtcttccaggttgcggctgtaccatggcacccccagagccctcct

SEQ ID NO: 51165 - DNA, 1033 bp, Homo sapiens
ccagcctggcaaaacccactctctacaaaaagtacaaaaattagccgggtgtggtggagtgcacctgtggtcccagctacttgacaggatgaggcaggaggattgcttgagcctgggaggtggaggctgcagtggccagacctccagcctgggtgacagacgagacccttttcttaaaaacaaaaacaaaacacaggtactatagctaaatatagttcctgcacttctcgctggctcctggagcacgtgtgctctcttcctctcaggacctttgagtttgctgctcctcctgcctggctccctctccccaaactccctgtggttcttctcatgccccccttgttctcagctcaaggatcatctcagagagcctgccctgccctgccctgccccgccccacccacctctctccccgttcttcaccatgtaagccctgtaagggcagagattttgtctgttccttgttgtttccctagtgcctggaaatgtgcctggcagagagtcaatgcgcagaatagatgtgtaagtaacgtttactaagtgaataggtgaaagaaaggtggaggactcttgtctcaggtaagaacctgtcacagaagagaaaaggctaaagcaatacttgctgtaagtggtaaagctccggggcagggtcctgcctgtctacactctggctgccgctctgggcagggtcctgcctgtctacactctggctgctttgttctgtatttgtagccatgatttctcaattctcaaagatctgctttttgctttgccaatgtcaccccaaaatctgggaagttgaggatttagtttctggttatatcaggaagggctcatttggttggaaatgattaacaaacccatccaaaatgatttacgtgagaggcgatttgttgactcacagcaaatccacagccagcataagcttcaggtgtggcttgagcgaggtctcaggtgatgtcccctggacttgttctctctcacctgttggctgctgggagccctgggcctcatcctggcaggcgcatgtgtc

SEQ ID NO: 51166 - DNA, 1006 bp, Homo sapiens
ccaactcccggcctcaagtgatccgcccgcctcggcctccctaaatgctgggattacagatgtgagccacctcactcggcctaaaaaagcagtttcttagacccactttcttctccactgtttcttgccttccatttgagaaaattcctcaaaaagttttccttcacttatctgcgattcctcttcttcttccggcttataaaccaactccaatcagcctctgccctcaccactccgtggaaactgcacttgccaaggttgcggtgacctcttcgttgctaggtccagcggtgcccatcgtatcggggtgacagaggtgctgcctgcggcttccccagctcccaggactccacgctcccctctcatccctccagccactccttctcagtctcctgggcttcttcctgctcatcgctgtcctccagtggctgcccttgctcagctcttgaatatattcttttccatccccacaaagcccctcagatttccacccatctcgtggctctgaaccccgtccccatgctgcagaccccaccccctctaccactcccctgaaccccagagctgtttatttcctgcctgtgtggctcagctatgagggtggggaacgtgtgcctcggattcctgggtcagacactgagctcccgactgccctcacccccagcccagttcttcccagggtggccccagatgagtaacgagctccccaccctcccaggtgtcagtcccactcccgggagtcaccccgactcctcccttcctcccacgtcccgcctcccacatccaatccatccctgggccaggggccccgtgcctctccctgtctcctctcctgcccagctgccaccggctctcatgctgctcctcacagcattccctgcgcccacctccacccccgccggcagactctacgcggccagggtgatcctcccagaacataagtcagattatgtcactgcttcactccaaaccttccaatggcttccattccattcagagccaaagt

SEQ ID NO: 51167 - DNA, 1003 bp, Homo sapiens
ctctctgccaccccactccctgccctactccttcccgtctgagcccacctgtctcagctctttcccttgatctttcagacaaaatggaagcccagctgggctacatggatgagaaagaccccggggcacagaagccaaggcagcccctggaagtccaggtgtggaacttgctggcgtctgggcctgtggtgtgtgtggggtggaggttgggtctggggaccttctcaggccctgtacagcgaggtggaacccaggcctcctggctcccttttcggggctctgaatcggcggggagcaggctaggagcaagcgacgggagccaggagactgggttcccagcccagcgcacgttccccgccctccgttcctggtgaggccccaggccttgtagttctcctggcttttcctctgcaggcccttccagccgccttggatagagtggagagtgaggacaagcacgagagcccagccagcaaggagagagcccgagaggagcggccagaggagacggagaaggccccgccctccccggagcagctgccgagaggttggggcttcttgcaggccacccaccccagtgccatgtctggcctcagcaggcctgggttcagagaagggcaggtggctgtacttccgctcatttctccctggcagagaggtagactccaaccctctgcaggccccctggtgaggggaggccaggagctcaggcctctatacatggacttaatggactttttttttttttggagaaagggtttcgctctgtcacccaggctggaatgcagtggtaccatctcggatcactgcaacatccgcctcccgggttcaagtgattcttgtgcctcagtctccctagtagctgggactacaggcgtgtaccaccacacccagctaatttttgtatttttagtagagacgagatttcatcatgttggtcaggatggtctcgatctcttgtagctgggactataggtgcataccaccacacccaactaatttt

SEQ ID NO: 51168 - DNA, 1943 bp, Homo sapiens
ctgcacagagtctcaggcacttccttgtattatactgggcagattcagctccttgctgccctcagaaggtggctgcgtgtctccagcacatggtcttgtggtcccattagtggttcgctcacagggaaatgcagcctcctacctccccgtggcccccacgaagctctgtgtggcttcagttacacccagcacactggccgtatcatccctcacacactcttgcacacctgcagtcctgcctgcttccaatggctagaagcttttccactccaaacccagcctggcacccaggcttgtgggaggctccgcagtcagggagggagcccagctgcagtggtgggctccacacacctggacgcaccacacgcctttccctacacagtcatgcagcccattccatgctcttgagctcatgggtgtgatctcctccattgcctggagccctgggtgagccacgggtgctgaggtgcaggtctccccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggtgggcctctgttccgagggagcgtggcaggggactggggtggcccggctgagacacccatccagggcttgcttgggtccctgcccgctccaacacacagcctctcttctgcaccccccacctgtatctcctggctaggacagcccagggtggtgtctctgggcactgcccgccaaccctgcagccctctgtggtcctgcaccagtgctttccttctctgtctgacaggcatgatgtctcagggccagaggccggtcacacccatccctgatgtccagtcctccaaaggggggaacttggccgccagtgcaaagaagaagcacggtagcaccccgccaggtaggggccaacccagcccagcctcagctcctcctccgaccaggtggctgctcctgcagaggaggggttccctgacctgccctcacttgggcgtcctgggactgccaggtgggcggcgagtggggctgttacagcgcagtttcctctgtctggtcaccatgcctctcagctgcagcccctgctggggatgggaagggccattgttgggagtctgttcctgggaccccggggctggaccagggcagtctttgtcctcacactgcatttgcctgctccccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggtaaggtccccggcccgccctccatccgcagccccgccctccatccgcagccccgccccccactgtgtccacgccttccactgtgaccccgccctcccgccgcagccagccctccaagctgtgaccccgccctccagccgcagccccgccctccctgctgtgccccgcactccagcgtgtgctccgccctccaaccacgtgctccggcctctgcagggcggccctgtcgctccacccgcgggctcaggactagagacacaacagtgagggaagggacggaggcagcgctgagggcagtacagccacatgggccggccactgcccttgcacacatcagccgcctgctccgtggcgtcatcccggctccagtccagcttccccactctctgaagtgcaagctgatctgccaccccgttgcacagagccctgtccccggg

SEQ ID NO: 51169 - DNA, 1049 bp, Homo sapiens
ggcaatgccagggctccctggttcaccagctagccggcctacatgggctaggcgctctgcaccctgcctcccctgccccggtcctctgctcctggctgttatcccagctttttgttgcagcaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagtgagtgatgggctgaccccggagcagcctgtgctcgccctttcccctgggctggtctcctgggtcgattcccaggtgggcggagggctcttcagcctcactgaggtctcggctaatgctttgcatacactttcttcgtggggcctcttctcaggttttagtgaccagagtttgggtcgcttgagtgctggcagtgtcccccagtcacttgcagggggactccaggccggtggcttcacctcttgggggtcccttgggtctctctgtaaatgggtgcttggccaccagcttccagccccactgcagagcagagagagccctcatggaggcgggtctgacccagcctgcctttcctcgtgccctgctgcaggaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggtaggtttccccggccatcatggcagcttctccatgaccgccatggtaggtgcctgtggccgccatggtaggtccctgtggccgctgtgataggttctcctggccattgtggcgatttctgtggctgtcatggtaggtttccctggccatcatggaaggttgcctgtggccactctggtaggtgctggggaacttaccgtggaacccgctgctgtggtagggctggtgcggctgtgagccctg

SEQ ID NO: 51170 - DNA, 1128 bp, Homo sapiens
ggtactcaagaggaggcagtgaacaggaccaaggtggtgatgacaacctgggctcagagtcagagaattcaacagtcgggaaatttccctgataggagaagtacagggctgccatgggaggacactgtgggagcacttcagccaggctgggagtcagggagggcttcctagaggaagaggtgttccatccaagaactggagaagagttaggaagacagacaggagtgggaagagtgttccaggcagaaggaattgcatgtgcaaaggcctgtagtgtggactctggtggcccaggatctggggcgtgtctgaaccgctgcctcccctgcagcccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggaggtgggcaggcggggcaggcggccaggaggggtggctggtcctggccaagggcaggtggtctcacggcatcggcctctctctccagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaaggtgagggctcgctatccttggaaggacggtaggaaggcccccggtctagttcagggaccacgggtgccgtgcactcctttggggtccctcagcctgggagggctaccgaggccggcaggctctgaggggcttgtcctagaggctgagttacagccatgtcagttttctggggctcctgtaacaaagtgtcacaaatggagtggcttcaaacagcagaaatgtattcggtcacagttctggaggctggaggttggaaatcaaggtgagggcagggccacgtgcctctgaaagccctaggggagaacccttccttcctcct

SEQ ID NO: 51171 - DNA, 1070 bp, Homo sapiens
caacctccgcctcccaggttcaagcgattctcctgcctcagcctcctgagtagctgggattgcaggcatgtaccaccatgcccagctaattttgtatttttttttcagtagagaaagtgtttctccaagttggtcaggctagtcttgagctcccaaccttaggtgatctgcccgcctcggcctcccaaagtgctgggatttcaagcgtgagtcaccgcgcccagcctcaaggcattttcttacagtctccctggttctatcctttctggcattcccagttcacagacgatgaagctgaggtttagctcgctacagtgacttggccaagtctcaggcttgcaaggggcagagcctccctggggagcccgggactcactggcaggccacgtaggattaaccgtgggtccctcaacttcatcctcggtaggtttgtggggtttgctctctagcagctgaaggccacccagggccccttcctccggccagccccagcctctgtccgtggtgctgaagttcatggcggcctctcttgtccttacctttgctggggtgagggctcagggagagcgtgtctctcagatctcctgaagggcggtctcttgaagctggccaaactctgacaccctcaacgggacgtggacatcactgtctcatctccacctccccaaaggaccgaggccgagcttgggagccgtggctccagggcccagcatctcctccagccttgagagcaggctcccagccagtggctgtgtcagtattcccggaaacacccgggttccggaaaagcaaagagcacagaggccctgctgcctggcagctggcagcgccgctgactctggaggcttaatgggctaagaggtttgggagcagggaggctggtgggcaggggagagggagcggggcttccaggagaggagggaagtgcaggcagcctgttggaaggggtgcttcccagctggatgtcagagggggcccccacctcccctgtcagtgaccgtctccccctccacgaactgttggatgtgactgtttggagccactctcctgggaaaaggcaggtcatcccc

SEQ ID NO: 51172 - DNA, 1044 bp, Homo sapiens
gacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtacgaggctttgttttttttaaggactggcatgtgaagaaaagctttgtcctcacgaattagttgctgtaccaacagttacgttggtctttattaggcttagaagaaaagatgtcctttatttccacttttcttcccttagttgtgctgttttgccgcagtgagattcaggggttggctgtcactgaactctgtgtagaatttctccagatccagagtctggggatcaactttgccagcaaatgccgttttctgatggggaataggtagtgtcaacttgaattccatcacaaccatgacaccagctgcgcccaaag

SEQ ID NO: 51173 - DNA, 2305 bp, Homo sapiens
acaaaaattagctggacatggtgttatacacctgtaatcccagctacatgggagactgaggcatgagaattgcttgaatcctggaggcagaggttgcagtgagcctgggccacagaaggagattctgtctaaaaaaataaataaaagagtttttaaatgatccctgttgtggtgagtgtttagctctcacctggctaaagcagcaattgggcaggctgactgaaaggctttgtgctctctgggcgtgagcgcagtggcagggtggcattctgtccctgtgtgttgggtggtgagcaggagcgagtgtgtgcacacccctaagaagcagtcctcatcatccagacaacctcaaaagggggtttgactccgtgaggtgatgtgtgcgcagcgcttacagctctttggaaacccactattttctgcataaaaggtattgaggttgcgtacttaactgtaaatttctatcatgttatctttctccagtggtcactaaaaaccatgttataggtgtttgctgcattttcatggacaactggtacatctacttatctacttatctgctcttgttttttttttttgtttttttttttttgagatggagtcttgctctgtcgcccaggctggagtgcaatggcgccatctcggctcactgcagcctctgcctcccgggttcaagcgattctcttacctcagcctcctgactagctgggactacaggcgcccagcacgacgtctggctaattttttgtatttttagtagagatagggttgcatcgtgttagccaggatggtctccgtttcctgacctcatgatccgcctgcctcagccctccaaaatgctgggattacaggtgtgagccagtgcccctggcctagttttttttcttttttctttttttggaggcagtcttgctctgtcacccaggctggaatacagtggtacaatcttagctcactacaccctccgcctcctggattcaagggatcctcatgcctcagcctcccgagtagctgggattacaggcgtgcaccaccacgcccagctaatttttttatttttagtagagatggggtttcaccatgttgttcaggctggtctcgaactcctgacctcaagtgatctgcctgccttggcctcccaaagcgctgggattacaggcctgagccaccatgctgaggctattctaattgttactgccgatgtcgatggtacgtggctgataactcagagccttggctgggtgtatttgccttacctttgccatttttgaggcttgggaaaacaccttgaattgtaatgattttgagtgctgggttttataaatgttaaaatgttttagaatgcaagcaccaactgtctagtggagttcttgtgtcctttctctgcaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagct

SEQ ID NO: 51174 - DNA, 1094 bp, Homo sapiens
ggagttggagaccagcatgaccaacgtggagaaaccccgtctctactaaaaatacaaaattagctgggcctggtggcgaatgcctgtaatcccagctacttgggaggcggagcaggagaatcacttgaacctgggaggcggaggttgcagtgagccgagatcgcgccattgcactccagcctgggcaacaagagctaaactccatctcaaaaaaaaaaaaaaaaaattgtaaagtcagctggggccaggtgggatggctcatgcccgtaatcctagcactttgagaggctgaggtgggaggatcacttgagtctgggaggtcgagacttgagcttgggaggttgagactgcagtgagctgtgattgcgctggtgagactctgtctccaaaaccaaaacaaaaaatgatattagttcagtgttgggagacagataaaatattctgttgagacagatgaacttgtcacttcattggtcaatttaatgatttctacaggagcagtttttgcaagaaaggatcaaagtgaacggaaaagctgggaaccttggtggaggggtggtgaccatcgaaaggagcaagagcaagatcaccgtgacatccgaggtgcctttctccaaaaggtacaggagggaagtgtgtgtgtggcctgcgtgcacccagtgcccagcccgccttttccctgcatgggagtgggggcacccgcagagtgattggtttgcatctgttaatttctggaactatgctcagtgcaggaggcagtggatgaatgctattatggttgttaacaatagtcaacttttggtggttttaaaattttgtctttcacaggctaaagtgttttatttttttttgagctggagtctcactccatcgcccaggctgttgtgcaatggcgcgatctcggctcactgcagcctccgcctcctgggttcaagcagttgtcctgcctcagcctcctgagtagctgagactacaggcacctgccaccatgcccggataatttttgtatttttagtagaaacgggggtttcaccatgttggccaggctgctctcaaattcctcccctcaagtgatccacccgccttggcttccc

SEQ ID NO: 51175 - DNA, 2887 bp, Homo sapiens
ggaagccatagtggtctggcattgggacctctgaacgaaatttcccggtggctacaaggaattttcccacttccccaaattagtagattcgatttccatcccactagctggtaatttacagtatagtgaatttccttatttcttttttcttcccaagactttcaaaaagtaaagccaacccctttatttatctttgggctcgtccagtctggcttcccccctccgatcgttcgcagtgggacagcccgccgggcctccttccttccccagaaaccctccaggcctgggagaggacgcgttttgcattcaggaaaaaccaatcgctcccctatcgtacataaccaagagaaaaggtggcggacgaggggcgtggcaaagtgattagtgcggcctggaccctgcgtgccttgcgcgctgcgggctctttgcgtctgcgtagttcgctcacctccctttctaactccgctgccgccatggctcctgtggttagtatggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgaggctcgtgagggagatccgggaggtctcggaggcccggggccccagctaggggctagcggggagctggagcctggagactgcggtctgggccggccactggtcctcggaccccggccgggggcctgattacctgggtggagggcggggaagaagaacgggacctgctaccctggggagccgcgcattcggaagtccacggccaagactcggggacgaatccgcggaagggcggcttggtcggcgtgctttcggagaggaggcctgggtttgaggagctttttagcgtccccagaggaaattagtttatcagggcgcactgtacagacccaaacgggtgttgcagtggtgtagggagaaggctctcattgcattctcctttagctatgctgggactgggctgtgcggcgccctcctcctaggttatttgagaaagttgtttttccgtgttcttcgtcccaagatcctacttttcctcttttgttgggactccctggttaacatttccggttcttctgctctttctgtctggttgggcttttgaatgccttttggtttaaaaccttgatggagaagtatcaagcccgttgtgggtaggtctcttgattgattgtgtgtgttcggaatagatcttaaagtacccctcttagattattactgcgaagagacgttgtaaaaaataaatcagtgatttttgtagtggccaaatgtttgaaaagttgatccagttaacacaagttttagatgaagttcttttaaacatgaagggaggtaagatgtgtttttggaaaagtctatttagttctgcagagcttttaaacgtgaaagtacaggttggtacgatgcacaagtgcattaatggtgtcaagtttgtagagagataagattaacacaagcttcttcgtaagagtgaagaaactggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttagaaaaagcttgtggtgaaggggggcaaaaaaaagaagcaagttctgaagttcactcttgattgcacccaccctgtagaagatggaatcatggatgctgccaattttgtaagttacatccttattgccactcgggtggtcacgaacattttgagatactgttgagaaaacctactggggtacatttctgttttcaggcttataggcagcttcacaggtctggctgtatcatctcaccctgggaatgtgggcagattacttgtttgtttccaagtcttgtttcttcttgtgtgtgcaacagttgtgaggagtaaaaggagatgggcttagaataagcaagaagggctctagcacagaggtgttagaggactatcttgtttttctcctttagtttccacaaatgattttacttaaaagttacccagaaacaagccaggcacggtggctcacgcccgtaatcccaacactttaggaggctgaggcgggcagatcatgaggtcaggagttcgagaccagtctggccaacatagtgaaaccccgtctccactaaaaatacaaaaaaattagctgggtgtggtggtgtgcacctgtaatcccagc

SEQ ID NO: 51176 - DNA, 1232 bp, Homo sapiens
ccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcag

SEQ ID NO: 51177 - DNA, 1056 bp, Homo sapiens
gcctcagtctcccaaagtgctgggattacaggcgtgagccatcgcgcctggccgccttatttcttgaaactgtttcttgattctttactcttggtcctagaaaaacttggccaaagaatgtgaatagatcttggaaaattcacgaagtgtttgggaaaagtctccaagtctttgggcaaatccagagatctctcaggcatcccatcagcaatgcatggtccttggtgactctggtgacccctaacggtataggtggggcaaatgatcacatagcatttacaatttttgtttctgaaacatgtaaaaccgccacattaacaatcaccttccctgggaacaaattagttatgactgaataatgtaatttgccataaatgcttgcttcctgtatatgtgtgtgcactagaaccaaagggttttccatacctttttgcccatagattttttttacattgtgctccagcacttgtgtgtgtatgaaaggaacatgtctttcctgatataatacttacacttactgtttacaaaatcctgttttctatcttattatttcaatactgttcataatgtactaaatgatttcatggcttagtaacaggctgcagcctgctatagagaactcccactgtagggtatccccagcaagctatgccagatgtgagggtacaggccccggagtcactgactgggccagtcctgattctgacattcactgcttggcctccttctcctctcatgttaaagtgggggcagctagacatagtggcacatgcctgtagttccccctactctggaagctgaggcaggaggatggcttgaggccaagagttcaagtccagcctgggcaatatagtgagaccctgtctttaaaaaataataaaattttaaaaaaaacaaagtggggatagtagcgtgccctcaaaggtttgccatgagagttgaacagggtaatgattgtaaagggcttagcatggcgctgggaacatagtaagtgctcaataagagaaggtgtgagaggtcaggacatgagcctggctctccgggtggctgtattgg

SEQ ID NO: 51178 - DNA, 1013 bp, Homo sapiens
cagcactttaggaggccgaggtgggcagatcacgaggtcaggagttcaagaccagcctggccaagccaggagttcgagaccagccttgccaacatagcgaaaccctgtctctactaaaaatacaaaaatgaactgggcgtggtggtgggcacctgtagtctgagctacttgagaggctgaggcaggagaatcgcttgaacctgggaggcggaggttgcagtgagctgagatcacgcagttgcattccagcctgggcgacacagcgagactctgtctcaaacaaaacaaaacaaaacaccagaaacaaaaacagccccttaaaaactccactttttgcaaacctgaggtagtagatgctgcagatgggtacctgtgtccactctcagacaggtgagaacagggcctcatagacttagggacagctcaggagacccagatgtgcacttatggttaacttggttctcttgtcccaacttaactctctttttgtctttaaataggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccaggttcgtgtgccttatgtccccctctggaggggaaaagggtggctcccattcaggctgaggacagtgacattgattcacctttcaggtctaatctcccccaagcgattttccgcagacctctatcctcactaagctatttataaaggatgagctccgctcatgaattctgcctctggatattgactcgaggacgtgctgaccttttgctttaaagtttgcatcacatagtgcaccatctaatttgaagccccaaccttgagtagttgtgattctaattttataatcagatgatatttagacgtttcatgtaagagtttactggccgggcacggtggcgaacgcc

SEQ ID NO: 51179 - DNA, 1027 bp, Homo sapiens
aaggccccgcagtgacgtgggtggggctgggcgcacaggcccgggtgccctgacctcataaactaggcttaagcagttttcctacagccctgaatagtaatcacgaataataataataatgacagctaaaatgtaggtagcagttagtcttaagtgttttacgtgggtaatccttactgcagtcctaaaaggtaggtactgttatcccctggctgtagatggggaagcaagctcagagaggttaaataatttgggaggccacacagccagagagcggtgggtgcagaatttgaacccaggtcgcccacttctccctttcaacctcagcaaatcggctctatctgcttgcctgtgggttgcctattccgggaaggtcagcagcccagatctgtactctgaggactgtgaatgactgagcttctcttgggttcctttcagatagccatccgagcttgtttcctggggtttgtgttcggctgcggcacgctgctaagttttagccagtcttcttggagtcactttggctggtaagaattccttcggaaatactggttttcaggcgagggtggacagatcagagggtctgtagcggcatttcctcatccctgtctcatctgtgaccggcagaaggctgttcagggttctctggaaacgaagtctcctggcttccccctagttgctcacatttcagcccttgtgatttcgtgcctgtgggttgattgtgaatcaggcagaaacagatctccctggcacccccaaaggtgctgtcatccgcagctgtggtgacagcattccgtaacttgagcagcccttcccggaaggggtgcaggtcctcggtggcgggcaggggcagggctctggcttgtcttcatgggcctttttcatctctaatttctattaggtcacatctagtgcatccccacagccactgtaggatttttccctacactatgatttcagtcccttgagccttctagtctgacctggatatgaaccagtggcttcaaggtaaaaagttttatctcct

SEQ ID NO: 51180 - DNA, 1081 bp, Homo sapiens
ccactcagtggtggctgcactgctcgtaaatctgattaactatggtcttgccaagggaagctgtgctttataacagcacttccaggcccacgagcactatgacaatctgagtgtcttgctgcccgcagaacagctgttgcctcagaggcattccctgtttccccttccttactgcccccatgtctctgtcctccctcgaattccagggtgggctcagctccctcttccgagcctggccatcccaagcccaggcttctgccacttccgagtattgtgtttgagactcatacagctccattctgcctggaatttgtgaaactctgggctatgagttctgcttactttgtcgacatgttagacgttcttcactaaatggggcatttccgtcgtcgctgtctacgtgctgaaaagtccacacccttaagcccagtctttctttctttatgtgctgaaaggcatcagtgagatgccaggagtgggagaagtcactggagaagccccttggaagtccgcagcatgtcatgttcatttacggtgtctaagctgcttcactgatacaggcacatgttaagatgtgtattaggaataatggctttacaataatgcctattttagtagggattttctgcccacaatttgtaaaaaaatctaataattttaccaagcttaaccttctctcttttttttttttttttttttttttttagacagagtctcactctgtcgcccacccaggctggagtgtagtggcgtgatctcggctcactgcaagctctgcctcccgggttcacaccattctcctgcctcagcctcccaagtagctgggactacaggtgcccgccaccacgcccagataattttttgtatttttagtagagacgggttttcagcatgttagccaggatggtctcgatctcctgaccccgtgatctgcccgcctcggcctcccaaagtgctgggattacaggcatgagccaccgtgcccagccttaaccttctcttatagggcctggtaactcaccacgagtgaatgaataaaataaacaccacattgaaaacacgaactgtgattttatcgtat

SEQ ID NO: 51181 - DNA, 1042 bp, Homo sapiens
cgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagtgagtaggggcaggttgaggggcgtggggcggcgctagccctgaaaggggagggaaatctagacaccgccccctccccagctgtcactgcccgggtccttcctcttctacatggtcttccggccacccctaccccattgagtacttgaccctaagagagggctctgggttgcttgaggtcctgccaaagcacgaccgggctgcacggcctggggcaagtcccttccccaatctgggcctgcctcccaccccctagctgtgtggcctgggcaagtcccctcccctctctgggcctcctcccaccagctagaaagggcctcccagctctggcgctggtgtttcccatgagctggtgctggtgtttctgatgagctggtactggagggacactcgaagtagaaccagcttcagagaggccccgcagctagccacccttccccctgcccgtctatcctgagcctctcttcctctctccacgtctttctcttgtccttccaagcagcacagacctgaagtcttcttagatatgccaggaactcttcctagccagtttctgccaggggccctgggccagccaaggcgtggctatgggggcaaagctgtgacccaccgtgtttccccctccctccccggtgacttccctaggcaaccttttttaagagctagactggtgcaggattcctgggctgcttttctgtagggtgggacagtgtcc

SEQ ID NO: 51182 - DNA, 1037 bp, Homo sapiens
ctgtcgcccaggctggagtgcagtggtgcgatctcgactcactgcaaccttcgcctcccaggttcaaatgattctcctgcctcagcctcccaggtagctgggattacaggcgcctgccaccacgcccagctaatttttttgtatttttattagagacggggtttcactatgttggccagagctgggattacaggcatgaaccaccgtgcccggccattttctttagggaaagcagggtggtacaaccctgtttggggcttgtcccagtctccacacacacccccaccagcttgtccttggaagtgagacagcagcctttctcagactctccttcaccggcccagcacctgggatctggttaaaaggcctgttcggatttaggaggtctgggcggggctgaggctcgcatttctagccagctcctgggtgaggctgctgatgctgctggtccaaggaccacactgagtagccaagagggctttggtctcagtcttagggacctgggctccattgctgtgctgccgccttccagctgccgatactgagcctcatccagcctcagtttccttctctgtaaggtgggctgatcagcaccagctggcaggatgagttgccttttattcatccaacaactattccccaaatgccatttatttttattttttattttttgagacagggtctcactctgttactgaggctggagtacagtggtgcgatctcgactcactgcaacctccacctcctgggttcaagcgattctcccgcctcagcctcccgagtagctgggactacaaatgcccgccaacaatgccctgctaatttttgtattcttagtagagatggggtttcaccatgttggccaggccggtctcgaactcctggcctcaagtgatccgcctgcctcggcctcccaaagtgctgggattacaggcgtgagccaccacgcctggcccccgagtgccatttatgtgccccacacactgttgtagcctctggagattcatggtgaacatatcaaggcctgctctaaggtg

SEQ ID NO: 51183 - DNA, 1148 bp, Homo sapiens
aatgacaggaacattcttgggtagagtgagaggcctggggagggaagggtctctaggatggagcagatgctgggcagtcttagggagcccctcctggcatgcaccccctcatccctcaggccacccccgtcccttgcaggagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactggtaagtacacacacccacacacgcacccagaagcctggggtcaggatgggtagcccagagtctactcaaccctgatacagaaggggaaactgaggcagggagtgtggggtgcagaggaaccctagaggagctgtaccagcacccaggtccaggaggcttgcctggtggctgaccgcaatctctctgtgtctgtcagcagatgaagctgggatggaggctctgaccccaccaccggtaagaacctcactgtgtgattctgggctgccttctggagctggaagatcaagccttactatgatccctggagcttggcacgcggccagcaccgggtagccctagtggacagaggtgttgggagcagagtcatcagtggatgagaccagcacagtgcctgccctcaaggggtgctcagtcagctggagttcagattcgtacacaggagctaacagttcaatggaaggagagccccatggtgctgggggacaagaggaaggaggcgggggcaggggactcaaggcagaagcaagagttctgctgggctacagtgagagcagggccaactgtgggaggtgtcattgcgggggtgtctgctgactgaaccagggactgtcccctcctggagaggcactgcgggtaaggggccttacttggcaagcagggctgacctggggcccctcttggcttccaggccacccatctgtcacccttggacagcgcccacacccttctagcacctcctgacag

SEQ ID NO: 51184 - DNA, 1477 bp, Homo sapiens
tccatcccaggctggcctgaggccctggaaacccgccctggggtggggccatgggggctggcagggggtcccggccctgaccacccttccctgaccaggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggtatgtggccccatctgcccagggtcaggcagctggctggccatgacccctgaccctgaccagggtatctttccaggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgaggtgagtgcgggccacagtgctgctccctccttgtcccgaaaggaggacagccctcgggaggacccagtgatcagatgttccatgggacgccccaaagaggccactgttaccattagcccactttggagacactgaggctagatgaaaatggtgtgctgcttggctgttttaatggcagaggagggcccagatcttgggtgtcttaactgtgattactcatgtggtgtcaagggtgaccctgctcctcttgggacctccatgtccccattgggaaaatgagagttgcatgcaggttgcttatcctccccggccaccctaaggtgctccaggcctcgtgaatgacccatcctgccctccctctagaagctgacccggcggcagtgccaccagcaggaggcggtgtgggagctgctgcacacggaggcctcctacatcaggaaactgcgggtgatcatcaacgtgagtaggggctgcgctggtccccgtggccaccctgcccccctctttctgacagccctcagctgagtctgagcctttgcagaaggagcaggtgcctggcaatgaggtgggggcaggaaagtcagacaagggctgcgcccagggaggaggtgcctcctagaggaacctgggagggggcttcgggcaggtttgtcaggttcagctgaattagcacaggtgaggcctcattctttcactttcgttcagtggctgtttcccaacacttgctgtgtgctgggtgcccagcaggccacgccctggacgggacagagtgagctggcagtgtagggatttcggctcagggaggggagcacctaccctgggcttggagcttcctggagggaggaagcaccctcagaggtgaaatctggaggctaagccagggcagaggtggagaagggaattccaggca

SEQ ID NO: 51185 - DNA, 1287 bp, Homo sapiens
atcagacattcaggaccagatgctctggcgccttcctcaagtaaggctgatgggcagacctcttcccacgcctgtggctgtcctgactccgggaagaggccacccagcctgggccagcctccagggtgcttgggatcctagcccacaccagaccaggtaccgttcgatgtgactcccgtgttggccaccagagggcgcacagccctatgcgggcctggccgggttgaatccacgcgggttacctgtcacctggggtgagccaagggcggggaggccacaggcccactcgccgcccacgctggcgagggccacccacacctccagcctctgccctcctcgcttccctgcagggaccggaagagcacaggcctgaaactctccaagaagaaagcaaggaggagacacacggatgtgaggagccccccagagccggcagatgcgggttccctacagcctgcgcccttccccgagcctgggccttcctccgggatgggggtggggaggtctgcatcccagggtgcagaggtctgggagatcgctggggttccctttcttgctggggttcccatccgagaccggagggtggggagggtggggaggagggttgggaaggagggtgggaaggagggtggggaggagggttgggaaggagggtgggaaggagggtggggaggagggcgggaatgagggcggtgaggagaagctcacagcccccacccccaccatcctcccaggacccaagcaaggaatgcttcactctgaaatttgacctgaatgtggacattgagacagagatcgtcccagccatgaagaagaagtcactggggtagggcttgatggggctcagggtggaagtgggactgggagtaggggtggccccatgttgcaggctccgggtctctgcaggtgtgacgtgtgtgtctgtgtggtggcccgtgagcgagcgcatccctgcgtgggcagacccgtgctggtgtgcacgccagtgtgagggagtgcggtggggtctgtgtacttgtgcattttaatcatgtatgcaggagccaggcctgcgtgtgggcaggcgtgtgacaggtctgccgtggtatgcagatgcgcctgtgtgagcacctctgcgggcaggtgtctgtggacctgcgtgtgatcccatgcgggcttcccttttccgttgggaaggtgggggcagctggggctgtgggtggggcgggggctcgtgggggcggggcccaagctgaagcgactggccgcctggttctaacacacatgcctcctgtcctgggggcaggg

SEQ ID NO: 51186 - DNA, 1055 bp, Homo sapiens
cctaaggaacagtcccccacccttgctgagtacccaggcagcagcctcactcagggatggccagggcccaggcactcaggtgacctctggtgatccgccctgacccagccctggtggtctccacttgatgcaacctggttaccccacaccggtgggctccccacaagctggctttgggatctgccgtgtcttcaggaaggcaatctccagggccctgttgcccaaaccaacattcagctgtcttcaggccccacgcctgccctgtgcctgaggcacccatttccctacgtagcagcagctggtgactttggggcaagtcagttgacacaggccttagtttctctatctgttaaatggggattgtaacagtatctcctcctaagagtctttgagaagagcgaatgggattcactgcctggaactcccacgatggggtggcacatggaatgctcagtgaaatgcagttatctgcctacaggacagtatgggggtggaggtctggggcaagaccacccgatttgaagtaggaactcacctgcccagggccagcaggcccaaggtcatggatactaggaggaggaagagaccttcggtctggcagtggggaaggctctgttgactgtcggccacaggaagggatatcctggccgagccctttcctgtccccatgtccttctgtggcatgaaggcccttctgccttcatctgttcactgatctcatccccaccaagcgcacctactgtgcaccaggactgttctaagtgccgaggacacagtgagatgcagacggccaaggcgctggcttctggagaggacagtctggtagggaagaatgatgataaaaaagtgaacaaagaaatgaattacaggtagtaataaacactaagaaggaaataatttaacttaaaggaattgagagtgggagggtaagggtggtttattttaagatgagggaaaaggacgtcttagaggtaacatttaagttggggcccggtgtcagctgtttcaagatagggtgcgtggaattccagacagaaaatacagaggagaaggcc

SEQ ID NO: 51187 - DNA, 1052 bp, Homo sapiens
attttacagatgtggaatcgggaagtgtcacggccgaggctgcccagcttgggaggcagaagcctaaccctgaaccaagccctcccctgccgggggctgccctcagaaaacccctgcagtgggaaggggtcatccagggtggttgaggggagaaaggatgttcaggggcccgtggagcccccagcctgtgagcttaggcaggaaaagtgccccagagcctacgtctcccgagtggccgtggcttcctggcgtgggggtcgatggccgggtcctgccacctgtttctcttcctcttttggccccttactcagcgagaccttgcgggggtggaccctgcttgggtcctccctcacttggcacttccgctctcaaggaaacagctgtagtttgcagaggactcgccccctccccatgtccaaggccattgccaggaacgggatgaagcgggcccttgtctttagcccctgtccctctgcctgtcctggttccagccccaggccaggggatgctcactggagcacagaaggaaccagaggtgggacgagaggcaaatcttagggtctccgggcccagggccacagctcccagccccaggggcagcccgcgtgagggcacaaaccaattgtctctgctcccctgggatcttcctgtccagaggccgtgaggcttccaggggactgagtcccccgagataggtctggggctgtgggagagcagccctccagctgagggcccgcctgcctctctcgggcctctagctccctgtctgtacccagcagtgacttcgagaggcgctacaggtgggtgaggagggccaggcctagagcggggtgggcagtgcggccagcagtgtgtgtaccgctctggggctcagccctggctctccctcttcctagctctgtgtggccctgggcaagttgcctgtcatggcctcagcttctccatctctgtggtggggacagtagcacctgctattggggatgaagtgtggattggagatgatgtgtgaatagtgcttgctcagtatggcattgggccatggtaagtggaga

SEQ ID NO: 51188 - DNA, 1867 bp, Homo sapiens
tttatacagactttgcattcagaataactccaagaaataggtaactaaccctcatttggctgaagaattatttttccttccgtcgaaaaagacctgccattctcaattcctctaaaggcctgagtcctctaagatcttcaggtccctgtcacagctgtgcatgcacaaagacgaaccagttgttttctgaactgttatgttcccagtggaaatatccagaagtgtcccctacctctggctgccagcaactttgacttaaaggagagtctttacacttcctgtttttccagttggggtccgtcaagggggggcagtgttggaaagcccagtactctgtgaaaatgtgacctctgtgatgacaggtgtgggaggtggccgttgagggttaaatgtctacttaccttgttgtgatttgcctttcagagagtcacataacaaaattcttcgagatctgtccatcttgagttaccttagccagctgcagcccccgatgcccaaaccactttctcctttacatagcctgacaccctatcaggtaatctgaacttacaggagaaattgtcttcattttgttacacacttgtgtggttttctgtgtgctgggcgctctcctaaccactacataactcctcgctcatttaatcctcagaacatcccagtgacacagcttgtgtcgttattcccactttacagatggggaacctgaggtgtagagaggctgagggactcagcactaggggctgggctggcatgcaggcccaggcagttcagctccagtgactgctcttagccatggttctgtactgaggataagtgtgggtccgtgctgggtttgaatgtcccatctggtcgcaggggctgctccagcacttccacttttccgctgtagagcaggggtgctactgggcctcagagagtgaacgtgtggattcagggagcgttcacagtggaacctggcacccagagaacactcttaaagtacttcacattagccgggcgtggtggctcacacctgtaatcccagcactttgggaggccaaggcgggcagatcacgaggtcaggagatcgagaccatcctggctaacacagtgaaaccccctctctattaaaaatacaaaaaattagccaggcatggtggcacgtgcctatagtcccagctactcaggaggctgaggcaggagaatcgcttgaacccaggaggcggaggttgcagtgatctgagatcatgacactgcactccagcctgggtgacagagcgagatgccgacttaaaagaaaaaaaaaagaagtacttcacattactgtcatcaaaagtagattccaccaccagagtatttgcaacttggaatccaggctgctaataattgttttgggaggaaagcatgatagtgttaggattcgggatgatgaaaaaacaaaactagcggcaggtagcacttctgaaatgcttactctgtgcagtactctgttctaagcctgtgtaactccactacttaccgtggtcctgttattatccccattttacagatggtaaaagcaaggccagggactgggagtcagcttgcccaaaatggtgtagtcaaagttgaggctaggactgaagccgcaggacgcccgactctgagcccaggtctgtgctctgccgcacagcatgtccggttttgagcgcttgctctgtgccaggcactctgcgaagcatggaggggctcagtgacttcatggccaccctgtgagagaaaggctaagacgtgcttcatttacagctttgagcattgggcattgtcaggtggaagcatttgccttaggtcacataggctgaagcggcagacctgggcagcaaggatatgtttcttgggcccgatggtg

SEQ ID NO: 51189 - DNA, 1024 bp, Homo sapiens
gaaagaaaattagaggctatatgtgaagggcctcttagaacagagtcattgctgtattgctataagacacacatggctattcattgccctttcattgggatagaagccctgtgagggtggggatgtttgtctgttttgtttacagatatgtcccaaatcactggaacaagcccagcagttagcagatttgtgtgttcgctgaatgaatggccatgttaggacataattggcattagccatttatgtgaaagtgagcatgtctttgtgttaagttgaaagcttagatttccaaaaaatggaattagagtgttcctgtaggtaggatggtctcagatttcctaaggttctttgtcagtgataacggctgaaacaaaaccctcaccaccttttaagtagccaggattgatcactcaccttactcatctgattactcatctttatctttttaggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcaggtaagcctgcatgtgcacatctgcaagggaaggacaggcagtgtgagtactgttggtttcagacattcacgttaaagcccagtgttttgttttttgtttttaattgaggcagggtctcactctgtcgcccaggctggagtgcaatggcgtgatctcggctcactgcatcctctgcctcccaggctcaaacaatcctcccacctcagcttccagagtagctgggaccacaggcgtgtgccactctgcccagctaatttttgtagttttagtaaagatggggttttgccatgttggccatgctgatcttgaacttctggcctcaagtgatccgcccaccttggcctgtcaaggcatgctgggattacaaacatgagccactgtgcccagccgaagtccaacgtattgatggtttc

SEQ ID NO: 51190 - DNA, 1069 bp, Homo sapiens
tagccgggcgtggtggcacatgcctgtaatcccagctacttgggaggctgaggcaggagaattgctcaagcccgggagacggaggttatagtgagccaagatcgcgccactgcactccaacctgggcgacagagcaggactccatctcaaaaaaaaaattcagctgggctcagtgcctcaggcctataatcccagcactttgggggaccgaggtgggcagatcacgaacgagatcaggagatcgagaccatcctggctaacatggtgaaaccctgtctctactaaaaatacaaaaattagccgggcatggtggtgggtgcctgtagtcccagctactccggaggctgaggcaggagaatggcatgaacccaggaggtggagcttgcagtgagccgagattgtgcactgcagcccagcctgggcaacagcgtgagactccatcgtaaaaaaaaaaaaaaaatctgaaagagcaagttgttatccgtgttacaaatggacattgtgaccatgcctgcactgcgtttctctggactcgtttttaaacagcgattgtcatcttgaggcttcacttctaaagtgctgtgtgtggtggattatgcctgcgtgtcacatgaaatctttactgtgtgattatcctttctactgagtaaagctagttaggattttctttcttttttcttttttaaaaatttgcagtcttccctgcgttgactatttggaatgtgatctgggacagacagaatttacccctcctggttgcatttctttgcttaatattacagaaccagttctgggtatgtattacatatttctcaaatgtcttggttttatgaaattcatatgtgatgatgctaacaaaaactcagaaatcgaagagtataaaatattaaaagggaacatgcgcctaccaaactcatggtctttccataacttgttcctctaacctccaaaaaacaaactatggtgctttctcattttaggaaatggaactgctactcattttgttttatgaaattagttgggtatggtggcaaaaattattttgttttatgtaaattagaaacacatg

SEQ ID NO: 51191 - DNA, 1110 bp, Homo sapiens
ccctccgccgtccgggatcctctcactgtgccgggccagtccgttcgctctcatcccatgtctcctttccccaaacttggatttttctcaccaggcccttcttcacgaccctggccccccatccagcatcccccctggccaatccaatatggcccccggcccccgggaggctgtcagtgtgttccagccctccgcgtgcacccctcaccctgacccaagccctcgtgctgataaatatgattatttgagtagaggccaacttcccgtttctctctcttgactccaggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgaggtactgtgcccagggtgttgggactggggagacaaatagagggaatagacacttttttggtataa

SEQ ID NO: 51192 - DNA, 1060 bp, Homo sapiens
cttgccacacagtaccccacagctatagaacgtggggaccaaagcctcctggacacagaccaggctgcttgaaggaagggccccaccctcctcagacccccaggcgtgctcagctacactaactgggcccaatccttgattctgcccaacaaggccagccccgtgggccctgatcactctactgaactccagaagcttagtaatgaattctatctccagaagccggtatcacctcagctctaaaataggaatactggtgctctaactggccagcgttccccactctaaaatcctgcagtaatgaggaacagaatacagatgtggagagcagccaaggccagaggtttggcccccaaaggaaccccatccaagcctcgctcagctgaggtttcctgacaggaggggaagctgccagctgagctgaggcccacataggaccgggcagggcactactctctcctgaaggcgtgggtgggaaggcagcacttccccaactccaggacacgggaacagactgtcaggctgaaatacgagagtccaaagccacacggtttattgaggggtggggccaagtgggctctggtggccagaatgggctatgtgtcacagtcctcggggacagcagctgtgatgatgagggagggctccaggacacctgggccggtgaagctctcctctgcacacagtctctggccggggagctgggaggccaggccgccctgggccagggactccacaatgacctccgccgagcccacctccagctctgcaggcggctgcagcgccaccaccaccatcttctcgtcctcgatgatcaggttgcggagcttgcgctgccgcgggttgtagttctctacccggtcgtggatctccatgtgcctccgcaggtgggcctggcggggagggtgagctcagaactttgggggatcctagggtaggggaaggggcccaggccctggcctacctgtcgggtaaacttgtagccacactcggtgcactcaaacttcctcacccccttgtgccgtctgacgtgcacacgcagttgctccacggctgcaag

SEQ ID NO: 51193 - DNA, 1055 bp, Homo sapiens
gcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatccatttggagtcattgcctttgtcctcctgctactgtcttctgggactcttgggctgaggacagatgtcaggggaacaggcagcatggagcccagggttcacactgagggtcttaaacagccttccaggccctttctcatctcagattgtagcaagtgatgaagcgttggaaaagacatgccccagaggctgggtgtggtggctcacacctgcaatcccagtgctttgggaggctgaagagggaggatcacttgagcccaggggttcaagaccaccctgagcaatacgggaagaccttgtctccatttaaagagagaggcctgagaagtaaatgctgtggaacagatga

SEQ ID NO: 51194 - DNA, 1062 bp, Homo sapiens
gtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggc

SEQ ID NO: 51195 - DNA, 1132 bp, Homo sapiens
ctcgctggacagtggtcagcgtgtgctttgccttagccacaacatgtggcctgggcttttggggagagggtgtgcgtctggggtgaagcccagtgatgttaattcctcccaaggcagaggcccttgcggaagttcgggagggtgcaggtgggtgactcacctgagtgggctgatcttctgcctgtcatgcgtcctggcaggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcaggtgagttccaggtgccgagccccactgtgtgtttggtgtctcttaccaggccctgtcttaagcacacatcatggctgttctcccttttccacagatgagaaactgaggcctagctggggttggaggctgggtctgtctctttgtttttgttttgttttgtttttgagacggagtctcgctctgtcgcccaggctggagtgctgtggcgcaatctcagctcactgcaagctccaccttccgggttcacgccattctcctgcctcagcctccagagtagctgggactacaggcgcccaccaccatgcctggctaatttttttgtattttttgtagagacggggtttcaccgtgttagccaggatggtcttgatctcctgacctcatgatcggtccgccttggcctcccaaagtgctgggattacgggcgtgagccactgcacccggtctgtttttttttgttttgttttgtttttttaaaagaagagtttcgcttttgttgcccaagctggagtacagtggcgcgatc

SEQ ID NO: 51196 - DNA, 1574 bp, Homo sapiens
gtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgagtgggccaggggctgggcaggctctctggggttgaacctcgccggtacgggagcccagctattcgcgggggaagcgcacagagcctggaatcctaggggcgcacctgagtccaagctggggctctggtgactacatgtctctgggcgatacttttaaccttgaagaagggccccttgtgtgagccgggacaagtagctgcttgtgggtctctgtgccccgtgcggccggggctgccaggctgagccaactccgtgcccaggaggtgcctccccacttggttggaagatactggggcattcaccccgcacaatgggtgctttctttttctccttaaggaatccagggacgggcaggaggccgacgcccggtgaggcatctgttccccacaagccggggaatttctccctccctgctgagccacaccgggccccctgactcactctttgtcacccggtgacaaggttcccttgggcttgcacctaggctctgtgctctggtcacatggtgtttaggctgaactccccggagcctgtaaacatggtcacatgttaagaggttttcttccagttacttggcccaaaccccaaaacactgccgagtcatggtaggcgggtcccagtccgcctgagtttgggcttctacggtttttattaaagataaatcccagttcaaacacgaggctacctcctttgtcggggtgaggaagggcggtctctgtgactgctatataaggaaagaacccaccaggcaggcgtgtgaggcggttatcaggcaaggaggtggggactgggatgtcacagctgctgtgcccagccttgcatgttcgcgagagagcccactctgggacgtgctccgagttccagtggggctctgaggtgtcaggtgggacagttgctggattctgttgccacagcttccttagcctgctgctctgagtccagcctctgctgggttctgccagaatctgtgcctctttccaatccaaggttgtccccaagttgattggggaccgtgtccctcccctcttctgaaagtctgaccagtggctttgagcagataatttcttcccagaactggccacactggccccagctttctgcacacccttccataaatgtcccagcagagcagttaatcccttgggtttaggcaggtggctggttcattcctttcagctgcctttcacacagctccatggaagggaggaggccggcagagctcacttcctaagaacaagaacttgcttttctccctttagagctcagggctgtgaaacagaatgtcttgtccgctctgtcctgtggcgccagcctgggaggccaaggggtacagcccccaggatgcttggggtcccttcatgtcctggggtttctaatagacctggtgtaatttacgattacagccagtaccac

SEQ ID NO: 51197 - DNA, 1065 bp, Homo sapiens
ggccggcgcccttgggaagtctggcgtgaaaggaggggtggctttggtttcagggccgagctcgcctctcccgggttgggttcagcagccgggccgggtgggtcgtgggcaaccccgggaggcccccggtcccggcgcgcggcgaggccgccctcggacctggcacttgtcactcgctgtccccggcccgggcgtcagcggggagacgcagaagggcggagggagggagccggccgcggacagcggtgactcagcctgcggagccgggggcgggcgccgcgcgggggacaggcgagcccgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaagg

SEQ ID NO: 51198 - DNA, 1522 bp, Homo sapiens
gggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgattcaaggttcaggcgattgcgttctgtgctgaaggacaattgtgtttcttttctccttgctacctccccaaagcatgattacatcaagtctctgggaaggcagcgtctcagtgtgcacttagcaggatggaaaatgcccacggtgttaaggtaccttgctggtgaattccttagaaacaaaccacaggacgagtagatgtgaatggtttttgcagtttcttcatcagattgaggattagctcaagc

SEQ ID NO: 51199 - DNA, 1337 bp, Homo sapiens
cctgggagcagagacgccaactagcccttgacccatgattcactcagagcccatgatttgtgccctaaaaggggggctggggccctttcacaggtagaattagagtgagcgcgttggaaactgcggcttgagtggcgggggatgaaagcagacctctacgttccagcagcagttgattttcagcagcgggtgctctgcctcgcctgggcccagccagctgctggtccgggtgactgctgagccccatcagtagaaaggtgcatgggaatggccaccttctgatcacctgcgtctgtcttttcctttacagcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgc

SEQ ID NO: 51200 - DNA, 1051 bp, Homo sapiens
accctctgtctccccagctgggaatccctcactcctttgcactgatcagctatcagcacaaattccaagatgacgatcagactcgtgtgaaaggatccctcaagtaagtcctggcctggctaaaatggaagcacactggtactgcatgcgggtcttcacagtggaaccagttggtgtaagacaccttgctcgtgtgaatatctacgtgtgtgtgacatttttggagagcttcctattttgaggctgtgggggatttaacactacagtcccagcccttgaggagcttagagagtgttgtggaagaactagaccatgggtgtcccaactttcttctgtcatgaatctgctccctgggggtcgaggaggctggagggagggaagggaaggtacctggcctcttctcaaatgacagctgcccctgaagtgatgaatgaggggcacaggcacagaccgcgttctctccctgcagagcaggcttctttgggacggtggtggagtacggagctgagaggaagatctccaggcacagcgttttgggtgcagctgtcagcgttggagttccacagggtgtttctctcaaagtcaagtaagttgaacttaggcctttcgggtcaaggaatgcctgtcaccttcactcaaccaggctttacccaagttaaggctgaaatagcctttgcattgtaattttgttcttaaagacacagttgcttggctaggtgcagtggcttatgcctgtaatcccagcactttaggaggccaaggcggccggatcgcctgaggtcaggagtttgagaccagcctggccaacgtggtgaaaccccatctctactgaaaatacaaaaattagccagacgtggtggcacacgcctataatcccagctatttgggaggccgaggcaggagaattgcttgaacccgaaggcggaggttgcagtgagctgagatggagatcgtgccactgcactccagcctggaggacagtgagactccgtctcaaaaaatataaaaaaaaaaattcagccaggtgccgtggatcacgaggtcaggagat

SEQ ID NO: 51201 - DNA, 1109 bp, Homo sapiens
ccaagcccacactgaaggaatcagcatgccggcgaagaagccaccagccgtgatttgtggatgagccaggtgattccagcgtgcagtatgagcaccactgtcttggactgcttaatatgagaccctccgttggtgattctgacttgcactcctcggcccccatccattctaacttgagtggggttgcatctgctggcataggaatgcagacagtcaggtgcctatttggttgtagctaaagttagggcggctgaggggagtcgggaggttactaggaagattctggctaggaccctccccctctgtgtggatagaggcctgacctcctgcttttttttttactgggagctggcccagggatgcatagacgtgacagtaagtgaggtcttagccaggcagagaggaagtaacagaacagctgagagcaggtgctatccaggacctattctgtctctgtgtctctccagctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcaggtgagccgagcagccatcatctcctgcagacagagctctgggaggacccctcctcccaagcactcagtgctccccttaaatcctgcgtcctgatcaccactaagtctaagcccatacagggccctgaggggcaggctctcggtgctcacactcgagtgacctggtggaaccttcgagtatgaaatgcagttgccttcaggcgcctggggcagctttgttggatcatcttaaagcagaacaacatcttaatgtctggtgggagccacccacggaattgggggcgggcagatgaagccccatagcagaatcatgccctcggacgcccctgtggccacaccagggctggtacatgagaagccccacacgggccactgctccttggctctcaccagccgctgccacctaggagcataggctcagtgtcaccagagttttttatttcttgtgagaag

SEQ ID NO: 51202 - DNA, 1300 bp, Homo sapiens
gaaggtggattaattttaaagtctcccatttgttcataatttgtgctgctttatctttgaaggtatttttatttaaagagttttagggtagttttgtggtataaggttgtttaccaaaaaatgtttaatccatgtagctcatttctaggtggttttgtgcattcttgggtcctgtttggtctctgaaaatcaaactgtctagctcttactcctttgactaacacttttgtctttggcgtgtcattgctctgcagacatgcggaccggctctcctggtcaaatgatgttttctagctctggacgtctgtggtgctctgcagtttggttcggactgtgacattcatgctttgtgggcttcctggtggagtgtcctacctaaacccagtgaaccctgaagtcaaatgacttgttcaattaaagcgagctggctgttgaagtgtagcattgtctttcattccacaaataccacccgttctgctgacggcttgtttttctgccccagggaacgatcagcgttggagtagatgccaccgacctttttgatcgctatgatgaggagtatgaagatgtgtccggcagtagctttccgcagattgaaattaataaaatgcacatatcccagtccattgaggtaaagcacacaaccacctctccgagtacagcaagggctcgagttaatgaggcacagcacaccaagcagctggaatgagagtctgcccagggtttttctcatctttatttatgaaaggatgcaattagccacttaaaaaagaaagcgcttcattcccagccgtgtgttaccgctgtgctggcatgtgagccagcaggagtgtgggctggggcacttggctcccaaggtcttgggcctttccagcagagggtgttaatggtctgggagaagtagaggcccaaggtcatggggttctgggagagaaagcagacctccatggatcattctaacaaccagttttagttttaaggcaaattctgctaggtgccgcaaggctatagcagctctcatcctgagccctgggcacgcgaaaatgtcaccattctgcccactatttggatgtgacgaggtcaggtcattctcctgagcgtttatagtaggtctttgtctcctcagctcattaatttattctccattgcatcagccaacaacgtggagtcctaacttggggaaatttgccccctcttggagctccctgagtcagttgatacagaatacagccatgggaaggtcttcagtccccctggaaccctgatggcaaaccacagagggaaggcacacagtgaagtc

SEQ ID NO: 51203 - DNA, 1041 bp, Homo sapiens
tctttataaaatcataaagtcatctcactgtatacataatagcttgtagtgtttttcactttatagttttaccaaaaagttagattttaatggccagtgaaaatcaggctgcagtgtgtgataaatgtgtacagtcggtgtagtgtcattaccaaatttaactgtattcagatcatttgcatggcggttgtgaagagtagcctgttctttttattgtattctgttatctaaatgggtgcattaattttactgttgtctaaattagccacatagtttgcttgtattgtgttggagacctggggaagagttaaagaaaaaccctaccagtgctagtgaaagtgccacaacagcagacctggcctcatgtttagcttaaagggagactcaggtaaaatagtgaatgaataattccttattaaatgctggagaggaacacaagtttggctcctgtgttttccaggggccagcatttcttcctttcccgttagatttgattatgcatagtatcatttatgtggtttttaaattaggcctacaaatatatgggaactgtcaggggagaagagacccaaaggtcttggcagaaattggtgaagcagagggggaagagaacaaccattggccttgctgacatttgagttcagttgggatatcgttcagttgggatatcgtttgaacagccctcaccgttagctgagaaatccttttctgatgtattttgggtgatgtggccaacaacatgataagagatgtttttgtcttttaaaattatttacaaatagagaggagaagtgcacaaaagaaatgtagcctgtctttggagttaacagaactctatagagtaaataacaaatcagctttttctagtatctgagcctgtttctacttttatagcaagcttctttagaaactggaacccactctttcaagtcagtgtacttttatacaccgtggcagaaatttaccaaattatcttaaaaacaacgttcatgtcctttcccaatgcaggagcccgtgccacttcctgcatggtgcaccttg

SEQ ID NO: 51204 - DNA, 1120 bp, Homo sapiens
ccactgaatgtgctgccttctggaattagaggttgcattcgagtgcacgtgggccttacaagtttgtctttgaatttcaaggattcatgttcgttatgtcattaaattgatgtcatttctgtctaatggtatatagcttttctttgcctgaacctgttctgtttagagtgccttggcatgatttacttcaaataagttaaagagttagcacgtctctgtgacatttttgtttcagctcagagcacactgagccattccagagacccaaacgttcattcattggatagcagcacttcccagcaaaacccagtccctattgatgtatgtaattgatcactttattaactggcaaaaagaagccttgttgaggtgataaaccgaacttcattacatcctgtatgtcgagagcaaacacattgggacgtggctgatgggttcccatttcaaggctgattctgatgatgataatgtttaagtagcattgattgttctctaattgaatttttctttctttaggcctcttctgaagagctgaaagctgcctaccggaggctctgtatgctctaccatccagacaagcacagagacccagagctcaagtcacaggcggaacgactgtttaaccttgttcaccaggcttatgaaggtcagtggagggccggactttgtagaaacatcctggtaacagatattcgatttttaggaggtgcgatttgtagaggatagaaaaagagagtccttagaggtatataaaacaggtggttagtttagtacttttcactgacagggtcctttgaaagaatagtattttgctttggaaatcaatacgtgtccagtaagtagaaaatgagagaccgggcgaggtaatagacagagtctcaattgcaagggaatactcaagttttaaatcgtttaccagttttcttctaaagggaactcttataggtaaaaggctgatcgttacagggaaggtttctttgttctcttttttgttagaagatacaaggacattttttcatccaaaagtgattttattggttctgaagcagttatcggttgtaataaaagaaagaaaatgatgttaagaaggcttataggaaatagaaccaagtgattcaca

SEQ ID NO: 51205 - DNA, 1068 bp, Homo sapiens
tggtataggtggtatattgataagtgtagcaagaaatgcatttaaagttgggaggaaaacaaaacactacagcaagaagaaaaaggagaaaatgcagagatggaaatatggaggcccacctcttctagagaaccttgtatttttatagaaatagaatatacatgcagaaaagtggtcatctcctgagtatacagcacaatgaattttcacaagcaggactgcttcatgaatgaatgtttccgttatccatgcaccagggcggtgccctctgaattgttccagtttcagtactcctgttgccaaaaagataccacaactgaattgtgatgatggtaataacaaaagtggttatggtcctagtatgagctggacattgttaggcactcatgcttgtattatctcaattacgcctcacaaagactcagaaagaagcactattgtccacagtttgcaggtgatgaaacagaaaggggcttaaaggagctataattcctaagtttttgctgtgtgttgggcactgtgtgaagcacttcatagtctctgtctggtttcattctcacactgtccttgcaagggttgtcatccccttttatggaggagaagactaaatgccagaaatctcacttgccatggtcacaaagcttggaagtgacagatcctgcatccaaacatgggccgttgactgccacacctgcattctctactagcagaatggaaggctgtgttgccccagagcgaaccacatgagcatggctggaagacaggcagccagcccctgtttggcagtgccgtccctgaagtctgcaccaaagggaagatgggagaaagagatttgccgcggagtggggtctcaccaattctcagaggccaggagctgctcattcagcaagatccttgaccctattctgacagagtagttcatggaaccttcaaggagctcctactttaaaatggcatgcagcagagttgcctctctccaaaccagcgggaagctctctgtggcctgctttaaagggcaagctgaatggcttgggtctagctagttttttttccccctctgtcacccag

SEQ ID NO: 51206 - DNA, 1165 bp, Homo sapiens
ccaactactcaagaggctgaggcaggagaatggcatgaacccgggaggcggagcttgcagtgagccgagatcatgccactgcactccagcctgggcgacagagcgagactctgtctcaaaaaaaaaaaaaaaaaaaagggactgtattgtgtaaagcctcaggctatatggttggaacctttacaaaatgaaatagggaatttttttttttttaccaagtccagttaagtggttgctttttaatgcctgataagtaagtggcttggtctcttagtataatcagtatctactaaatgacaccaaataatatgtgacaccctttctctccgtagaacagctcttactcagcacaaagcacccatgctgtcttggtgttaattagctctgaaatctgctttttcttttaaagtgcgtaagcaccaactatcataataaacactgcaggtttttatgagctgatgcagtttctttccatcagattattggggaacatatggacagtaatgaatcttcaattgtggtaatcaggcaaacttcccaaaatccagtagaatatagtttgtggagccttcattggtgaaatttagtaatacagatacatcgcctggaagttcgagtttgaaaatacaggctaaagcaacaaaaaacctggtggctttaatattcccaaagtgaatataaatatgaggtgttattaagttgttatttgcatgctctattcagtcttcaaagtatcaaattaaatatcatcatcatggtaggtataagtaccgttcacccaatgtggttggttctttgcttgcccagcacatggtaggactgcacttgctagttagtgtccttgtggtcaagtgagaccttgggactagttctagctggtgatgtcagtggaagtgaggtgtgtcacttctaggtccaagcattgaaatgccagtgtgagccagggagcctgctgtcccctctgccttggtgattggcacaggatgactgctgtgtcatcctgggacctgaagacattgccaaactgtactagctggcctcagatggacatgtaaagtgagagagaaataagccattgaaatttttggattgtttgttactgcagtatcatctagcccagcagttatcaagctttttggtgttaggattcctttacattcttaag

SEQ ID NO: 51207 - DNA, 2351 bp, Homo sapiens
atacaaaaaaattaactgggcgtggtggcgcgcgcctggagtcccagctactcgggaggctgaggcaggagaatcgcttgaacccgggaggtggaggcttcagtgagccgggattgcgccactgcacacacaccaggctgggcgacagagtatgactccgtctcaaaaaaaaaaaaaaaaagcaaagtttccctttctagtacaggaaaagccctagggagtcctggctggatctcaggcccccgaggacgcagccacgccgcgtgccacgcgtccattgggagcacgaagagacacccgcgtggtcaccccgccagggctgcctaggcgccgcgtcccgccctaggccgcgcgggggcgcaaagcgcaggcgcactcccgccgggcgcggacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggtgaggccagcggctggacgctctgggggctgaggccgagcccggtcgttcgggagggccgggctggcggtggccgccccacccccgccacgggaggctcgggtccgtcggggaggccgcgtgaccccggcgacgtgcacgccagccgcccgatggaggcgtccccaccgcccagaccctcccgccgggggttccggggccagcctccgccccagctcctgaaggccagtgcgccgcgtgcactgtgtccgggtagggccagaggcccccgcacgctcaagaggaaacgggggccccgaggaggccaccgtagtggggttagcagtcctccgagaccccgtctcgcgctcagcccacatactcgtcctggctgaggggctgtgtcatcgcccgccgccagcaggatggcgaactgagtctcacccaccaaggtcaaggccactagggaacgtccttagggctttttccggttcccgagtctttcgtggggacgctctgcctctgaagtgggtccagcctcagaggcatgcgtctcatgccctctttcattcccctggacccgatgtccagaaattgcaggcagagcctccgggacacagaccctcggctcggaggctgcagattaggaagaagccctaggccagaaaagtggtgccctaacaacagcttcaacattcacaccaagcacttgtaccctgtctcctcaacgaataaaagataacatgagagagtctcacatagcctggcagtagtagggccccactacactcctttgttcttgactagtctggagttgagataggtgtgaagggcgagaaggcttccagggtcaggtcatgaggtggatcagtttctttaagccgatgggtccagacttttcagccctgccagagaattcctaattccatctctcaggttttccagtggtaatgaaagctagccaagtttggctatgctaaccaaagcgggttcagtgtgtgttgtcagtaaatattagtctatgtgatgttaataatacaaacttatcttgtgtgggaccactatgctgaatgaactttgtactgttatctcatttaattctgaggatagctcttaaggtaagtattatgatagcccttgatttacacttgaggaaaccaaggcatagagagattaagtagtgtgtctaaagtcacactactagaaagtgcaagagcctgaactcaacccaggcagtctgactctggagcccagcttgtgagctccatgctagtctgtcaccttaccttaccagtccttggactacaaagctgctagttctggtactgtatccttgagtgtcacgcgcgtccgtgtgaagagaccaccaaacaggctttgtgtgagcaataaacctttttaatcacctgggtgcgtatgggctgagtccgaaaagagagtcagcaaagggtggtgggattatcattagttcttataggtttgggataggcggtggagttaggagcaattttttgtgggcagggggtggatctcacaaagtacattctcaagagtggggagaatattacaaagtaccttcttaagggcggaatatcacaaagtacattatcacaagggcggggagcgtgtattgtcataaggccaattgaccagttagggtggggcaggagtaaatcaccatggtggaatatcttcagttaaggcaggacctggctattttcacttcttttgtggatcttcagttgcttcaggccatctggatgtatatgtgcaggtcataggggat

SEQ ID NO: 51208 - DNA, 1037 bp, Homo sapiens
cgggggcggggcttcccttcgccgctcccgagttccgggaaccccctttgattggtctggacggcctgggaaacactgtagtgacgcccaatcaaaacgccacgtctcggcctcgaggaaatattccgtgtcgggcccgtcctgattggacagttctttcgggttctggccactaggaagctttgtttaggtccggaaggcgggctttcctgggagtgggtggggagggggcgttgattcttgaccaatcctttcagtccgttgggtggtgaccagccaatgggccggatggataggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggc

SEQ ID NO: 51209 - DNA, 1028 bp, Homo sapiens
ctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtatt

SEQ ID NO: 51210 - DNA, 1174 bp, Homo sapiens
tctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagct

SEQ ID NO: 51211 - DNA, 1052 bp, Homo sapiens
cactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaat

SEQ ID NO: 51212 - DNA, 1349 bp, Homo sapiens
tgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggagg

SEQ ID NO: 51213 - DNA, 1024 bp, Homo sapiens
agtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctg

SEQ ID NO: 51214 - DNA, 1022 bp, Homo sapiens
ctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgt

SEQ ID NO: 51215 - DNA, 1676 bp, Homo sapiens
cattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtcca

SEQ ID NO: 51216 - DNA, 1994 bp, Homo sapiens
gcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaa

SEQ ID NO: 51217 - DNA, 1460 bp, Homo sapiens
atgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagt

SEQ ID NO: 51218 - DNA, 1082 bp, Homo sapiens
tctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgcccttta

SEQ ID NO: 51219 - DNA, 1722 bp, Homo sapiens
gatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgc

SEQ ID NO: 51220 - DNA, 1301 bp, Homo sapiens
ttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcct

SEQ ID NO: 51221 - DNA, 1002 bp, Homo sapiens
tgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcc

SEQ ID NO: 51222 - DNA, 2589 bp, Homo sapiens
accaccaccaccaccaccaccaccacataccctttcctctgcagagtaacttatctttctttcagaaatagtagcaacttgaatttattagtcttagctgccacattatacatcttcagattatattttgtattctgaagtattttggggagaaaaagcttagacttttaattttaatttcatttaaggactagaaaaatacaaagttgcctcattacccaaattcacctttccccactcttttaatattttatttctttaattttaggcataagttaagaacaagcaatttaacatgaccaaaaaatgtacttttgtctctgccaaaacctggtcagccagccctggtagtctcaataccagattgatttctgccatatgcaatttcatgactgtttttcaaacaatgcatttttattgtatttctcttttcagaaaattcttaatctaaagcaaaacaaaccaaaaccgaaagacagaaaccaaacttgagtcagttctttgaactggcaagatactccttagaaatcatgtccttaaaaaaaacatgtgaattctctcagcatggcccactgaagcacagattactttttaagtgtctcattattttattctctaacatttaatgctgatgttttaattgcacacagctgaagctgctaaatgagtactgaaatggatttaagtcctctttgagctttgttgatacctataaaagtttatgtcattcattagaaccacaaattaaaattagtcgtggttagctgttcactggcgattggaactctcacgaacagttttgttcaggctcacgagcttgttcttgcctagtatacttggatgcctgaaaagctgcctttggcctgttgggtatgttttcttttcacagaattgcaaaatatcagagctgagaaatacaaataggtaaaccatcctatgattataaagcccctgtgatttataatgtcccagtagtcaggagcaacttttttgctaaacctggaattttaaggtgattttttttttttttaaataatgcttttcacagttgtgctggcatgtttaccagatccccaaagacttttttgccttaagtatgtcctttatttgttcctttgatgccatgtccttctagcactaaaggaatggcatctggctcagtggatggtacatggaagccatgtggggggccatgactgcttgttgcctccattcctcttgctcaagcagccccaaaccggctgacccctgagggatgagctggttgatggtccccaggagagtcacagctccctgctgttggaatcggctcccctggggctcccatctgcctttgaggtagacagtactttatttgtaagtccagtagcagctgaagagaaattaataggttaagacgagaaaagtttttaattctcttattttacgattagatcagttagattttctttaaagttttctgcttaatacattttaagataacctcatttttctaagagagctagtacatggacacatttatggcttatttccaatgagccttgtttatttggttagcatttaggacatttagtagactgtaagccaatggatgtttttgtaaatgtgattcattgagaaaaaccttcatttgagagtcaggtaacctgctttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaaccccagcagggggactcacaccttacagaaaatcaggttcgaaaccattccccagtagtcttctaacactgacttagagacccttatatgtttagagagaggaaccgaatagtttatggtaattaagctcctctaaaacagatgcaagttcaggtgcataaagttaaatctgggtttttaatctcttaggaagaaaagtttagatcacaaagagctccataaccctttgttgataggttcttttaactgtttttggctatggagggacaaggaaggaaacctgagggacagacccaccttttacctgcttagcctttctc

SEQ ID NO: 51223 - DNA, 2232 bp, Homo sapiens
tttgagatggagtctcgcactgtcacccaggctgagtgcagtggcgcgatctcagctcactgcaacctctgcctcctgggttcaagcgattctcctgcctgagtagctgggattacaggcgcccgcgaccacacctagctaatttttttgtatttttagtagaaacgaggtttcaccatgttggccaggctggtctcgaactttcctgacctcgtgatttgtccactttggcctcccgatgtgctgggattattggtgtgagccactgtgcctggcccagaccttttaatgcaacagcgcccctaacttctgaaggcccctagctggcttcaacaaccgcccctcttcctgccccccatggagggctctgtcatacatgtgtcacttttagggactcttattaccaatggcttccttaatcctggctgcacatccagattcctctgtacagcttttaaaataattcactttttaagaaacacttgccccatcccaagactcttgttctagagagatggataggttcagaaatacaggaagtttattttgtaaacaagaaaacaaataggtccttacattgtgcacatatggatctgtgcttctggagtgtgggccaatgctgttaattctgtagttgactccattgtaaggtaaaatgagttttatgggccagtttagttgttcagccaacaattgttagtactgtttctgtaggaaaagttcctggcatccaccctgtagaataccatcttccatgagtgagcacttgatcaccacagaagccaggtttgaatttagttagagtgaaatgaagtagagggccctgcttgcttgcttgttctttcatttttttttctcttcctctcttttatgggtttatcgttcccttcttttcttctccttcgtagttccctctttccttgttttctctttcttccaccatctggcgtatgtttacaatgtatctgtcatcagactgtgaggtccctgaaatccttcaggtgcctaccacagagttgacgtgcaaatgaatgtttctttattttttaattaattaatttttttttttttgagacggagttttgctcttgtcgcccaggctggagtgcaatggtgtgatcttaactcactgcaaacctccgccttctgggttctaccgattctcctgcctcagcctccaaagtagctgggattacaggcgtgtgccaccgtgcccaactaatttttgtatttttagtacagacaggatttcactatgttggctaggctggtctcgaactcctgacctcaggtgatccacccgcctcggcctcctagagtgctgggattaccgtggtgagctgctgcgcctggccaaatgaacatttcttaatttgtcttagtatctgtctttcaaagaagtaggtactgcccgtcattagcttgaaaattgtcagattttgtttgtgattgtctgtcctaacttaggtggtttatcttgaagatcttaggtaatttagcctcatagatttagatagatcgagaaatggcaggcttcaatcactgaatagtacagaatgttgggcaataagatggatttggaccattcaagggagcacttatgtcaggcttttagcatatctgctgcatagtttttagagctggaaggtctgagatcatctgggttggacccttcatttttggtggtgaggaacccactcctgagagagaaaggtgcttcttcggtgcccgcctccaggccaggacttgcctcctcctcctctgtgtccttagctgagtgagagttgggatggcggagagcagaggcaatgtgaccgcatagctgctgcgattaactgcctgcctctagacatgttggagaaacagtcaaagtaatcatccttctgcgctccccctcccatggaaacaaatgatagaaggttagggcagttttgagggcaagcggcagacttcctcactgtgaaagtcgggaagctttggttgtgccctagaccctgtccttttggccttggcaccaccaagtgggctgctttaggtgtccatcctgatggtgtttaaccctgcttgaggcttttgaggacactaagaaacacatggtgaaggtgtggaaggattttttgtcattcctcaatgaagatctgccctaggtagaaagggagttaatgaaggaaaagtcggcaacgctattgctgcacgatcaggaaataacagaaaacgtctcccatttgttct

SEQ ID NO: 51224 - DNA, 1050 bp, Homo sapiens
ccaaaggagaaaccagaatgacttttgtcactcttttgtaatggtgggaaaaggactggtaggggaaactaccaaggtttgacctgggatctactttacctgctctagttcaccttggagcatctgaccatacataggtccttgcacatagtagatactcagcaaacattaactgtcttttcatttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttgaaaacaaaaaacaaaaacacccacaaagagtgacagaagacgacttctctcatatcttagcacttttccaggaaccgctcccccaaggatccccagcgatttgttctagttccgttgccatcagcaggaagctggatcagtaagggacgtgggcagatggtaaagtccatggcagttcaccatgaccgcttgggcttcacccattccataacccccagtttcttacccctcctcaaaacccttcactttgtcacacatg

SEQ ID NO: 51225 - DNA, 1038 bp, Homo sapiens
tggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataattaaccaaagaattcttctcaaaaattaccctcaaaaatcctacaaaccccactgttaggaagcgagcccattttgaggaagtatttgtgaaccctgtgttcttggatgccttatgtgttgaaggaataattacttgttcattttgtagtgctaaaatcctgggaatgcgcagtctaagcagtctagagcatgtcagtatcccacctttggaaatctcctaggagcatgtagagactctggtttatcattaactgtgttgctttcctatcttttacacaaagtattctccttcccgcaccattgtattcacatgacagaaagctcagttaatgccttttagtaataatgaaagcttactcattacatacattttcttaaactctctttattctaattaaaatgtttccatctgatgaggaagtgtatggataccaagaagtggaaattaagcaagaaattaaaagaacattaatggctttcttgtaatttgttttgaggtttttcttcctgctaaatggtgttttgcttacagagtcacccctc

SEQ ID NO: 51226 - DNA, 2941 bp, Homo sapiens
cactcaagtgggagctccttgggcaagggtgctggtcctcccttatttttgttttccttgagcccaccatctgcacgtggttatgggtggatggatgggggaagtgacagtggggtaacataccttcaagcccaaaatgtaaacttaataagtgttttggaggaagagaagaataaatactgtttttgtttatacaggtcttaaaattttggtagcagaaagcaaatgtgcaaagagcaatggaaaacaagtcagaagctgctgtctgattccagaggaactcgtattttatgttaaaaaaaatgtaattgacatttgattgccttgaaatcttcaatttgttgtgctgatatcttaagtaactaattatttagttgaataactactagggaaataggccataaatgtcactcgtgctttccttgtaagaagcccacagctcttctcgcagcatgctcttttcagtacctgttctaggtacttgtgacttgtgaaagtcactggcctctgcgcattgggcacaggcctgaaggcgatgttttactcacattttgtccactggaattaaacagctgtgctgatattcagttgatttgaggtttgtttggaaatcagtcccaaatttgggaagcaaatgagacagaaccctccacaccctaccacatgcttccagctcatcccatgaaaactcatgagcacagtgtggagtgttttatctacagccactccctttttgacccttcccccaaaatagtgagggagagaaatgaaagaacagatctggggcttgccttcagcttcactgtgcatttttggtcattttggtcattttagaagtcatctttcacttgttaggatgttacattaattgggagatgctagtcgttttgttcatggaaaccagagtatccctttgaagtattatattcttctaatctatgaaactggcccaggaagtaacaatgggaagtgctggaaatggaatttaagaagtccaccttcttagtcctgtgcttaagcagagagtctctagcagggagcctctgcaagcattgtgttctgttgtatcaatatgtacttagatatgttaatctgaattagggagttgattgtacataatgactcccctgggttgctatgttagaagaaaacccaaaacttaagtagtttgctgaatatgcatagtaagtaaaaaaattcttccaaaattagtgttaattgaatctgagccttgatcttctttgaacctttaattttttatttgatcttttaaaaaagttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaacgctgttgaacgaatgtgtgggtcacttgcgtcgcatcctttctgaatgtttttcctttaacttgccatttataaataccttttccaatgataaagcagtgaaagtttggaaagaagcataaagcttttgttgtgattgaagtaactggaagcctagttcagggtgctgtgagaagctggagcatatcaggactttggaattatgaattacagacttactatatgtgatggtatcggtgcctcctgaagaagtagaagacagagatgcatagaaacatgagtcatgtctctggaatactgtaatatcgacatctagtgagagtctagaaagaaacatggagaaataaaagggaggcaggaaacaggcaaatacttagtggttctcagttatttaaggtaaattttggcatcgagtaaacaagataaatcaaaatattttctagatcaagtaggcattaacaaagatatagaggaaacttggaggcgattacttagataatactaacagaagtacttttgttccagatacctccacagatgccatggttaccccgtctttattcgttgtgtgttggcataggccagaataccaatattgttcttaaaaacctttgaggaagtttttctttttttctttcttttttttttttaagcaaagaacagaaacaaaaccaaggagacagtatcctgtgatgtaggctgttacctcaaggtgagtttatttgtagcactaacttgtaacgaattgtttaaagaactgaaacttctttttaggtatagcttatttgtcagattt

SEQ ID NO: 51227 - DNA, 1489 bp, Homo sapiens
actaaaatcaggaaaaccaatgtccaattgaacttgagttttattttgcatagagaagtaaccaatatttctgatcaaaccattaaagctgtttcagttccttttaaataaaagcaaaggctaaattttttacataccacaaagcaaaataaaacgaaaaaacctttggtcatgatgcattttttattcaactgattgctgaattattttgattatataatcttacactcttatgaaagtataacaagtatgaattttctgaggtgaagaaataaatgtagaaagcagttaatgaggcagaactcacaaatctgtatttatagtttcatggcaaataaatcataagcagaggatacagatgtaaagaaaaattcttgattgcattcaagaaatgcaaggtcgaactaactttttactgaaatggaattgtatcgctgctcagagggatgtggggagtaaagtaagtgggatgtgcttagaacagcaagctaggccgcagtgcgcactcgtcagtgtctgctgcttgtcttacgaggattctagcacagaagattaaatcatgttttaatcatgcttaataaatggtactgtagttttattatggttaatgtccacttgtaattcaatgaagagtggctttttaaagcaaaggagaaatcagcatgtttttcttggcgctcttatattgtgtgtgtgtagaagatgctgggatgggttatccatacgacaacccctgtgaccagagatgcaggagcacatgcatcactcttagttttattttatttgttttatatgttattttcataaatctgaaggtttgatcagcttactgtttttagtattttctgctgctgcatgtgtgtacctttaagttttgtagaattaaattgaaaattttgaccagcaaatgcttaaagccactgtcaaaattacatagttagcacttcattgatttgaaggctagttttcattcaacattcctgcagtttgtgtgtgacctgattttaaagagcagttccatgagttagtgccctctggtggcacacagaggacgtcaggcagagagggactctgacccaggagccttccggaggctctgctgaagagaagccagtttatgactggccctgtaatttcatattttttcatgtgttcagtgctcgtcagtttcctactccattaagccatggccctggcattgactcagtaccagctttatagcaagtcttcagcagcttaggttgtgagggaatttccaggtggacttgatataagaagggattaccaatgttgagatttcccatgaggaaccaggacatccatttttggatgcatctcttagctccttttgaagagcagaccatgtcacttcctgggttaaggaaggaaggctccctgatggcctttgagtgactgactggcacagcttggggtgggccttcagtgggttagtctttgataggcctttgtttcccattttggtcttccc

SEQ ID NO: 51228 - DNA, 2036 bp, Homo sapiens
tacagacacatcctgagcaccagcccacccacttctgccatcaggaggctttgaaactgctgtggttcccctcttaaaatggctaacctctacttcagcaaccttatttatgcattcatatacataatcattctttaaagtctagtagacaattttcacattttgtttcagcccagatctttactaaattttgtgagatcagcattgttgggcttgaattaaccaaacttcgccatactgtgccttcagaaatcccagattgggcgggttgtgagttcatctcatcctcttcctgacattgacactaccagcaccatcagcaggctctgggataactgcggccccctctgagaggctacatcttgtttgcgatctgtgggttacatattgtgctagagataaaccttgacagtagagacgtgtgacatattttttacaagagtcactgagatacttgaatgagaagatgatgtagtttgaaaaagtgataaatgggccaggttcttgagaaactagcagaatgtcttattgaaaccttgggatccaatctgaaaacagaaatgagtcttccaagcaaatttttttcttttctttttttttttttttttgcaaatgtggtgggggtagatgcttttatataaattctatacctgtttctgtggtataaaaatcaaattttgtcctcttttgcctcggttggttggtttcattttcaactaggtctccgtttctaacagcatctcaggtaacttttctgaaaaatgtgggttcagaggagctcatgtgctggtggctgtagtggcagctagttctagactatgagatctcagtgaccactttggtgggtgttttgttttaaatcaacaatagaggtgaatctgtactacaaagtaaaatgtatgagtagataggttttcatgttttgaagttttttatcttcagaaataaagaaacagcctcattaaagaactgttaaaaaaaaaaagagctgtggccgggcgcggtggctcacgcctgtaatcccagcacttttgggaggccgaggcgggcggatcacgaggtcaggagttcgagaccagcctggccaacatggtgaagccctcatctctactaaaaatgcaaaaaattagccgggcatggtggcgtgcctgtaatcccagctactcaggaggctgaggcaggaggtggaggttgcagtcagccgagatcgcgtcattgcactccagcctgggcgacagagcaagactccatctcgaggaaaaaaagaaaagaagaaaaaaaaagctgtttgtctgttctagcctggcacctatgagttctggagcagcacccaaagccagttcctgctggctttcctaggagcctctttggcgtgggtgggcgagctgctcccttgcagcagtttcagatgtcacttgagaaaaatatttgttgttgtttggttgccctcttcagttgtgatgcttttaggaagttaggaaacagatgagacagtctggctggaataagagggtgggtaaccactgatctgagatcatccctgttgattaggtttgcagaattctaaatggagattgtagcttcacatgcgcactgagggggttgtgcgttttcataggcttatgttccatcgggcttctgcatgatcttggaagagagagactaggtgtggttcttggctctgttggctggtgggtttagctgtggatcacttaagagacccataatccttgcttttgtaccgttctgtattccgtttgtcaggctgcgagggaagggggtttgtgctaatttgtatcttactgaccctgactggaaaagagattaagattttggttgtataattaacataaatgaccaaaaatatcaagcccactcctcacacaggtgacccaggcatccaaatatttactccaatgattagtgtctttcagctgtagatgggcacttctttcctttcctttctcctctctcttttctttacccaccagatagattcacactgaaagattaaaacaggctgtgggatttaaatg

SEQ ID NO: 51229 - DNA, 1029 bp, Homo sapiens
ataagaatgctaaatgggggttccttttaaaaatagaaatggcggcttgcatttacataattactgctaactagcacaacattttaaatggtgacaaactcagggtagaaaaagtatctgttttaaaagcctggtaaaaggaagcagaaaatgctctgtgagcagctgcttcagatggagggtctttgcaaagccgggagaccaagacttttcagtagggagggcgaggtcaagggaggaggcaagaggtagctcaggcaaactacttacaggccctgagcctgtgtgtgggcctgaactcacccacctttcattttggagcatgattgtctaagtattaacacttaaatctgccttggtgtctgtccggacagggtgcagtgttctctgtccgctgttaaaaggtgtcaggtgagggttgaagttcaaagttggtgaaagagcatggaagaatatttatgaacatgaaggctgagattcacttaacacaaactcatcagtagttcaagccagaatctcaggcctgtccttgattctgcccttttttccccatcccagacacccatctttctccttccaaaatacatccatctttgcacatctctgctagtaccaccctagtccaagccaccttcttttctttgcctggagatctgtcacattttcctgtgtggacttcatgtctccagtttgctccccttggaatagattccccatgcactagccagggcaatctatgaagaatgtaaataggattcgttcactagcttaaaccctacagtgactttctatccatttggagtccggtcagcatgaataatctggcctctgcctctccatttcctaccaggtgcctcttccctctaagcacccttcccatacggggaatccatcaaacatgattcttttttgcattcgctgttttctctacctaaaattatttcctctcctccccatctttgtttgctggctcctttgtgtcattcagggctcacctcaaatgttatatcctcagagagaccctccccc

SEQ ID NO: 51230 - DNA, 1841 bp, Homo sapiens
ttggcagaagctcccctgtgcaacttttcattcttgttgctgtctttatcagggcattattacagtgattgggttgtgcaaggagaaacagtaacttcccagttaatttatagtgaaatggacctttttagaactgagacctagagataaagccatggagctggaggatttcagttgcttttgagtgagcatcaattcattagactagttttaagagaacctctcccttctcatgtttgaccagagctgaagatgcctcgactctgcctggttccccacttgcctgagtagagaacaggttcaggtaggagggaacaaacaggttgagcacaggcagagtcaggaaagggcctggcctgttcaggatcaagatgtgtgaaatgaaggtgggaagatgggggtggaaaatgggttttgaccaacatatggatggtcttgtgtgcaagaagcatgtaagcacagcagattgtgttcccatggtgacaagctgctgagccactgtgtgtttagggtcagtgtggggcggggagtagtgttggaagtccatgtcagtcattggtttcctagttagtgcaaactcaataagcctgtatttactggaagccatttttctcatatatacacccccagattgtatatcgcttttctgatttgactttttggctgattgcttttgaagttaatgtggtttagtcaactgaatgttctaaacatctccctttacctacctggtcggtactcctggtgagtttttgaaaggcagtgtctttcccacagagattaattagaagttagtgtgtgcagtacacttgaccctatgtttgacacacattcagtatatggtggtgattatttgtttgaaaatgaaacagagctctctgatggaacctgaagaagtgggattggcacttctagatggatatatgggttgtgtttaactgctttgaatgttagtaagggaaaagtatccacttactattgttcatttcttttttcccagccttaagagccaaaatgattttctgcccacaaacgtcttggttttctttttctagcctgtcttttcatggctaagatatttgcagaaatttctggctagccaccagtccataactttttctcttctttgcagacactgtgtttagtggtatctgaaaaaccctacgaatccaaagttgtttaccctacgaaagttgagattccagttcatttgctaacctgcagtttcttatttcttgtcttggtacttcagttggctcattaaatatttcttaaaattggttgaggagcttaaatatttgttaaaattgtaatgtgtcctgatttagaggaaactaattattatgtacatcttactagatccatctgttgcccattcctcagatacagtgatagaaggagagagaaattctgggccgggcacggtggctcaaacctgtaatctcagcactctgggaggccgaggcaggcagatcacgaggtcaggagatcgagaccatcctggctaacacggtgaaaccccgtctctactaaaaatagaaaaaattagctgggcatggtggcgggtgcctgtagtcccagctactcgggaggctgaggcaggagaatggtgtgaacccaggaggcggagcttgcagtgagctgagatcgcaccactatactccagcctgggtgacagagcaagagcccatctccaaaaataaacaaacaaacaaaaggagatagaaattctgtctccaggcagataagttatagttcatagagtgtgagagaatgggctcataatggaacagttatcctgggtggagttggtgcttcgtgatggtacagatgctttccag

SEQ ID NO: 51231 - DNA, 1007 bp, Homo sapiens
ccatcatggaagcgtgcccagtctgtttccccatctttgatgcactgtggatgataaataatcatcactgctgtgtgatggctgagagggattccagccagtgtgtgctaggttatagtgttttcctgatggatggagcctattctgggaagcagcttattgtctcacgtgaacaggctttctaaaataaatgactgctttcttaatattttgaatccttttcttcagcacatgttttgttgccgtggtttgaaagcttgccaaatatatgcctttgcacaactccctgtagggctgggtatacaatcagaccaaacagtgtgatttaagtttgagcataattgggaattcagcaatcacttgccttgcatttgatggaatggcagtggagtgcttgagagttacttcgctgttaaaaaattatatgtgtataacgcgcacgcgcgcgcgcacacacacacacacacacacacacacacacacacacacagagtttcactatctcataataaagttgtacctgaaaccactgggcaaaaataacactagcatgataaataattgcttgatttttgtgatggaggcaggaattaacttcaacaaatcatagcagttgatactgtagatatgactgaggacttaagttatataaggttgtggaatggaagaaaatcacgtggtggcagcaatacattttaaacacaagcccttgtcaagtccttcatcggttgatctgtttccttgtttctgtgtactttagtaattgagccataaacttggtgaacttggtgttgcctctgtgttatacaagcatctttggattttacattgccaacactgtgcgtgtttgttgctgttggattgtcagttacctataattgagaccttttcgtgtgtctctttgctggtgggaaaaatgctgtcaacagccccactccctgcagctctttgaaaagtcacatgtgaaatccagagtttgtttaccaggctgaaagagatcactttac

SEQ ID NO: 51232 - DNA, 1040 bp, Homo sapiens
cttagaataaaactaagaatatgtgtaagacctctatgctgaaaaccacaaaatatctgtgagagaaattaagagaagatctatataaatggagggctataccatgtattgaaagactaaatagtaagatgtctgttttccctaaattgatttatgaattccgtgccatcctactcaaaatctagataaactaattgcaaggtttttatggaaatgcaaaagatctagaaagaccaaagcagctttgaaaaagagcaaagctaggagatagcctgatttcaagacttcctgtaatgctacagtaatcaagacagtgtggtattgcaaaaagatggacatataaatcaatggaaccaaatagggaatccagaaacagatccacacatagatgctcaattggtttttgacagaggtgcaaagggaattcaatggagaaaggatagtcttttcaacagattgtaatggaacaactggacattcatgtgcaaataaaatgaacctcaacccataccccatactgtatataaaaattaactcaaagtggatcatagacctaagtttaaatctataagccttctggaagaaaacatgggagaaagttttcatgaccttgggttagcagtgatttattagatatggcaccaattgtgcaatccataagagacaaaacatcagacttcctagaaattaaaaaatcctgttcttcaaaaggtactgtttagataatgaaaaaacaagccacagactgggaggaacctttgtaaaacatacgtctaataagggatccataatgtatgaagaactttaaaacctttaaaaactttaaaacaacccaatttaaaaatgggcaagagagttctctagacatcttaggatacacagatggcaactaagcacatgaagaatgttcaacagcgttattcatcattgaaatgaaactaaaaaccacaatgagatgctggtacacagttactagggtatcttcccaaaataaaaccaaaaagaccctggtaataccaagtgctggtgaacatgtaggg

SEQ ID NO: 51233 - DNA, 1103 bp, Homo sapiens
tgagccaggcaccgttcggggcttcatgggactcctgctgaatggtgagccggtggtcccctgggtccatagtctcttcccagtaagactgaaggttctgagtcgagcagcaggtacggggccagcctgcccagggcgtaaggacgaccacccctggcctgggaggagtgccctcagccactccagaagtagcgtgggcatgtgccccgtgactggcagaccagtcagccctcggtggggcccttcctgtccagcccttctgctcctgccccacctgggagccactgtggtcctcagacctggcgcagttccagcctctcccgccccactgtcattcctgcctgcccatcacagtgcccacaaaacccagaggcctcccagccctattgccgtggtggtctgccttccggctccctcgccagcctcgtggcctcatgtcttgtcactttttccttgcctactggagccaggctggccattttttctccctcagacgtgccaagtaagttgctgtcccttctgcctggacccccagacagtgcccaccctgtgacttgagaaccccttctttgctcgtcaccctttatgaagaagacatcccatccccttctgcctgcatcattttcttccaggcacttaatgctatccgtcatcatcccacgtcctgtcccctccagggtgccaaggcacacgcagaggggccgttactccccctcactcccttcacgcctcttgtgtccagcagtgcccacggcaagcaggctgacaggccagggttcttgccttgtttctccaccatgccctctgctctcaagtttatctcctggctctggaaatgctgcccgctgctcgctgcaagtgtgaagccagaatattcaagaagtatatttaaagtaaaagttgagcatgctttccccaagaaaaggttttcatgtcagtgaactggcaacgcgatcacctcctgatggtctactgtcaactggaggctcttaggaaagtggctctgtcatcttctccagggtttggtgcagcccaggttcatagttgtggattatagtcctcgttccttttcttggggtagagagttagggaaatggacatga

SEQ ID NO: 51234 - DNA, 2570 bp, Homo sapiens
tgcttggttcaactttgataacatacccttcatgagactctggggttatggcattgtgagctcaaccccagagctaggtaggagtcttcgtggaagtgctcctggcttcgcctcccctgcagctgctcagtgggacagcctgtgccagggcccctgaatgtgcagttctccaccaggagttgttattgacaagtaagtgtgcaatattaatttagccagatgctggcatcttcagaatcacacatgagtattgagaagtcatggctgaaactgctcgatcaatttaaatttaattaaaaagcatcgaatcaaagaataacatggcgaagtacaataataaccacaagcatctgcatcattttatatcataatccttttaaaaatttttttccaatggtgacaggtaggattaagcaggctgacttgctacgttctcttctactcctcaagaaaacaaggatttcctggcctctaaaagaaaactcaatttatttgtctgctttgatcatctgaagtattagatgtggactggagaatccttgggacttttaataatttagatgaaaggacacacaaagtcacctaatactacttaataatacctagtacctaatatttggatacagtatgtctgaattacttccgaatacttgtgaatttctaagcaaaagtatagttatttcattctcaggaactccctaaaaatgacaaagaagtgcttctggcatcacgagggaggttggaagcaggcacaatttggaaattcagagccagaaaaggcccatctccagcagggtaacagttctcaggttggggcggggggcctctaccctgcagtgggctctacagcagacccttgggctggcagacacagcaggcggtagagctgtgcctcacaggggtttggctgtatgggattggcgcagcccatggggcgtggagggctctggtctcctaaggggcctctgcctgcctgtgagtttgcaatgagggactaactggagcaggtggggtgacccacaggaggtggcctgggtacattcagctctgtcctggactgattctgtgaccttgaggatgagccagatacaattaatctgtgtgcacaaaaagacttggggaaaagactcctgagtgaacttcctgggtctcccggttttcaggctcagctctaagcaaggatagtggtgacttttggctttggcccctctggtgttaagctgaagccaaggaagttttcctgcctctgcatgtacttaggctggttgccccaagggtggcccagcctgtatggaactctctggagcagctaacctggtccaggtcaccaatcctgaaaatcagttggcctttctcacaatgtgccattgtggaatttgcagcaatccttgtttgcttttggctttatctatatattgactaggtgtttgggtccaggccaagccacttgctgtcctcttggagttgacatgctaaggcactagtacccgttatagggcccaggtggctgcccagcaatgcaaggggcaccttgtttattgttctcctgctgggtcataattaaggttcactattcagatgattccaaagccttcatgggcttgatctaggtgacctgctggtttgaaaggagaagctgtagtctcaaaacaccagtatggcaactgtttttttcttctttttaccccagttttctttcagcttctgcataggcacagagtcacctgggtggccccaaacttctttttagccaggctggaacgtaactttgcagggttcattccctctactgaaatgtttttgctacattggaggctcagctcattttttgaggggagcagggtggggagggaaatgctggtcttgtttcttgaaaggaaaatgctaatgtaacttgacttgggcctgagctgttggaaagcgggtctctgcataccttgagtccctccaacatgtcactatctgggaaggtcattgtgtccttgcagtccatcttgtgccttttctgtttatagagcgcagcaaacagggtcaggaacccatgctgaatatttaatgaggaaatatttcaaaggcggaggtgtgcttgcctgtcacctactggggctatatgtgggaacccaaggttgctggatccgtggagctttggacccaggccctgggctgctagaaccctgtggctggacttcagcagctcagaaccttctgctgggggtgctttgttcataattgctcaacagtgaggaaatggaagtggcgggcaaggagtggacttgccagggagctgtgtgtccccattgctcgcgtccaggatgtcatcctaaattgcagtacatctgctaatgaggagacaaggtgttaccttccgtttggagcagctgcattaattacatcctctcagacatcccctgtgcctaccactcctggccagcttcctttgttttaagttaatagaccaaattggagggaaagaggggagggtgtccttggagaccaggtgccctctgctccttgaacgtggtgaggacgttagctcaggactgggagctggtggcaaatggcaggctggc

SEQ ID NO: 51235 - DNA, 1107 bp, Homo sapiens
ggagctcatagaaaagcccacgtagtctgtgtggggtgggtcagggaagacttctctgagcaagtggtgtctaagctgagacatgaaggatgagtgagagttagccaggtgaagggggccagggagagaaagattgttccaggcagagggagttgccctataaagagatggcatccagggagagagtggcatgttcatgacagtggaggaagccagagggtttgcagtgtggggaatgagcctgttcatgacactggaggaagccagagggtttgcagtgtggggaatgagggtgtggctggtgcaggatgagggtggagttgtgtgcaggtgggcgggatgcagggcctggtaagccgtggtggtttaaatgaagtgccgtggagggcctaggagagagccagctgatgagatatctgacttggagaagcccagggtggcaagattggatgcgaggaaactgttaagagaccaagaacttgcaattattaacctaggtgacagttggcccagagtgtggcaatggagctggagagaagtgacagattcaagagattggtaagaaaaggaatctgtaggacttggccatcgatcagacattgagggtggggggaagggaggcgttaaggacagccctgaggtctctgttttggcacccactgccatgacccaggaggagcagaggagagttcagttggaggccgccctgagacagccaggtgcggctttgcagtaggatttatgggcttgaaattcagagccaaggatagcccaggaaatacagatttgggagtagagaggaagacccacaggagagggcagagtggggtgggggagggggccccgagaaagacgcagcaaggaggggaagggcagaagcaaaacccatcgggggcggggggggacatctacatgccatctttggtgctgtgaacaagggacagtatttcagcaggtggaggccatgggtcacagcgaagacgttccaggtagctggaccaacatgaccaaggtggagaggcaagaggtgtccatgctgtctgggacctaggctgggtggggctgggttaggcctcacatctagaaggccccaaatgcccaagttct

SEQ ID NO: 51236 - DNA, 1632 bp, Homo sapiens
ctcccccttataatcccgtcagatcccctgagacttattcgctattataagaacagcatgagaaagacccgtcccgctaattcagtcttctcccactgggtccctcccacaacacatgggaattatgggagctacaagatgagatttgggtggggacacagagccaaaccatatcagtggggctgacccaggatggccaacttctgatttgaccaaatgaggccattaaaagccagttgtcagctactgtatcatcatttcataaaatgaaataaaggaaagaatattttgacaccaacaatataagaaggccatcatttcaagatacaaaatatttcttcagttgattataattggttttatgaaggatttgctccactatacctgtttttttaactccccctttttccttatttctcttttttttgccaaaaactcacacaattctgttctgggtccccaggcctctagtttcagatgagcaaaagcaggtgcagagggaagggacctggccagggtccacagctagtgagatttgtgtattgtttcagttatttctggcttcataacaaatctctcctgactcagcagtgtgaaacaacagtcatttattattatcacctctcttggttctggggctggcccaagcagcttcacttggggtctcagtgctgttgcagtcagatagtggctgggctgtcatcttaaaggcttctctgagtgggtctgggaagatgcaagcatttggggacagagcagccagggctcctctggcatccctttctccatgtggttttcagcatgacggctgcaggacagccacatttctcccctggggcctcaaatgcatgtcctgagaaaagccggtggatgctgtgttgcctttcatgaactggccttgaaagtcacacggcatccctcctgccgagttctattagttacaagtgagccattaaggccagcctgtattcagtgggaggagaattggcctccacttcttggtgggaggagtgccagaggatttgcagacatgttttaaaaccacagtgtggatccaataggctaagtccaaagcgccctagggagggccaggttttaatttggagcgctgggatcttggaacacacccccttccgttaagtgttccaggaatgagtctgctggaggatcactccggtgacggtggcaagctctgcttcctggtccctgcttgcacttgtatgaagtgataaatttcacgaataaggtagattccatcaaataagtatcaattaagctgttttatgatctagttgagatgatgaattaaagtcgatttagataaatgatcagtaaaagaacagagacttcaggaagacagcataaactctctgaattgcaggcactcactcttcatcagaaagcagcctcccacacttgtgcacttgttgagcgcttgctgtgtgcatagatagcactggctggtgctgtccgaccagtgatggctgcagtggtatgtggaagcgagaggggtcccagtttgcactcctgagtatctgtgatccaattcgggtcatccctgtgccatctgttaggatctgagtgtgggaagggggagcactgatctcttttcaatccccattcctgggtgtg

SEQ ID NO: 51237 - DNA, 2042 bp, Homo sapiens
cccctcccctttacctttattcccatctgccctccccaccctaactctcccctgggaagatgcctgccgttgcctgttcccagagagccccttacttgcagtttcagagcctgctgcctcactcctcctccctcactgacttctgtcaatttgaagatctcccagctcattctcaccccaggacctttgcacttgccattccccctacctggggttccattatcaggcccgtccttggcttgccccagctcattttccaggtctcactttaaatgttactccttaaacagcccagccaagagcaccctgtctaaggcaggcccccagctcctctgtttgctcctcatggccctttaaatgcaagcttcatcatgcaggcagagaccacgtccatctgcatctaccatgttcactgttgtttacttagcacttagtcctgtgcctggcccatcggaggcaccagcaagcgtgtctgtaggagtggggcttccgcaggacagtgctgctttttattattatttttttaaatagaagggacttaagggccaatgacttttaattctgctgagtaagatgtagaaaaattacagctaccatatatcatcaacatgttgtaaaagttggaaggacatactcttagaataaagaacagttcttttcttttcttctctttttgttttgtttcgtttcgtttcatttcaagacagagtctcgctgtgtcactcaggctggagtgcaatggtgcgatctcggctcactgcaacctccgcctcctgggttcaagtgattctcctgcctcagcttcccaagtagttgggactataggcgcataccaccatgcccagctaatttttttttttttgtttgtttgtttgtttgtttttgagatggagtgttgctgtgtcgcccagctggagtgcagtggcgtgatctcagctcactgctagctccgcctcctgggttcacgccattctcctgcctcaagcctcccgagtagctgggactacaggcgcccgccaccacgcctggctaagtttttgtatttttggtagagacggggtttcaccatgttagccaggatgatcttaatctcctgacctcgtgatccgcccgcctcggcttcccaaagtgctgggattacaggcgtgagccaccgtgcccggcctaatttttgtatttttagtagagatggggtttcactgtgttggccaggctggtcttgaactcctgacctcgtgatctgcctgcctcggcctcccaaagtgttgggattaccggcgtgagccactgtgcccggcccttaaaggacagttctttaaatggcataactttagcactattgaaaacctgctgtgtcgtccctcttctcacctcttggaggttggatgaaaattctccttcggtccatgagcacctaggaggtgctgcatttgccctcggtggaacttagtaacccattcaatgtggtcttgaccgtgctctcgtggtatttgtcccctacaccaggctgtaaatgctgtggcgggacatggtgttttaggatgagcctttgcaccaggctgtaaatgctgtggctggacactgtgttttagggtgagcctttgcacatgctcttccttctgcctccagtaccttgttggtctctgggtacctccaagttctgcccagacgccctctcctgaagctttgcaggactggccttgcctctcctcgatccttggtaatcactgtcgactcgcctgcctgctgggatccaagtcttctctgttttggaccagggtgctggcgtaccatgttcccaccattgtacaccgtcatatgctgaaggatgaaggatgttggctggtggcgactttgagtatgtggcagaaacagataggccaccctcaaggactctacatggagcccactctgtctttctgtaactgattctaatttctacttcagtctttcattccaccaggttacagaaacagaatcacatttaattgtgggttttctcagccaacagaaagttcctccagcctcctgggtttgcgcgc

SEQ ID NO: 51238 - DNA, 1064 bp, Homo sapiens
cactttgggaggctgaagcaggaggatcacttgagtccaggagttcgagagcagcctgggcaacatagtgagacccctatttctacacaaaaataatgataaaaaattagctggatgtggtggcctataatcccagctacttgggaggctaaggtgagaggatcacctgagcccaggagatcaaggttgcagtgagctatgattgtgccattgcactccagcctgggtgacagagtgagaccctgtctctaaaaaaataaaaaataaaaccaaaacaaaccatgggctctttgtgccacaaacggagaagggagctgagccagttgggaggagcacaagctgtagccaggtctgccctgagaggcctgatagtctgagtggccctgtacccctgtgaggccagtgtggccagctgtgatgggcagcacggccagacacgatgtttgcgtgtttaaggacttcagtctgtgcttggacactctcactcagagtggcccctgggcagtctgctctgggccgagcagggcatgagaaggtgccacagggcagaacgagaacacgaatgcagaggccccggctccagcttccagtgatttctgttgggggccttcgatgtcctgggcaacgtgctgaccactctgtaagcactatccctgctcaaggtcaccagcaacctgcttgtggctggtgccgtgactggccctcattccttatctcgtgggaccccattagcagcggttaacacagccactccggccctcctcccctcctcccctccgtccttcctcccctcttctcctcctcccctcctccctgaccgtcctcacctggcgtccaggacaccatggttcctggttttcctccctcctctcagcctcctcagggctcaactgtggtccccttgtctcccattgtctaccttggggctgctacagtcaggagcattgagggtccctgtggcagaggggaggaggcacctgatttcagagagcggggaagtgcaacctgtcctgcaccagaaataggtggcgccccacacctcctcactcatttcccaactctgc

SEQ ID NO: 51239 - DNA, 1064 bp, Homo sapiens
ttcaatttttttcttttttttttttatgagctttctggtacgtacagcacataatcctacataaaatggctgagcacgacactggcataaacagccggtgatggggtggaagtccgtgaaacgacgggtttgcctctgtgggagaagccgcagtctttcagcactgagcaggctccggattccagggctggggttgccaggtcttctgagtgctgctgacctgagggcggcactcgagggcttgggtccttggggagggacgctcaggcccctgcctgggaaggatgcctgcgtggcttgaaccctgacctccaccatcagccacatgtgccatttgggacttgtcctttttctcaccatttcatgaaaagcttgtgttgcttttgccagccagccagccagccagctgggaaagctggtcccacatcatggctttctaaatgacgccctggctggtcgcctgatgattgagcaggccatggttaaggctcttgacagcacgtccaagggccaggtgccccgtggaaagactggagcagacttgatgtcagttccccagctgttgtggggttgaaggggatttaccctgcaggagtaacgctcctattgctcgagctgttggggtgtggacgggggaagctccagcttatttatcctcataaaccatagtgctatcccctttgtcccacgagttccagtatttcattatccaaagtggatctcctaggctgcctccaaattgcacacaatgattttgtcagattttgaggtctgagttttcctttgcagaataggaagagtcactctgtcccagccttgcacctggtacatagtagcccgagtggtggggagtctgccaatgagatgataaaagactctcagaggttaaggctcttgctcaaggccacacaggagacaggctctgagctcgggggagcccgacccttaagactaaatcctcaaggaccgcgagtgcctttgaaagccctgccccgccgcctgggcagctggagtgggagccacgcaggcaggcacttgtttctgagcacagctgagctggcggg

SEQ ID NO: 51240 - DNA, 1003 bp, Homo sapiens
cctgcaataaaacagagcctccaagaagtgcatgaagcgaatctcctcccagcctagtccaccacccctctgcagcttcccgagctgtcaccctccagggtggccacatacagtatttattttttttaattaagctgcgttgctgtgtggctcaccctccacagatgctttataaagcccagccttgtaagttgctgaaagtttttatttttttttaagcggatagtaaaattaagcagttattagtattcacgaaaaatgctcgtggcaggcttcgcacacgtaatgagaagccacctgcagttcaaagcagtacttgataatgctgtaattagatttgagatgcaaaaaagctcattaaaattaaataacatatttgtcactgttttaagaggtacagattgcctagaaccatgctggtctcttgaccttgagtattttggcagagtccttgctgccgacaattcaaaaataacatcagcaattctgcagagagtcctgaaaacatgctcatccttggttcagtttgtattgaaaaaattatatagatatccaggggaaatcacagatttgtacacagtgtgttctgggagaaaagggtggccacagtcctctctgagccagtagctcagacgctgtgaagaagagatggatgtgtgcctgtgggaggctggggcaggtggaggggtcccccataggacacggggacactgtgagggagtttgcaggaagcggcggccttgggcaccactgcttaccactaagctgagctggatgaagccacttgctcagagcaggcccagggcgactggtaatcagattgtcagtcagtgtttcccgggtgcctaccggtgtaccgggtcccgggcaggggatggtggggccgcaagtgccagtgagatttgcctcaggctgcaaaagaggtcatagcctcatcacggagatgaggcataaagtcaggtgccaggaaagtatttattgttaataaaagtagctaatgttg

SEQ ID NO: 51241 - DNA, 1001 bp, Homo sapiens
cccatttgaccagggagtgcaaccagcagaccaaaggtaatgcatttcagctgcctgtgggggaaggtaaatgtggtttattagcccccctggctcagagggggctgggcactggtagcagctgaagcaaggcggctctagatggagggaggggacaggttggtgattgtgtgccctggtttctctaaaggaaaaaaaatggacgtgccgcctgttagctaatcaacagtgaggagaaagtcctgacaacaagtaaagaaaacttagctggcaataaaataagggactttttatggtggtttttatgagaacattttcgctttgggagttattagagttagtgccggttgtgacaaaagctgcatttgcatatcgccgtgatgaggtctggatggagcctgaatgcggcattaactgcatatcagagaccctttcagaagccaaacaggatgacatttattgcaagctcgatgccgcacgtctggcattagttactgcttgttgtgtcctgtggaaactagattttctgtcttgggatctttctgggactggtcgcagcagcttcctaggtcaagaacaagctagggctttgggagtgtgtgggggatctcggggatggggaggggacaccatcgggagaggagaaggagttaggcttcacagggctgcgcgctggccaggtgcctgtcacaggctgacctagatgagactgccactctcagattcaagccccacaccaggacaaacaggaatttttcccacttttttaatttttaaaattacgatgtaattaacatatcacgcaatttactcattttaagtattcaattccatggcttttagtatattcacaaaaacgtgcaaccattgccccagtctattttaggacatttgtgttaccccaagagaaacccctcacttcttagccgtcaccccaaccccctcatcctccctagccctaaacgaccatacatctacttctgtctctattgatttgctgc

SEQ ID NO: 51242 - DNA, 1081 bp, Homo sapiens
ccagagcatcttgaatgctcactcgagccaggcaccaggatgcctaaagcaaagctgttggagtcagactttgacctaattgagttggggttccaggaagatcaatctgatcatgggacaaaacgaaacagtcagtgcctggaggcagaggccccgctgagtctttcttgggcttcttggaagaaggccacaaaggtcaggacgaggaacagccggagaagtgtgactgcatgcatgtcaaggagaactcatcagcaggacctcctgctgtgtgtgtgtgagatggggcagggagacggatctggcacttctggcctggaaaactgggcctggggtgaggattgtgtggtggctgatgggaaggggagaaataggcgtttccacctgtgccttgcctttcagagtgttggcaggcacagagttcagttggctgctggactgtgcaagggggacgtgggagacaagggatcccacagaatccatctttatggaatctacctttcagagagagcagatccacgtgaaagccaggctctcgggagcagtagagcatctgtgatggaccctaggtgagtggcttgcccaggaggaaaggacatgggccaggatgatccaggagggctttctgagagggaggagccaagctctccgtgaaggatggatgtgccgagcatcagcagaggagggaagagaatattccagacatgtcaggcaaatagcaagcacagggtgatatggtttcgctgtgtccccacccaaatctcatcttgaattgtaactcccataattcccacttgttgtgggagggactcagtgggaggtaatagaaccatggggacgggtctttcccatgctgttctcgtgatagtgaataagtctcacaaaatctgatggttttataaagggcagttcccctgcacatgatttcttgcctgctgccatgtaagacatgccttctcttctcctttgcctttcaccatgattgtgaggcctccctagccatgtggaactgtgagtcccttaaacctctttcctttataaattatccagtctcgggtctgtctttattagcagcgtcaga

SEQ ID NO: 51243 - DNA, 1060 bp, Homo sapiens
ttctgggccgggtcatccactcctccagaagagaggccagggagcattccatcagccccacctctccagaggcccggcacacagtaggcactcaatggttgtaaactgtatccacctacaaagcccctagagcttgtgagacccgggaaacagcgttccatacaattgagtgacagagccctgcgtggaaagggaggcccgtgttggtgccctgtcctcatccagtgggaggggaggagagacctggaaggaagatgggagtcccaccccagcctgcgtgtttctctgggaaacaggtttcaagtgcagggaggtggtggagggctgacttcatggccagcactgtcctgggcaccgtgggtcgtggaagggaggtggagctcggttttccgtctgggcctcaggtggactcagaggaggttcttagagaaccatacagggcatatcaggtaagcacgggtacacaatgcagagaaacagtgcttgctgcaattagagaaagcagagaaataggagctggagtggtcactaaaggcacgaacggccttgacggtggagtggggagaggcagacacattgccggcacaaagagcatgctggatgacaggtttcgtggcttgtttgttgctttaattgatgtggacaggggattccaggtaggagaatccaggcaggctaggaaggagcttggctctgtgtggggcatgagaagacgtgctggtcttagcggaaggtccccagaggaggggaggctcaggggccggcaaggtggctgagcctcgagcaccctccacagagcaccgtgccaggggcctggggcgcatgttgtaacctggctgtctacactagatgaatagaactttcacaggttagtggcttcatcttgattgtttaaatttcataaggcgttgggaccccttacgagtagctctgaaagggaatggattgctaataaatgcaaactgtaaaatattcatttgagatgattattttatattattgcataagtgcaaaatgaatgaactttctgcttacttatggtggaatccacaaccatctg

SEQ ID NO: 51244 - DNA, 1055 bp, Homo sapiens
ttgatgctgggggaaggactctttatgatcccttccctccagactttggctggctggctgttgaggtgagtggaaaggccacaggatgactctgccgtgggtattgggtgggccagtggtaggggctagctgtgcaatcaagaggctatgaggagtgaggtttcctcttggattggccttctaattagtctaggatgacataaagaagcctctcttttaaaaaaaggcaaatttggtcagttcttggtttccagggttttggaatgtccaggcaaaattgccttggcaccttctgaaatcctagagaggtagtgtagcccacttgctggggctgacttctgttgccagcgcctcacctccatctgattgcagggtattggttggccatatgcttcagggatttgaaggagggttacctatgtctagggcttaacgtgttcttggagaatattgggcaagagtatgattccctgagtctgggggaaggaggagctccagtggaacttccagtcaagatgccaactatgcatatgtgggaatctctgttctctcactctaaacccatagaaatgttggattagttataatagcaacaaaaacatagctgaattcaaaggtgaggttgggagatttccaggtgccggaagccaggatgaaatttagagtgcaagtcgagtggccttactggagtttccacagtaaaccccttaagggctgaggtttcacaggccccagggagctggaaccaagtttcttgtacaaaactgggaacaagaagggactgtcttttctgtcatcaaaaaatagaaaaattcttcccattggctcaggaacacggtataccccagtcccccaagccgtagcttctaagagtttccttcaagaacgagggataccaagcctaagctgtatatagatatgagaccaaatcctgcactatcaatgtgggcagaaactccgagctgagaacctaacataaaatttggtcccgaattagtggtacccttaaagctgtgtcagatgtaagcgtaaaacttgttatgggggatgattcc

SEQ ID NO: 51245 - DNA, 1041 bp, Homo sapiens
gtagtagaaggggcaaataaattgcagtattcttatataatgaaatagtatatagcagttgaaatgaataagctaaggctgtgtgtatatatgtataaagatcaaaattcagtggggaaaaaaacaagttgcaaaaagaaatgtacagcacggtaccatttatataagcttaaaacgtaaaaaatatttgttgtttatggacgcctacgtatatagtaaataaaaactaaatggaagatagcagctgcctctgagagggagggaggagaatgagatgggcaggtacagagtagctgcagttatatctgtaattcttttttatttctaaaaaataaattggaggatatctagtgaatttttatgacagaaaatacgattggttggcacgcaggtttttattagattatcctctataggttttggaaagcttgaagtcttccataatcatcatcatcatcactgagaaatagagaagaagagagaatgtgtgaacacatgatggattctcagttctacgtgaaaactgctaaatgaatactagttggcgagcccaccacgattattatcatagtgctaacagctgccattatggagagggtgcgatcagccagggacctcacctagtttcatattcagctttattatcacctatgaagtaggacttacgatcctaattccacaacagagacgactagcattcagaaaggttaagttacatgctgatgtcatgcagtgagtcagttatgaagtcatgattggaaactaggccttttgggttcaaggtttgtgctttttccattccgctaacatctgaggtgattggcttgttatctgaagttactctgtttttatttctctttcagctcttcttccaaacctattttcgggcatagtttgttacgtttctgctaagcgagttggctctatcaattacagtatttttgttgccacagcaacaataatgcagccatattattaggtatcactactgttttgttctgctgtgagcttcagccaggcaggtgccctgctatttgcaga

SEQ ID NO: 51246 - DNA, 1074 bp, Homo sapiens
tagtaaattaaaagtttcaggaatgggtcttctcaggagaggggagcgtctgctgttggctttggtgtggctacgccagctgggccctaatctcagcctttgcccggagagattctgcagcacctgccgagtgagcagtcatcccatttgagctctgtaagagatccagcgttcctctgggagtgtcctgagcacgcccaccaccacctgtccctgagccttcccttgcaacagtcttgccttcctttcattctcttctcagctggtcttgagtccgaagtgagcggcttcctttgtcgcttgggagctgcagcttgcaccgcactcaggtgtaaggacctgcaggtgtgtgcagacacagtctgtgtgttcctcagaaggaatgaccacttgaagcagagctttgtgacgaggccttccccaagtgcatctgagaacgttcacaggacttctgagactctaagatgagccgtcaacctgtgttgcaaatctcctccagctttaggaattagtttaaaattaaacttacagacaggccaaatctccccagactcaggccgacttaggaaagtacaatgcgtggcttcattttaacaagtagttccctgatacggtacatgaggaaaatgctgctgaacgtcagctagttaacttgaggacccagcatcagccattctccggactgcgagctcagcttgtttcaagtctgggggttcatgtacgaactacaggctggttctggggtctcagcctaagctgaagatccggcggggaccaatatggacaaagcatagaggaaactgcccagtcagaaaggcagtgagccagaagccaagatgttccttaggaacacccagggagggggcagcgtcaaggccagggggtgcagggcctgccagctcacctgtctcccaccttcacgtacatcctctattctgggaaagtgtgatcgatcctgctatgcatattgttgcattccatcttcattttgtgtctcttgattgttggggttttttgtttgtttgtttttttgttttgagatggagtctcgctctgttgcccaggctggagtat

SEQ ID NO: 51247 - DNA, 1029 bp, Homo sapiens
ttgtgtgtctatttgtctattttaacccagaacatcttctgagaggatcagttttaccaggcaagggcaacttttgatggtttccccaatagcattcccgtcttatttcttgccgacaggaccttgactgtgttcaggtgtcagtggccaaattcttggggagatgccagggccctctccagtcccaggggataaacctagatccgtctaagcccatcatggtcagtgattggtttaggggcggcctgtaactcagttattgccagtgagatggctaggcacttctaggacaatttcctggctcttaaaaaagggtgtatgatttctgtcttctggactttggaaaatgtgatggttatgggaggccgctatggtcaccttgcagccatgtgggtccagcccaaggtcatagcatggttgagccgagagaaggaacccagctgacatcaaccctacctccagacttcttgtgacatgagatggtacattttccttcttctttaaggtaatttaggttggattttctgtaattttgcagcccaaaatatcctacttgaaagcaaaagacatctgccctcgtattcatgcagcggtgtggtcgctttagcctttctccaggctcattgtgttgtgctcagttttgtacacaagtacgttcttttctaaatggcaagacgcttaagatgcttggatttcctcttccaccgcctctctccagcacagcactgagcttaatatcttgtatgtcgtgggatatcaataaacgcttattgagttgaatttgagttttacggacatgagtttaaatttggtgactacccacgggcttctgagaaattattgaaagccaatctatggcccaaagagaggacggcctgatcaaggcatgtgctgttgggccaggcagaccacgatggggatgaacgtgccctgtgtgaggtgccagagaaaatccatcatgcatcccgagctctgttttttattgaaaaatccatttataaataatctggacaaataaagtaaaaggca

SEQ ID NO: 51248 - DNA, 1031 bp, Homo sapiens
catccgccagttggaacttttaacctgacggctgcatccttcagccgggtgcttggaaggcttcacaggcaggagcctcaggggaagtttattttgggaaattgctcgcctgccactagtgttctctagaaacgtgctttgaaaaaagagaaaccagcttaactgcccacttttatctcaacttgtctacaaactgaaagtcaagttcttgattggtggtaaagagatccccccaaatcagaagcaatggctaagctcgcagtttattatgcagtaaatgtccttgaacctgctaactgccgcaaacacttagcttctctcaccacttgggaatagagggaattagtgaaaatatagctgacctgcgttccgccagcaccagtgatgttaccatcttgtgaacggtgatgttgggacttagggttgattttaaaaggcagcctcttttggtcctccccaactctaggtttttatttttggaatgttacaatctagagcttcggaaatacatggccactctcttccaattgccgtaagttttctgttagcagtgacaggacccaggtgtttattagctggcggggtggtagctggagtgtggtttacacaggatgcctggactgcaggcttgaactgaagtggtggaatgtccagttggtttcacgttggacagaagccccagagtccccaggtttgttaggaccagggaagggttgagtgtgtcctctgtgcccgtggcccatcagcttgacctgttcatccttcctgagtcatgggaaaggtcatccttgggaatgtttattccttctagaaggtattttaaaataccacattattaggctgagatatttactggttagcatcttttaggtgagggcacaatcctcccctttgaaggaggctagagggcattgtggaaggaaggttagttattgaggctcccttccccaggtggctctgaatggttcacctctggcctgagaatgggaggagagtctgtccgcaggagtccccaaaacctcagcctgctg

SEQ ID NO: 51249 - DNA, 1054 bp, Homo sapiens
ttgcccagagtcgtgccgagtgggacccactccccttgttttctcattcttcctctctctcctcttcgtttcctgctcactctcaagttaacttgctgtttcactctcttgcttttttctctttttccaagtctttttcagtctgcagaaagaaatgcctcaaagtgcagtttggaggtttctaagtgcgcagctgctcagggctgggaaatcctgctgctgacatgcacacatgcttcttgtgtgtgaggccccaggtgcgcagcccgacccacaccaagccccggcgctggcctcctgtccaccttcttaatgcaccattcttagtttagagcctttcctggcattggcacaggggcgtggtgtggcctctccctgagcagaatttcagggatcttggggacggccagggccatccactatgctgtgcatgtcccctaacagtgggatctcgatggcttttatttttacatggttctgcatgtgtcttctttggattttactgggacaaaagccttcgcggcagaggcttcgtgccagggtgcctgtgatgcacgttggggtgctctgacaccccaacaggagactgcccgcccagggtgacccttgccagcatctctaagcaggacacctggcagtgaatacttccgagaatggaaaagccccctggcactgtgcccacactgatcgataagtatttgcatgccctgtccgtgtccatcgatggtcattttgttttgtttctggcgccccgcaggccccgcagtttattcttagcatcttcagccctgtctccttggtttggagaattaggactgcctggtatttctgtcacgggcgtggattggcatctgtggtgtttcctctggatcaattctgatctaataaattgttactcgctgcccatggaaagggaaagggagttggcctgcgggccttgtggcattatgagataggaaggcgagttcttggaataaaggactttttgcaattcataagtttctgtgtaatgagtaatcaccagatcatctgggggttctgggctggagattct

SEQ ID NO: 51250 - DNA, 1048 bp, Homo sapiens
gctgacttggtgtgctatggcgtctgacctggctgaaagccatgacgcttggcctttggttgggatagcaccacttgattcatcactggcagctgcggaggggcagagcggagggaacatgtcagtactttatgggcaatcccaatgtgagaagggactgaggccggatagcccagtggtggaaatcccgtcattgtagaagggagggcctgggatctcaaatctgggaatttttgagttagatctagaacctgaggctggaggcaagttggatggaactgtctgtgcttgtggccgctgctagccattgagccgagtgccacctgcaggagcagtgatgatgggggtcaggcccagcccctgagtgcacgctgcccgccagtgtgtgctgggcatcacggccccctcacaaccctgcaaggtaagacgtgtgactcccatttaacagatgaaggagcgagcctagtgggattatgtaggttacattgtgagtcaatgacagggttaggatctgaacccaggagtgaggagtgaatgcagcgtcaccggaaggaaaaggaaagaaggagaactggaggatgatctgtctcaggcaagctttagtctgaggttctaagtcatgctgtgaaggtctctgcagagtcactccttggcttcattatgcagagagcttgtagccaggtggcactgggcaggggctcatcccaggtgcctaaaccccacatgcatcaaaacttagaggagaccagcgtcttctgctggtcctttaaaaatagtcatttgggccaggcacagtggctcacacctgtaatcccagcactttggaaggccaaggcgggaggatcacctgaggtcaggagttcgagaccagcctggccaacatggtgaaaccccatctcaactgaaaaataaaaaaattagcagggtatggtggcaggcgtctgtaatcccagctactcgggagcctgaggcagggagaattgcttgaaccaggagttggaggctgcagtgagccgagattgcaccactgtactccagcctgggcgac

SEQ ID NO: 51251 - DNA, 1036 bp, Homo sapiens
cctccctagacagccccagccctttctctttgttccaaggggcccagccaccatattgattgtttcatccctctgcactgcccagagctgcctcctggagcacgctctcttctttcctgatggcaacggtcccacctgatggcaatggtccctgggccagaggatgcccattggtcttcatggagagagcttgggtcaggcccacttggtctccaatcctggcttcgccgcgtgccagctctgcagtggtgccagcttatcctgctaagcctagcttcctcttctacgtgggtatatctgcctcaggtgcagctgtgaggatccggggtgatgctcatgaggtgcccggcaccctgtgtggcacagaaatgaccagaaaataccaactcacccaatgccaagtcttcactgtccttaagatctcaaacctttttttcttgatcttcttcccttgatgaccaacgctcttgttcctctcgcccttgcgggccaccccctcatacatctttccttgggccacaacttaggcctttgccttgcctttacttacctgttgatccacccacccacccacccacccacccatccaaccattcatttcttgcttcattcatccagtgatgtactgaatgtttcctacatgtgtatgtcaggctagggtgagcaaagcagattcagtgtctccctaccctaaacttagtgcaggagaggatagagacaatggaacaggtgcatgtgcgtgtgagtatgtgtatgtgtgattgtgtgcgtatgtgtgtgagtgtatgcatgcgtgtgtgtatgtgtgtgtgagtgtgtgatgggaggtaggtgctaacagggagagtcttgagaaatggatactagggtcacctaacagggtcctgaggggtcaggaaagcttcatagaggaagtgactcttacctccttgagcagatataagcaacctgaggccaggggttgtgctttctagggcctcagaacaccagcatcgtcaacaggtgagtgcctgccatttatatgaggccctgggtt

SEQ ID NO: 51252 - DNA, 1090 bp, Homo sapiens
cttatcctcctagcaacgcggccctctcggctcttaaggcgtgacttgccatggatgttctgcctttggaaccagtgggtggtcacagcacagaggctgttggtttcatggctgtcacatgcacagagacagccctgtccactgagcctgttctgtggcagaaggaaccccctagcctggaccatctttgggtggaaacaccagcccctcacgtctgactgtcattttcagatgtgaagagaacacacagtgttgctgatgtgtttgtattgcctgtaaacaacgaagagtttctttgacttcttaactgccttaaagctagaagcccggcattaggatggcagtggtggtaatgaggttatgttttgagacttggcctcattagaagtgatgttctttatttgggcacttaggccacatataaaaaaaaaagaaagcacctcttttaaaataggaatgatattgtagttactgcattaggaattaacagggcatgaaataactgtctgccctgtggcaatgccagatcatttcagctccgcttgcagccataagataaattggtatcttgcttgcagccactggaaaacattttaaatagccagccatgaacatgtatggtgcccaaatcaagtttgaaaaacagcaataaatagataaagtggaggtaaggtgcctaatgaaatgaatgaggggcaggagctcacagaaggcaaacaaaccagcagggaggcgctgcgtgtttcacatacaatacgtatttctacttttagtaaaaaatcatgtgtctcacgaacagaaaacccaacaccgcatgttctcactcataagtgggagatgaacactgagaagacatgggcacagggaggggaacatcacatacctgggcctgtcagggagtcgggggctaggagagggagagcattaggagaaatacctaatgtagatgacaggttgatgggtgcagcgaaccactgtggcgcgtgtatacctatgtaacaaaactgcatgttctgcacatgtacgccagagcttaaagtacaattaaaataaaaaaataaaaaattataataataagaaaattaaatta

SEQ ID NO: 51253 - DNA, 1094 bp, Homo sapiens
gtgggcagttctgccctcaaccaagtactcacagggtacctccaggcagacttctagggcctactttctgcacaagattcttctctccagagcccagacctgtaagttctagctgctttagcagccccaaactcttgatttttgccttctcctataatctaggctgctgtgccccatcgtcctgcataatgggccaaaaggctgggcaaacatggggcttatcttgtgtgttttttttctggcagaaccacagtcctgaactgcctgttgtacaatccctacaaagagtagcctcagatatttttgtctagtttcatgattgtttacagcaggagggcaaatccaatcctagtcacttcattgtggcaggaatcaatatctatttggtttaatgtttaccattccttcccattccctataccagctcatcacccttgtcagcggcagttctatatatgtttgtagtcctttcagttgaaataaaattgagtcaaacaatttataatctgaaatgaacaaagaccatgtaaattcttttcagttgcctttttaggctggtatctgtctgtagaggactcccagggaaggattctcaaggaagactcaatgggaagcctttggatggcaagctacagggctgagtacgagggtggccttcctgtgcggggtgtaggattagcatcagagaaacaaatcaggaatccctgggtataacagtaggggctgcattgtcattttagccttctccagagatgcatgatccaccccccaccccgcaggtcttttcctctctatgaaagtcactgacaagttcctgtggatcccctggggtccccaggaatgtatttctactctgagggccagtgagtatctttttcttggccatgagccatgaatagaaacgggacccttaatactgcctgacctgccacatgcagccctctcttctgggactgtctacacaagtacatttccaccatctacaggggcggaattccggtcatttgctacaggggaaattctagatttttgtttctaaagggccccaggttaccaaggtctcttgtatattagaattttaccacttctctctg

SEQ ID NO: 51254 - DNA, 1035 bp, Homo sapiens
tagcatgcttgaaagaaagggggtgggggaagatgacggcaaggctgacgtcagggcccagtgtgccagtgcagaagcagggaggccccatccctggctggaaatttactgcagctcagagaacaggcctgtgttcctccaaataaggcagaaattttcctgcattgctagttgtacaaacacagggaggcactgagcagtggcaggtggcacttggagattttctgaatttcaggcattgggtcagcccgtaaaggcttccctggggtatggtggacttggtcagtgactggttggctggaagtctctctcctgggtggttacctggtatataatgaataaaatatagcactggacaacttaacagggaatgggaggcgaaggccagtgagtttcacagccattttcaggggatatttacaagggacccttaccttggttaaagaaaaatgtaatgtgaccagagctacgtatttctgatttttcgcctccatcttggtatccaatgaatcacagctaatatgagctctgactgtatgaaaggggttttcttagttgaccactcagctgagagagctaccaaatcagaattccacaggagaggatggttgggttcctcagctattttggaggatgacataaaatgttgcagagggagaacccttctctgcaatcagacgagattttcctcattgttctgcagggcctcacatgttaccaatgaaagccagctccctggtgccacgcgttttactcattgctggatccctagggcctagcacagtgcctggaacatgcacgtgcctctgggcatattcagtgaatgaatgaacaagggaatggaggtgggtgaaggtggactgctagggaaaccgggaacatatgaaggcagcacgaaatcgtgtgtgttggggtgaaaatggacgactggagtctcagcttattgaattgtgggtaatgttcattcaactagtcagtcaaaggatattttgggaaacttcttataccagatacatttcttgccttcatggagtc

SEQ ID NO: 51255 - DNA, 1028 bp, Homo sapiens
agaggaaaaaacgtgaagtgatgaaggcagagagtggaatgatgcaactcaagccaaggaatgccaagtgttgccagcaagcacctgaaacgagataagaaaagattctccctcacagccttcagagagaacatggccctgccagcaccttgatttcagacttaagacttccagaactgtgagagaatatgtttctgttgctgtcatcacccaagtttgtggcactttgttatggcagccccaagaaactaatacaatgagggagtgagtaggaaagaacatcagaatcagccctgaggcttgtcagggacataggaggtccaggaaagcaggtagagaagatatgaccatgaggtaggaaggacccctcaggagaagtgcactgtgacagccaagcgaacaaaaaaggatgaagaaggaggaggtgatatgctgtcttcaggtcacattcaaagagccctgagaactggccattgattcagcaatgaggaggtttttgacaaaagtagttaagtggataggcgggggggaaagtctgttggagttgatttaaaagagaccaggaggaggccgggcgcagtggctcacgcttgtaatcccagcactttgggaggccgaggcaggcggatcacgaggtcaggagatcgagaccacggtgaaaccctgtctctactaaaaatacaaaaaaaattagccaggcttggtggtgggcgcctgtagtcccagctacttggagaggctgaggcaggagaatggcatgaacccgggagacggagcttgcagtgagccgagatcacgccactgcactccagcctgggcaacagagtgagactccatctcaaaaaaaaaaaaaaaaaaagaaaaaagaccaggaggaaagaaatgggagacaagtaagtaaagatgtctgtttttagggataactgcaaggaaagcaaaggaataaggtggtagtgttggagacatgaggagaaggtttttttaagattgaagaaatagcagcatgtttccctgcaggttggaatgat

SEQ ID NO: 51256 - DNA, 1030 bp, Homo sapiens
gaagagggcttgtttggcagcacagcttttgtgtgtgtgtgtgtggggggggggggggggggtgggggtggggggtgtcagaccccgaggctacccttctggggttttgtttagattcttctgtgcaagttcccaccaagttttcagtgagttagactttcagggtaatcccggtttgccttgcaaagctgaggaaatgaggaatgtcatgggtatcaatatctttcctgagaactgaaatttaccagtagcacattcctatcgggcatttatcaaaacaaacatataggtcaaatgaccgtttactcagcagccacctgtcagtgccttgggacgtcagcagtcccggggatgcccgtcaaagcagctgagtgatctcggccctgaacattgccaacttcccgcctgatgccctggagctgaggctccagcttgaggcttcccagtgctttggataaaaagatgggtctgcacctgagagccatatacatctcgctctggggagaaaacccaggcagggctttcacacagaggaagagtgaggccaggatttatactcagagaggatgggcaaatagcattcacgcgtgtgtcctccagggtggaatctgccaggctgacttacagtgcaggaattttgccagtcagtggaggtagatgtgtttatagataacgttaaaaaaaaaaaaaaaggcaaaaaccaagacctctgcaaccttggtatttgaaacacagaacacgggtttgtgtactaagtaaaatgtggttaaataagattaatctattgatggtggggaagagagcctgtaaggcagattgggtgtctcagaggcataattatttatcaaactaattaaaatgtaaccaccggctcatcgactctggaaaccggctttcctgcccaagaagcagccctctcctgagcacctgtgattttatttttcattcattatcccactgaaacacaaaacaaagacccaaattggccacctggagtggccgctctcaccctctgcctggccatggcctg

SEQ ID NO: 51257 - DNA, 1019 bp, Homo sapiens
tgtatttccaaatcaggtcccattcataggctctgaggttaggatgtggacgtatgttttggggtgccataatttattcagcttaggaggacagtggtttgatacaccgtgtagaggactggacctcacagcaaggccgtgggacagaggcagctctggcgagggactgaccaggggctgtgctcactcgcagggcctctggtgtctctgcctccactctgcatgcctacctctctgtcttctcactgccccccagctttgtgttccctctggtgtcccctttctcttcgtcttgtggcctctggttctcacgccttgcctcaattcctcctggcccagcttcagcgttctggccttggtctcgacgacttcttggctgcagtttctgctgctgactgcctcattcccatgcccatgctgtttcccagttgggttcctgagcaaggaggtcgtgccagtcatgcctgtcttctcacatgggcacagatgacaccccgccaggccaaccttggattgatggtcctgggggtcgtggggcccactcgtggtccagacagcaggatggggctgtggtacgaagcataaccacctccacctggcccttggaaggtgcaggaacatggcagaaacagggtaaaggttcggccgcctacaaaggcgactgcgtggtccctgcaggagaacttccagggcgaggatccaactaagtggaattgtcaaattgtcagttaactgaagtatttccagtttgagaggagagagcaagagataataggaacctggagaaaaagcagccacagggggtgttcggcttcaatccaggtccgttcaccccttacgttcaaaacagcaaatttcaggaatgccacagtccgttaagcatcaaagagagatggggccacccacgttcactgtattacgaccctcattagacagaaaaggacgtctgtgattgaggaaagattttccaacgacatccctcagttgcccatcaaagttgcctacttctcatttcctca

SEQ ID NO: 51258 - DNA, 1040 bp, Homo sapiens
atgataacattgagctcttcccaccccactgatgtgtctttgatggcacagctgtggatatttttatttgcccagtcaagtcggctcctcggtgcacatgtctgaagtgaaggcccttgggtctgcaagctgcagagggcactggcgccagccttgtgcgttgacaggagactgcaggaacccgccagcttggttgctggcttcctgagctctgtctgtgggttccctccctggaatggacaagggggagcagccgatttctgatacagctcatctgtctgggtcactggttccagaagttaattttggatggaacttcacaggcacctggcgtctggttatgcaaaacctgacctttggcttcactctggggccttcccttctcctcaccccagggctcctgctgcctccctctctgtgccattctttcctcttaaaaaaaaatatcctgctgacaggagctttctaacttgtcattttggagatcatcaacaaattctatagagaggtgacctccattatgagaaagagacggggagttggctgggacccaagccaaggagctggagcctcttttgactggcaaggtgacattgagtgtcatatcagcattcatggccagctctcttctcctcagagagtaattatttctttcagagcgaaaggtccaatttgctgtaaagaacagagccccaggtaaaacgaaagagctataagctcccctgacataaaggagaccagactgcccccgtccccagccctgctcactccacatcataatggccatttggccagatttattatgtttacttgtacttccttcctgtcataacacattagggtggttgcacattgcatgggtgaggccggctcagcaggtggagctgaacaccttgcagctgacactggctcttgtatccttggccagcacctggctctgggcagggattgagatggcacctttggagaaacactgggagagctgatgcctggcatttggggccaagctgagctctgggccctctgcactctcctggtat

SEQ ID NO: 51259 - DNA, 1007 bp, Homo sapiens
agggaggccaaataaatatttcaaggtcacctaagggctcccttgggtcttgtttatttatagcatcctggccacctccatctagaaatgtttcaaagtgcagaagtatgaatagtaagaaggcagctcttcatttatttatttggttatgaatgtatttattttcgctgtctctgccaactcgaagggcctgggcataactggccagcacatggccctgctctggcccttggcatctgcctgcttgctcagggagcatctaagtggaactctgcattgcatttagtcctcagctgcaaaaaggaagctagttagctccagggggctcgcgaggagactgtacctgccaccacacatacacgtgagccaaggtgtgctgtcatcctggagaccctggcccaattccctggagcatctatggagacagagtataagcagtgcctaatttagtgagtccagcagtgtggacgttccataccagtgaactcatgcagcagaaggggtcagtattagctgggcttcattgtcctccctctattcctggatgataccgccctcctaagaggtaagtgtcatcacacccatttcatactagagactggaagagatcaaaattgtagccccaggttgtgaacatggaggatggtggagctaggacttgaacctggctctgtccgacgtcttcccctgtctcaacactggtgtctcttttgccctggagatggaagccaatggtactgtctgcccaggattggttaacatttgtccccagcccttgcctatgtgagcaaaatgacctctcagataggctgctccctgggagctagtctgtcctcagcctgtgtccaaaggctctaatggatgagatcacagaccggatcacagattcggatctgtctggaagtgctggacccctgctgcatgtccattctgaaaagtgctctgcccaggcaagatggcactcaagctccactctacattaatttaattaatacaattaatttaga

SEQ ID NO: 51260 - DNA, 1048 bp, Homo sapiens
atggtgaccatggtggtgaatctgctgctgctgctcatcaggaggatgatgatgatggtggaggtgacagtgataataacgatggtgatggtgatgacagcgataacatggatgatggtgattttggtggtggtgatgatgatggtggtgaacctgctgccgatgatgatgatgggtatgaggatgacgatgatggggatgatggtggaggtgatggtgacagggatcttgatatgtttctaccattttgaggctccatgaggatccatggcttcaggtcttggcaagcctctctgttacctgaccagggccgggacatagaataacctgccccttccctctcattctctgcatgttcacccacagggaagcctgctggagaggcctctatttctgccctgtgggccagtaaaggcaccaagtaaaatctttgctaaatccctgcacttccaaggctcgccatctgtttcctattagagtctcatgcatccctttgacatatttttattgtcaggttagaagaaaatattccactcatttgcaacattctcattatattccctttataacaatttctaaaagagaataaatataaaatatttctctgtattgtggagatatttcagcctgactttaatatgctgcatagttttccaactcacaattcttctaaccttgtgatgacagttaagaaatcttcaggctggggaaaacatgtggatcaatgagttagtggaagtgcaggacactttatgaggactcagggagagcggctttctgccgactcagagatgccttctcagccttttgagaataaactgttccaacagtcccaaagtctctttcccttgggccatttctaagaactcagagatgtctcctttgagatcgatcagcagctgggtcctcaaggagcctggccaggaagcttggtttgaaagggcaaaagtggaaacccttgtccacagcctctgagtaagcctggctgctccaggtggcagtcacgactgaccctaccccagaggacccagtcaaagggcatccagat

SEQ ID NO: 51261 - DNA, 1029 bp, Homo sapiens
ctcctggctgaattggcctcttctactgttttgctaaatatttaaagaccccttattaaaagagttaccatcttaaaaatgtcagatcttcatctgtcatgtccttcctctggagtgtggcctcagggctgtatccaagcaccccagaaacagaaaccctctttgccctgggccccaggatcatttcaagtggtttctgaggacccactctgtacccagcactgtggctgcccgagcatctgcctctccagccacagtagcttctgccacgtgatgggctggcaccagcctgagcaggtctcagggaatatggtgaggaggcagcttgggctgcagtacgtggccatagtgcactctgcccagcccaaggttctgtttgctgcttccctcctccctgggcaccaggctgggctggaggcagagaagctaaggacagcccagcctagggagtgaggaagcaggaagtgaagccctgagccacggcaaggtcttggccctgctgatgatgttgggcaagcagagggtcatgggggcaccgagcaagaagcatccacttctgcctggaggaattagagccagattagaggagaagctgttgtaggattaggatgagaattaggtctttgagcagcacctaaaaggtgaataccagttcactggacatagaaatgggggtttcccccaaccctctaaaaacaaagaaaaccagacaacacaaagacatacaggttcaaagacttgttcaacaagcaattgagcacctactgtatgccaggaaccatgccaggccctgagaatatagaactgagtgtgacatgttcctgcttcccgtaaaatttgcccgcctagctggggaaatagactaaaaacagcccatgatgtggaatcaaatgtgctgtaataaaagcggttgcagctgcctccctagcacggggtaggaggtgggggatggggtgggggttacctctgtgcctcaggtgggaggtgggaggggtgcctcaaggggaggtgatgtctaagcaggttttg

SEQ ID NO: 51262 - DNA, 1049 bp, Homo sapiens
tctctcagccccctgcagggggtgagccttctagaaaggtaagggcattggaggaaagagggaggaaggaaaggaagaagtgcttctggaaaaaggagactttctccaaggaatagcacccactgccccacctttgtagcctcagttcagtggccgcctcctgccggcccactgtgaactcgctcctgccctctgagatgctccagctgatgtcacccaaggccacttagcacttagtgggcacgtctgcctatgttggcctcgattttcctctccaactagtcagctcccaagggagagacatgaattcctgtctcccctgagtgcccagcccagagccacagccaccacagggcaggagccagcatttgggagagccatgttctgctgtggtgacgtatccaccccggggcgggaatgagcaggcctcgcagactcggggcctggagctcaggattggtgccaagatttacagagaagggcctgagttgacgtggcacgtaagcttctgagtcatcgggctttcaggggagggtgctacctctctgtctgtgtctgtctgtctgtctttcaggctctctgtctctctctgcgtctctctctgtcatgttctccctccccatctctccattgctgacaaatattctattaggctatgagcgaggagacgggcagggagcctctcacaggcagggcactagagcccatgtggcccataggctcataaagccattggcatgaccagtaaccaccatgtgaggtcaccaggacagctggggagggaccagatgacctgagctcagcccactccagctgggcagggccagagccatgacctggaagaggccacctcttcccctctgctggtggcacccatcctcagcattgctgggggctctgtgtcacagctgacagggccttcaggctcccctgagcctacccagtgcattttctagaaggatttctgagacccagcgagagcagggccaggcccaggtcacccagtgggtcaggggaggagcaggcagtgctccgttctcccgatgcct

SEQ ID NO: 51263 - DNA, 1065 bp, Homo sapiens
cattatcctctctgagaaaagtcactgggcattttctagaagattccctcttcccgattccttccttcacccctccccgcctctggggactgggcgacaggaggacatccagtcggctttctcagagggtccccttgcaggccccattgctcacccttcaccttgcagactgcggcggccaacgtctgctatgtggccagagccctctggggaggggcaccctctgctcccgccgtgtggacgagtgggtactgagtacaggggagacctcggggcatcaggaaagtcttcctcctggccacctatgtgggaccaccagagccaaaggttttgaattcatcaccacccttatgagccaagtgactctggccaactgaatcaacttctttgaaccttatttcctttttggtaaaataaaataaaatacctccctcctgagctgaatgggaagatgaattgagctaagacacacagaggtcttttggactcggcagccccctgggaagtggtggctgttttcaccccaccaggaccctttccagcagcttttactctaggggattggacgggtggaatagcagtggtcggggaagggggtcccctgagaaggtcctatccaacccagtttgcaaatggcaaaatgctaggcttgtgagatgcaactgtgattaggaacaaaactcacttgttccgcagcctcaggcgggaatctggtgtctggctgagtgagatggaagctctgccttctggcacttgtctcctgtgtgccaccctccccgagcctctctgctccacaccatcccctgtgactgccaccaggacctctcctggcctggcctgccgacgctcctctgtccctcagcccttagggactgggctgcccaggcttgactgggagagaggaaggatgaagcttccggagccgcagttccttagagatggaaattattaattagtcttattatccagaacttgtcagtctcttaatccttccgtcggcagaggggtttatgcctccacagcgtgtgctgtcagcttggctaaacaatcgcttttcatatacag

SEQ ID NO: 51264 - DNA, 1087 bp, Homo sapiens
gggttgtcctgatgcagccgcaaggtcaggccctgggtgttcacactgacctgggttctaatcccccttcttcaaccacgtggagctgtgtcacctcgggctaattaacccaaaaccaggggctcagtttcctcatccgcagaatttttaaagcactttgcacagggtcggacatagaccagcattcagataacaatcgtggccgggcacggtggctcacgcctgtaatcccagcactttgggaggccaaggcaggtggatcacaaggtcaggagatcaagaccatcctggctaacacggtgaaatcccgtctctactaaaaatataaaaaattagccaggcatggtggtggacacctgtagtcccaactactcaggaggctgaggcaggagaatggcatgaacctgggaggcggagcttgcagtgagctgagatcgcaccactgcactccaacctgggcgacagagcgagactatgtctcagaaaaaaaaaaaatcgtggctgttgtcatgaccgttgtgttgttacaaaaccacgtgataacccctgatagagccgcccgtgctgagctgggcccacaaagaccccgtcctaggctctctcccctctctggccatcagttgagttgtacactgtgacccaccaggccactgcttccagcattcacagccaaagaccttggccaagcaccggcccacgctcaccatgggccatgcctgccctggtgactctgggaatgtccccagagctgcccggacctggatccagccccttctgttgcctccaaaaggcttggattcagaattccacaggaggatcttctctggctgcccatccccagtcccccaccctttcctggccaatggcctccctgtgtcccctgatgtctgagcctgaaagccacggcccttgtgcgcgcattacatagctgcagttgccagttgtcacccatgtctccatcgtgcctcgtctctcagggtgtgtcagagcagtcactcccactgccttaggggagacaagaaggaagccccatcccaccaccctcctgacagccactcgtgctccctgccacatgctgctctcagct

SEQ ID NO: 51265 - DNA, 1015 bp, Homo sapiens
taaacgctgacaaaggtagagtgggccaagcatccctggcagcccccagaggtgacatggcagcccccagaggtgacattccagcccccgtcatcgtgtgtattaagtgacagggctcataaaaccccacagctcctttccccaccccttgcagtctggctcccagaggggcagatagttggagattctcatgcaaaataaattgctctgcactttcattaaaaagtaactgcaactgactcagcactttcagggtgagcggcagggaggggctttgtggcaaaatcaaaggacggggaggaggtgcctgcccctgggttcactctgcgtccctgccgctgcagcctgccctttgctgtgggttcggtttctctgcatcctagtcccaagtctgtgaccattgggtgtccttaaacaggcagctggagatcccagaatttggatcatgattttactggagctgggcaggccttgacaggggctctagcccagggttccctattctggaacaaaactaggaccgggcagggctgctgggggcagggacggggctgggacaccggcccctgggtccagcgagtgtgtgaagggctgcctccatggtgcactgggctgaggtgtggacgcagggctttctgcacggcaggcgcgacgctcatttaaatagcagatccgaccaaggccttccctctgctccacccgcggagtgctgccccgctgcctgcagcctgaagccctaaccctctaaagagtcccctgagctactcccagggatcccagctggccaaggtctcactgaccccaggcatcaactctggtggctcctgcccccattgatctctcgtccccctccctgcccacatcttcctcgtccctctgccatctcaagacatcacctgctccagagagcgtcctggaccaagcatggtcaggaagccctcggcttaggcaggggctccctgtccagtcaggtagcagcctctgagcaggcagcaggtgacattcatctgcagct

SEQ ID NO: 51266 - DNA, 1058 bp, Homo sapiens
tttccagccaaagccttgaaaacgagggagacgataaacagtacagagtcagtctttggggcagaggccccaagccagggagaaagctgacgtcttttccaaaggtgcagagttgagagcctggagccgcacacaaagcaggataaagaggagtgggcatagaattgggaaaagagggcctcccgatcctagaaagtggttctcctgggtggggagctgctgaggcttggcacagggtggaatctggtctggcttgggaggtgatataggctgagatgccatctctccactgaccactcagctaacaccttcttgagttacaggcactagagatatggagatggaagaagagagagtcagtgtcctcagggtcgaggtgaagaagacagatgatgtgccagtgtgatgtgatcaaggccagccaaaatgacaacatgggatgaaggtatgatgatggcccccaaggaacctgcccaggctgctgtgggagcaccacatcttagaagcagactcaagtccatctgggtaattcaggagctcccactgtgtgcatggtacaggggtgacttcttgtccagagcatgctaagaactaatgtcgatctgtgccaggccttgggctgcaggctttgagtagcttcctgtgttgaattctcctaagaaccttattgtgatcagccccaccttagagctgaggaaatgggctcttggaagttggggaccccgattctccattcactggactatttcacaatcaagaagatcggggacccaagagcaaattcctctgaggaacaggaatcctggtcctctggaaatagtaccttagaccttatgtgtatgcatgggggtgggggggtgggtgtgcatgaccaaagtccttcaggtgaccctaccattgagacatctggcacccctgctgtgtcctttcctgggtgtctaagtgtctgcttagcagggaaaggggctgctctgagattgaggacctcatcagctttgaggccttatttgctttgctgatatgctggccctagagcctgagggtagaggactcaaatt

SEQ ID NO: 51267 - DNA, 1032 bp, Homo sapiens
gacaacgcagaaccctgcctatgcgatttctgggaccccatctgagcttagtgggaaagagtgccatccgccatggttccagtgcagaattccaagggccaagatggggagtagggatttgtgtatgagtggttggttggaacaaatcatcctggtataccactgctcccacaggtggaaacagagaaactgggttaaaatgaagactccagtaaattcgcatgcagaagtacccagaaaggcccttgccatgtccttcactctgccttggtgaaggtggaagagatgaagggagagggtgatgggtgggtggtgggtgtgctggccaccgactggcacagcccccagcacaggggctgtctctagtgaccgatccaggatgagtgtccccattcagatgcagtcaacccaccactgattcaaccaacacttgctgactgcctatcagggaatacatttccttctgatgcacactctgctctcaggaagtctggggtccagagagggaatggaggtgccagccagcctgaagatcagtggaaagagtgaggctggctgatgctgcaggagagacacagaggactgtcaggggagtcccaaagggaatgaaattattttggttggaaggataaagggaggctggaaggacagtgtgacgttggatctgggtcttgacaagtaggtggaatgtggagagattccaggccttgggaacagcgtgggcagggccagtggcagagcaggctgaatggtctggttgactgagccaagaggggtgagaagggtgcatgggaggtggatccagccgatcatggaggccattgggatcaggagtggggttgcattcacaggaaatggggagccaggaaaggttagcagtgggtgacgtcatcagagctgggacttgggaagatggctctgagagttggatgggagtgcctggctcaaaggcagaccagtcaggaggctgatgccaaggagcatggggaaggcagtgaggggagactggggcggtggcctcaagggccaaga

SEQ ID NO: 51268 - DNA, 1056 bp, Homo sapiens
ctccagagtgggggaacccgtattcttagctttcatggatctagagttagaagcaactttcacctcttctcccctttctgaagactcgaatcacatttcctctccactgttatctttctggaccggaaagcccttatcttcattttcctggagctgcctgcccctcctcagttggtgctccctcacccctgcactccctagttcagacccagctctgcagcaaggacgcctcggccattctgtctccagttcccaggtcctgccctcctctccaggctgggccctttctggtccctgcaacaactgtggaccagtggcttctgtggatcctgggaggtcctctctcggggggcctggcagtggcagctcgagctgccagcctccgttgccaatttgctttactcatcctgagcctctcgccctgcacgtcactgccctgggatacatctgtagctcccataccctctgacactggctctttttcgttactcattaaaatttagtgtcatctgcaaacgtggagattttatcggacatgtcttcccccgggtcatttataatgattttaaataaggccagcccgggcccccacgcatacgtgctgttgggcagccaggtcttgctgcgcaatgaaaagtcctcccctcccgggcagcgcccctccaggatggcttgacccccctctcagcctttgggtgggactgtttcagaggcctctggaaagtgcaggcagacgggaccctctgtcccctcttgaggtacatgcatctttatctgctcagcgagagtggagaactcccttcatccagcattctctgggtgtctaggatgtgcccaggattgtgtcaggcatgatctcccaccataaatgtgtttttcctacactacctttgggctaaaggaggcagggcaagccagcccctgagccggcatggttcccggaaccccgcaccaggtggaaattgtttaactatattcccatgactggaaaattctggtaattgtgtaacagcagcagcactcagcaattacccagggtttttcatcttcagacca

SEQ ID NO: 51269 - DNA, 1031 bp, Homo sapiens
gtgcagctgatgggaccccggcccggcgggagtggcggggagggcactgtggaattaaacagtgcacccatcatctgctgccagaatgcgacttgcctggcctataaatagatgccacttcctgtacctggttctcgcctggctaaggaccagggcagggctgcttaggtctgctctcagttatctgacccctctacagaaaaagaaaggctgggctttgtgtggccccggggctggagtcagccacactcgggtccatcccagatcagccagaaaccatccctgttgctggagctcagtgcctgacctctctgggcctcagtttctacagctctgaaaactgcctgccagcagggcgagagcagtgagtgagaggaggtgtgtgaagcacctggcccagtgctccattcctgaagggttcccattaaggaggccttcgctcttcctttcccaagggggagttcggagagggtaccagggcagtttgggtctcaacaggcagttctcctggtcctggggcatttctgggtccccagagatggcaggtagagtctctgcccaggccactcaccctcctagctgttcaggctcattatatgagccataatgtgtctcggaccaagggaccaggagccacaaggctcaaggcacactgagagctgggactcccctgctagagccagcactctgtcttcagctaactccacaaagggggcctcctttggacatctctgctttgaggcccaaattggaacacattgctctgtaaaacagcactggatgtattaattcattcattcatttcttcatttgccaaataacttttgagtagcccctgcttgctctgcacagagtaggggcctggaatggagcaaacaataagacccagcttctcaccgggcccctgatcgtaaggggctctcggtccagggaggagtgcagtgcgcaaatgaatcactgctccggagatgacgctggctgcttggggacctcatctttgggtctccccagaggaatctgaggctgagctc

SEQ ID NO: 51270 - DNA, 1059 bp, Homo sapiens
gggggaaggggagccacccaactgcttcatgacagacacaccccgggacctcggccaccccaggcccctcgagatgggcctgccgccaagctgggcacctgctccctagctgcccccccccccagaactttgagctctgaactctgtgggcctccaagttgaaataagcacccctgcacctgcaggatacacaggagggtgacaggaattggggcggcgatgacatcaaggcctgggcgtccagcagcatcgcctctgttaccaccagccagggcacagctaggggaacagtagctccgcagcttggacccccagctcagagcgccctgctgaaccagaggggaccagcctggggtccacctcggcccaggggccctgcagagagcagatcagggccctgaaggacgctttcctttggtctgggccagttgtcctttcaaggaatgagtgggaggcagggacagaggaactgccagaccccacctggctggggagaagcgggtcttccctggctattctttttccccctaaatgaatacaaggcactcacccacccaagggcccagccttcccagcctttcaccagcttgataaatactaagggaggggaggggaagcagcgccgcagtcgcagcgcaaagggggccgcgggaacagctagtcgggagcgcgggggtcccgggcctctggccagccacggggcctggccatgaactttgcgtccgggccaatgctgcagtggccgggcggtggtgagccttccgttccccgcctgtccctcccggcccctcccctcggtctccgcagcttctcggctcagcccctcccgtccccgcgggcgctgggccgattctccctccgcgctggccaggccgtggagacgggttcgccgcggagaggggaggagggctggggaaggggtgggcgccaggggactgcagcgcggagcaaactggggcacggctgccggcggcgcgcgtgcacacactctctcccacgcgcgcgccctcccgccgacgcgcagccgcaatgcggggcccttcgcggaactgctggcgg

SEQ ID NO: 51271 - DNA, 1146 bp, Homo sapiens
ggggggcgtgggtccggggcgcagagaacacgcgcgcgcgcgcgcgcgccagcagcagcagcagcagcagctgctgcggcgaagtctttgtccccgcggcgcagcctttgtccccgcggcgtagcttttgtttgcgcagccccgccctgcggagggcgatcgtccccacgttggggccggggggcagggacccgacgtccccaaaatctcagctggggcgcagccatcctgggagagaccgggcgtggagatgggggaaggtgggaggaggaatcgcagccttctggatcccggagctgcagcgcctcccccagacctaggggtcttcccctcccttcccctgcgccccactgtgagctccagggtcaaaggccctgtctgctggacccccatcacttagcccagggttggcacgtggtgggctgcagtacatatttgtgatatgaatgcaggcacacgtgaatgagtgcaggagggactgtcaaaaagctgaatccaactagtggtaaggaaggtttcacagaggaaacgacccccttggtgagacctgaagcctgagcagggttagcccgggaagagggggcatcaagggtggcaggagagggaatgagcggctgcctttaacccagggtcttcgggaactgccgttttcaccatttctcctccacccacaaaggtgcggattcagaacaaatttcctctgtcctgacctgaccccaggccatttgcacaggaccccagggaggtctgagcaggccagctcttcatacaaagatgcaagggggacctcttccaggctagaggtaggcaggcaatggggtttaccctggagacccactggggaggatctctgggaaatgtcacttatacctgtgataggtcctatggatacaacagccagggccgtgctgaacttcaagaggatgctgtctgtgtagatttggcctcgcctgtgcctgtgtttacaaagagaataaacccaggcagttcaacactgcagccctggagctgaggggatggggcgggccctcttctggccaaggacactgggacacctttaagtgacctgggtccctagaagagaaggtgagcggaatttttgtgtgcctctttcttgtcttacagcatctgattctcccccaaggc

SEQ ID NO: 51272 - DNA, 1074 bp, Homo sapiens
ggcaaatggtgccctgcggagaaatggcctttaggaggaagcttgcctctcagcaaaggccgaggggcagcctttgccaccctgtcctggccgttggggcaggaagcaaagttgactctgtggaggacgccccaggactcgggcagatgcaggctcctctcccaggattggcttccctgccacctgcgggccagatggctccttccagagtgtgcatgactatggcagctcagaccctccaggggtcaagatcagccagctgttcctgtgactgccagacaaatgcccaccaactggctggcttcacacagagatgtgctctcacggctgtggagactggaagccagagttcaaggtcccagagagccgtgcccccaccaaaggcgctagggagggaccctctctggccacttgcagctctggtggctgctgatcatcgttatggatccatggcttgtggcaacagaaccccagtctctgcctgcactgtcctccctctgcgtgtgtctgtgtccctactttcttttaaggacaccagtcattggattaaggccaaccccatccggtgtgaacccgtcttaatgaattactaattacatttgtaatttactaattacaaagactccatttccaaatcaagtcccattctgaggttccctgtagacatgagcatttgaggaacactgttcaatgcagggctccatatcttgtaggcttagtccccagggcatggtcctgggcatgatcccagccgtcaggcctcactgaaggcaaaactgacccccagaaaataccagaagcctcctgagggtttgttgtgcacggggttctgccctaggtgttgtgagaagcgcagtgaagaagccgcgcaggttaggctccggggactccgcggtgtcggggagttcacaggcaccgtcccgcggtcacaggtggcatgttttgaggagttcgcaggcaccgtcccgtggtcacaggtggcgtgttttgaggagttcgcaggcaccgtcctgcggtcacaggtggtgtgttttgaggagttcgcaggcaccgtcctgaggtcacaggtggtgt

SEQ ID NO: 51273 - DNA, 1005 bp, Homo sapiens
tccgttcgggcaagaggcgattgtggctctgacaaggccggaacaatgactcctgagggacagggtgggtttggggttgtttggaggtgaagtgaagggctctgctgatgatttgaatatgaagaacgagagaggacaatgagtaataatgcctagatttggggcttcaaccaccggaggaacagcaaaccatttcctgagatggagaagtctgaagaagcagcaaacccaaggggataggggaatctagtgttcagttttggtcacgttacagctgacaacctcattagagatgcggggttcacattgcggtctgaaagtctggaggccaatgagagatccagaatggagatgacgtttaggagtcctccgcgtgcagatggcgtttagcgccctaggtctgagcacgaagactccgtgaaacagcacagatgaagcagaggagaggctgcaggatcaagcacaggctaccctggtatgaggacaccaagcagaggaggagctggccaaggagggagggggacagccagtgcaacggagggaaaccagcaggatgtgacccatggaggctaagaaacgaaggtgtttcaaaaaaaaggacgtggtcaggcaggtcagatgccaagcagggagctgggtaagagccctccaagcagggggaggtgggtaggaaggtcctgaggcaagagggagctccacggatttgcagaattcagagaagtggctggaaaatccaggtgacacggcaccatacctgtctctgagctcagagtcacagccttccacagtgtggggtcagatgagaaagggcaggagcctcctggactcttgcctggcccaggagatcgcgtgcctcccactgccccatccactgctcgttcagcagaaggcaaggccccgtcccctgcttttcccatcttgcacctctggtgttggtcttgccaaccttttgataggtccgtgggccccaggagggcagcttctgtgtccctgggctcgtggaga

SEQ ID NO: 51274 - DNA, 1094 bp, Homo sapiens
ctgcatcgattggtcttgagacacatggcagacttctgagccaccaggattgtttctttcagcaaaacaccttctggcacagagttgccaccaggagggacagcagctgacatctgcacatgcaccacctgccaggacctggccatgaagtactgatgtgtacccatgtgtagtgactcactgagactttccggcaacccgtgaggcccctgttccacagatggggatgctcagacaacagtgagtgggtggcgcagagagtcacacacagcagtgcgaccccatcatccgctcttgacctctatgccatgtgaggcttctggagcctcttcctgttgcacctgcactactttggagctgcctcccagggctagagcctgtccttgcttcccggttattcacgacaaccgtcagtggagtacccgttaggtgccaggcactgcgtcacgtgatgagtatcagaagaaatggatcagatgaggacctgcagtcaacgagcttcccgtccaggggaggaaacatccgaactgaccacctgtcttcgcacaaacaagcatttggggaccttatgatggaggatggtgacttctcgaggaggtctgggagggatttcttgaagaaatgacccccaaaccaagagctgaacgatgagcacaagttaactccctgaagagagaaggcaaacattccaggccgcaggaatggcacgcgcagaaactctgtggtgggagggagccatgaagccagtgaggcagaggggcaggcagtgaatcaggccacaggggctggagggaccctcagagccagggctgtgtgtgccaggctttatccccaaggagaggaaagccactgagggctcgagaggcagggacgtgaccaagttggcttctgaagaagcgcacatggcagccacatggagaacagattgaaggaggctcagagagggtgaggggagaccaggaaatcatcctggctagagatgatggtaacttggcagttctgggggcacagggacagtgtgagagccaccgaggagatggcatcaggaggtcttgtgggtggattcactatggaggctccatgtcattcacctt

SEQ ID NO: 51275 - DNA, 1059 bp, Homo sapiens
gtctctgtcctgcagacggcacccctggctcaagcaatgctctcctctcggtcaagtgtcctcccaatggctccatttgctgtgcggggttgtaaacggctccattttaagccaccagctccctccctccggccctctctgctgtctccctctcctgtgctgggggctgggaggctgaaggaagccctagcaccactgtcccctcctcgatggctactcttctccaacaagacctctcttcctctcctcaacactgatgggaatggatcggaccttgcaattagtgcccagctgggtgcagacagggatctctgagccagggcggggacctggggagagagcattcctgctcaataattcacccttaagggaaaggaaagctacgaatgcagcattcagccattttccaagacattaacaattcagtgtaattcctgaggcataaaaaatgcatcattgctctaattttataagctccatgatgtttattatgacatcagaaggtctggtctgggtcacccaggagagctaaagccaggagaaaccggtagatagctctgtacagggcctgcacagaggtgctttggagccagcccagaaatgctgcagacacagcccccacgaggtgggacctgatgccctggaagcccccagcactctggaacttggaaatgactgacgcattcatcatgagtctttacacccctcccctggaaagcagcaggcaagagcgagctctgagcagagagaagagggcgcggcagggagcctgaagctccaaggcccccaattgcactcaaagacatcattcctccccggcgttctcattttttcattcccagtaacagagtgagtgggtgctcatttttatatttggtgaaacgccctggcattattccaagtcacttgaaagtgagattagaccaggaggatcactgggtggggctgcgtttcttgttcccactctggagacagagcacgatccatggtatttcactttggacataggtgcttcttaggccctggggggcagcagagccaagcaggggacagcctcca

SEQ ID NO: 51276 - DNA, 1042 bp, Homo sapiens
cgaagtgatggtgatttccgggttctatcccctgagccctcactgggcacccaccaggccctgggctatctatttaagtttattatccaacttcatcccggccgtattccagatctttccatccccattctattgacgaggagcctgaatcttagaggagtcaagtgacttgtcctgtgtcacaccgctggggattcgaactcagggccatctgacattgcagcccagtgggcactttttcaccatgccttcccaccacctgaattgatttgggacaatccgctttttagtatcctgctccccttcacagcagagatgtctctgcatttcgcccactttaatggggagaatagctgtgtattttaacatccaacatgtgtgtaatagtgggggcctggtagaagttgctggcggaatggatgggcctgtgtcagccagcagggagaatgagttgaaggtggtttcactccgcttccttggattcttttctgcattatgtccattaggagaaacctgccagtttttgggctgatggctaatgcatctcttcctccctccatattacagctggcaccttcccaggatgacgccaatcatggcatatcctggtagcaaacactgtttctccccactatcctccacatcactgtcaggaccattatctctggccgtataacaagccaacccaaagctgaatggctcaaaatgatgagaatgggtactttctcttgatgccgtgggttggccaagctcacacatgcaactgcactcatgggactgatgattttaagcccagagtccctgcagctgaagcataggggcacctgctctgtcaggtcatgctggccacgcactgtgaccccccccccccccaccaacatggccttagacctgtcccttcagcagcaacaacggatttggattaaacaggatttttaaagaattatgttgagactctagtccagggtgtccaatcttttgtcttccctgggccacagcagaagaagaagaattgtcttgggtcacacataaagtacactaa

SEQ ID NO: 51277 - DNA, 1054 bp, Homo sapiens
ttcatataatacagcaggatgggcactgggtgtttcagctctaccattcactcagtgagaaaccttatgtaaattaccttgtatctccggctctcttacctgttttccaaacccattagtggttcagaaaagcatggtcaccatcatcagattttaaaatcagagtgcattgcacatagtaagcgtaagtattgatttgggaagctttttggtttccatatgggagtgtgtgtgctggcttctatttctttctgtggaccacagtttaaaaaagttgaaagccactagactggatatttcctaattctctttcaattcagctattctgctgtgattcttttctgtggtatgtgtctgttatgacgccacatttagcagtcgcataaggcctgaaagagttaagatacctccatatgtatgaattcaacagatagtctccagccaggccagagctcagtatacctttccttgtcttactgaatgttttggcagtcaacattgaatcagtgttttgaataagcaagacagtttattgctactgtcatttatcacatgttttgtagataaattctaatgctgcaagtgacaaaactccacctcagactggcttacataaaaaagggaacttggccgtgtgttggctcacacctgtaatcccagcatgttggggggtcgaggcaggaggatctcttgaagccaggagtctgagactagcctaggcaacatagcaagacctcatctttaaaaaaaatttaaaacaaatagctggacacagtggcacacacctatagtcccagctactcaggaggctgaagcaggaggattgcttgagcccaggagtttgaggctgcgggtgagccacgattacaccactgcactccagcctgggtgacagaacgagaccctgtctcaaaaaaaaaaaaaaaaaaaaaagaatttattgactcttaggaagtccagaattagtgttatcttcagctagaactagctctagatgtacaatgatgtcattaggcctcccccattgcccccaccccactctcctcctctatgt

SEQ ID NO: 51278 - DNA, 1051 bp, Homo sapiens
ctccaggtgcgtgtcaccacacctggctaatttttgtatttttagcagagacggagtttcaccatgttggtcaggctggtctcaaactcctgacctcaggtgatcttcccgcctcggcctcccaaaatgctgggattacaggtgtgagccaccacgtttggcccacagcatccttcttattaggacctatgggagaaatttatttcagatcctagtaccagggaaagtcatactatccaaagcaactgacgtagtgtgatcttgaaactcactgcccccttttgctttgtttgctacgttcagccccatttgggactcacatttcaccattttggagggtttagtctgtgttttctgtgaaacagttttcctggagctttcttttattcttgtctgtaacatcatgagtcctgattttgcctgatctgctattaatcacaagtatttttgttagccacctcacacaggattgttaccagttaagtgagagcaggaagggaaataaagaggcccgggggaatgggctgggacagggaaggaaaatcaggaaaaggggggaagagcagagaacagactaaggagcatctggaggtattagggattcgagagagaggatcctcagaaacagtgcacagtgccaccggagttggctattaacgttttgttccattatttaaccattccgtcaaccacttgggggggttctgtaaggatctgcagattgcatagcccctgaaactggatgaagtcaagctgcatcccatagccacacactttttttttttttttcttgaggcacggtctctctctctgagccagactggaatgcagtggcacagtcatggctcactgcagccttgaactcctgggctcaagtgatcctcccacctcagcctcccaaagcgctgggattacaggtgtagccactgtgccagccacatccccctttcacagaaagcacccttaagtgttttgcttttttacgtaatccaagggatgctttaatgctggcctcagtaattcatacatttgttcaggcctcactgatttg

SEQ ID NO: 51279 - DNA, 1136 bp, Homo sapiens
ctcttttgtagactctttaaaggtgggtgcagaatctgtatgggagttccaaatctcttttgtgcttcatgccaattagctgcagttttactacctttgtctttagttggatttgttacttcactgacagcagagttggctcctgcgtggtggaggtgccgtcggtgcctgagactgtgttgtgatgtggctgcctgaatgttccttggagaataggtttgagattttcaccctgagacacccctagctctagtattgaaagatttcaaatgagagatgattgtcagtttgctttgctgcccttgtaacattttgtctaatcactgttggtccgttgttttggcagtatcctgaatgatttttctgaacaagtccaagactgaatatggggatagtgtaaaacaaagatcaggaagaagaaatatggatgcagaattatgacaaatgaagaagtcctaagcagcattgctcattgccatttctagtgttttggtatacagagtcagagagttttcaaaaagtggagtatggcggttttttctacggctaaatttagccattgctttggaaaatcagagtggtacagcttgtgcctcatctccacccggcccttacccttccctctgcacttggacatcttaaacggcttgccagggaggagcagcttaatatactctcgtggcaccatttattctgggagggaattaagtgacttcattttccctgtccttctgagcttcctaaaaaatttaggagacttcctaagcagcgctcacagtgctctacagaaatagttgcaggcatgcctcctttgcctcctcagctctccctgccagggcagccaagggctgtaagtggaatgagagatggatggcagtgggagagcacatgtgcacttgagctacaaataacgtgttttaaaatagcagatggtatttgacgattgcttcttcattcacttacctgccaaggcaaaactttttcttctcctctggcaacaagacctgagatggctcagctcagcagttgtaataacaagttctcacgtttgccgatattattcattagctgatgtgcaggcattcatattcatggacgctttctggggctgttctagaaagtgttccttttgttta

SEQ ID NO: 51280 - DNA, 1038 bp, Homo sapiens
atttgaagattgaaagtgagttgtgtaaaatccagaggaagcagtaggtgctgctggggcctgagggcctgggaaatctggctaggagctggtttcctggcatagacactttctcactcacagcagacgcccagacactcgggattctccacttttacagcagcaaatcccagcccttctaaacttagaacacactgtgggtgtctgatttcatgaaattgtctctgtctttaaaacattgctaaggaattttaaacatttaaatgaatattaatttgggacattttaaagtgagtccctttgaaggttaggaacccctgtcagagaaagaggaaaagatgtcccatgactgtgctgtgtgacacttcgtggaacagctgtgatggagaggctaggatggggtcgacccagcaaaagaaaagggaatctgaagccccaactaaccattccttgacccttgggccattgtttggaagagttttttcatcttcttcttgatcgttgtaatactcaaagctattctgggattatgagtctatttctatttatacttatgctttctaatattgttggaaactaagaattgaagtataataaggtaaatgaatatactactatactataacctatgcttatacttttgagatacaggagttaaacctgaaggtctcttttttttttagtttaatatatcaataaggtttcttttcagcatttcatttatcggtttattacagctaggtaacacacacagttactttcatcatcatttgatctatttttaaaatgccagctgggcatggtggctcatgcctgtaattgcagcactttggaaggctgaggcaggcaggaggatagcttgaggccaggagttcaggaccagtctgggcaacatagcaagaccgcagctctaaaaaaaaataccctcagaaggctctaataaacactgcagtgctatagtagacacagagacatcagtaggaactcatgtttacattagtgtgtatacaggtagatatatacatatatacgtatatt

SEQ ID NO: 51281 - DNA, 1049 bp, Homo sapiens
tggtgataaaatatttcttctccagattatccctttgcatgattcagatgactgtattttgaaaatagttatgttctcaacagttggaggagaaatatgtggtcacagctgttcagtcagcttccacagacattgacttcatttgtctaaagatgatggtgatggcaagcatgctaacctaggatttatcatgttctgagcacttacatagattaacagccctctgaggtaggtgtaactactgtccccatttaagggttgaggaaacggaggcatgaaaggttttgttctaagttcaaagctacacagcttttatatggcagagccagggctctgcacagccattcactggtctgactcctgcacacctccagctctatcgtctcctgcgtctcctgctctccctccctctgtgctccagccacacggtcttctgctccctgaaagccctgcctcagggccttcgcatgtgctattaccaggcctcagttctggacatgtttggctctttctcatcattctgagcaaactcgaagtgtcacctttcctgacttgtctaaactctgtccccatcccatccctccttattacgttatcctgccttcttcacttaccaaggcctgcctgtgctagagtagggagagacctcccctcttcgctattgaatatctggcacagtgttccttaaaatttgtgaggtgtggccaggcacggggtttcagcctgtaatcccagcactttgggaggctgaggcgggcagatcacttgaggtcaggagttcaagaccagcctggccaacatggtgaaaccccgtctctactaaaaatacaaaaaagattagctgggcctggtggcatgtgcctgtagtcccagctacttgggtggctgagccaagataatcgcttaaactcaggaggcggaggttgcagtgagccaagatcatgccattgcactccagcctgggcaacagagtgagattccatctcaaagtctcaatctctctctctctctctctctatatatatatatatatatttaacatatatatg

SEQ ID NO: 51282 - DNA, 1085 bp, Homo sapiens
gttacaatcagctgagattgcaccactgcaccccagtctgcgcaacagagcaagattctgtctcaaaaaaaagaaaaaaaagagagataatgtagcataatgtttccccctaattcagctgaagttttctaatggcagtagagtgtactgctactaggttttagtatttagcatagtactaaagttatgataggtgttgagtataaacttactcaatcgaaggacactgggtatgtttagcaacttgcctaactgaatgaaggcatgttcctaattgcccacagtggcttctggcagataccatcttggctcattcattaatatctaatgggtggtgcaaatcaatcattaatctgtctctcctttttctcctcttgtttcagaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaaggtaaactagaacagaaccttcgttttgtgacattcttaagatcagagaggacagatgaaagtcagaatcatgcgaacaaaaacatttactatttctttttttcctctgaatttgtagaatttttttggaagtctccaatttattaagattcactatataacatatctgtgtgtgtatctgctttgtaaaaatattttatggtaaaatattcataacataaagtttgccattttgtctgttttaaagtgtgcagtgtgggggcattaagtatattcacagtgctgtgcaactgtcactgctacccatttccagagctttctcattctcccaaaccatttgcttttaacaaccaatttttaaacagttaaacatgaaatttttatcaaatgtttacaaagttcctaaagcaccttcatagaagagtttcagaagcgtagtcttctcagttatctgag

SEQ ID NO: 51283 - DNA, 1390 bp, Homo sapiens
cttttatcagattgtgctttaggtagttataaatttttatttaaggaataataaattctaatatgtgtaatggtcacatagaaattagggattctatcaccttgtcataatccaggacttgcctcaatttctgatatgggttgccgtttcctcaagcttctctaggattaagccctattaatgggggtggggggacgtctttggcttcgagccagttgagttcatgatcccagaaaaggaaggtttattgtgcaaacgctgacaccacagtgcctgtagctctatagcagggagccgcactggcttctgtttggtgagcaggcttcctgggagcacaagtgatacacagaatgaaggtttcaagtctgtgattacaacaggtattgattccaaaatatgagtttggttttttaaaaaaaaaaaccctccccagaaactgtcatctacagctaggaagacagaaggcattatttttggaaagagtaacaactataaaacaaatattttggaagatggaaggcattaatatagccaggttgccttttttttttttcttggttgggagttttattgattctggtttttaatttcattatattcagcaatgtaacattaatcttgtattttctgtttttcccccaagctgacatggatagccttgaaggtaatgatacacccaagccctctcacaaaccattccaccagagtcacaaacttcacacccatcaccagctacagggagggccattaagatggcacagtcatggagtaaacatatcccccttgccaggccacctaagcacagttcctctgtcgtctggggaccacgtggttattcagctggagtgggtttcgacattaataactggacattttttggctggtgttaatccatctaagccagttcctgtgagccctgtggccactaagtaaataccctttttcccaaagcgcttcactgtggcccgatgggtctgagtgtgtagtgtgcacaggtggagacgatggaaaccacaggggctctgtagtctgcagcattcttgtcttcaaagactttcagaccagtgaaaaggtaaagcaggtcagataagaccaaagaaggttcttgcagaagggtcctggttcttggacaattctgagaagtcagtttccctccctcatttcacctcctcatacatccagagatacagttaggcagatacagggattttctggggaatatttttccttgcgacggtaagttgccgtcttataagcaaagggcttcattgcaacttctcatccccagagtcatactctgtttgattagaaatttggacgtagcattttaagaccatggagagctctgtatttttagtgcctagagactgatgttgagaattcaccctgg

SEQ ID NO: 51284 - DNA, 1028 bp, Homo sapiens
gttggtcttacgagtgttcatcttttacaggttaaaatggcttaaaggtgtcagcgtttcatgataagccttgtatttgggaccttgcaactcagtcagaaacttgtcgtgtggaatgatagttaaaaatcagaggctgaatgctaagtagatttgtgtatggtgggaattggaaggcataaaaaaattatgttagtgtttcaaaactggatagaaaatattaatccgaagcatttaaaattttactgtcgaaatctgtttttagattcataaacgtctaagggtattgctattaaaatttttctccaagaagggcaagatattttgatattttagggaaaaaatatatgtctgaaggcaacccttaaagtaatattttacattttggaaaggtaggtgtaaagattcctcatttgcctcttttgtgattaaaccccggacagagaatgtgataatagaggggaaaagcattttctcttcttcccttcccggtaagctcgaaggacgctgagcccgtgcagcccctgttgttactgtgtcgcttgttcttgtttcccctgcagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggtgggtggagaagagctcatggaggtaaagctccctagggaagagaactctgacttctttgaaagacttgtcctgggctgacattggagtctggggtgggcctaaagcattggcagtcactgtgttccagaacgttttaggcatggtggctgataagtacacctgtgctgagtctggttttgaatatttagctctttctctccacctcccacccaattattttgatattgccacccaattttaccttatatcagaatttggcagcaccagt

SEQ ID NO: 51285 - DNA, 1032 bp, Homo sapiens
tattgggcctctctgtcttttttgttttgcaatccaaatgagatttctggaaaatggcaagatctctcttttcctaaattccccacaagctattgcagctctcaaagcaacaggtaataatcagaaagccgcatccgctgccctgtctatttttgacgtccagcattgcgagaatattcccgctgaactccactgactcatgagacatttctctggctgagcatcactgagtagatgtaatgaagcagctttgccttacgctttacccatggagccattgtttgctacaagtttctgaagcaggcctacttcattgattcataaatgatcattggacgtctgatggaagtaaaccctgtgggcttttgctggctttcagtgctgttgcttacgacatcacttcagtacattacgatgcaactttttgggaagggggaattgagactacaatggtatcccagagtggtgattattctcagcctagaatgcttggggaaatactgggattgtctttaatgttaatagctgaatggtaacaggtcagtcttgctattctaattactgtgagtctgagccaataagagttctactttgcaagttactgataggagtcagaaatgtggccgcacagctctcctgagggcagcactggcgctgtgggaactgtagcttctgtcctgcattgcctctatgagctcagggaagactgctttgcctgtcttctgtgtaagtgaatttagaagtaagtgcagttataattttttttttttagatagcctggacatttttagattcagttctttcttagccctgaatgagtcgaacagttgtaattccttaagagaactgagcactcagtaacccttagctaagtgtgtgtaacataacaaaagtttatcatgcacctgtgttccaagttctatagatatggtgaccacaggtcctggattttcaagtctaattccaatttcaaaaattcttgtctatatttaccaagtttgtatactgaaaaatttgcttacaacataggta

SEQ ID NO: 51286 - DNA, 2044 bp, Homo sapiens
gatttttttttcaccttaagtagggtcacgtctttcctttgaatattttccccaacaatttcacaggagtttcttttgccgtcaatcctcaaaacggttttagtcttggcttttcagttcagagggagtggtaatacccctttcctttacttggtcacaattcactatagagttatcgcctgctgttttgttttgtttctcttccagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggag

SEQ ID NO: 51287 - DNA, 1664 bp, Homo sapiens
ttcttggttctggctgccaactgtgagttaaaactcaaggcttgttgtgaagcctaaaaatattcacaaataagcttttaaactggtgtctttggaaggaaggtagatacaaaaagattgtggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcaaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccatactacgtgtgtgttttgctttaatatgaccgggtagtgaaatctaaggtgatgggcacatgtttcaaaacatatgtaataatgtcaaggatttccttctgatccagatgtaatgttttgacattgaatgttacattgtttcagctaggtccatgaaagaaaaaatgtcttccagccaccattcagagagcttttcccctatctttccaggcacctctcaacatgtcaatcatttgtgtaaggcagtgcaattatttgaaagataaagacattaatttaattcaccttttcagttacaatcctctaaagtcttctaaaaggcattttccagcagattacgaacgtcgtcctttctgagtattgtgtcatcgccgctcccttcccgttca

SEQ ID NO: 51288 - DNA, 1049 bp, Homo sapiens
ctcgaactcctgaccacaggtgatccacccacctcggcctcccaaagtgctaggattacaggcgtgagccaccgcacctggccctgttcctccattctttgtgcattacttgctgtgatcacactcatctaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaaggtaattatcttttaactgacctttacatttaaccccccttctccattctcagagaattaacaggctacagataatggactttcacgactctgggaggtgggtttgacttcctccacatggaaatgtgggtccactgtgaatccgaaacactgactgcataccctttcctagccccacactaggaatcctctatgtgctgtggctgatcttcagaagatgcaggtagaacaggaatatccaaaatcactcacagtcatcagcccctcccaaccctctaccccagcagggccccaaacagataggagagggctggaattggtcagttttctcgtagttctgtgaatggttccaaggtcaagggaaagaaatgctagaaagccacagtgtgcccaacagaagagtagaaagcagctctcccaggagcacgagccaaagcagattttatacagttagcgtgctgcaatcagatccagatgtatcctgtcctctgccttgtttacaagtgacactttgagacacagggcaagctgagcagcctttccatatgtggaaaacttgtatacacaaacaaatgcctagctagaggccacacatcatttgaacatcttttaaaagcagataagttaccttcaggccctaattgagaacatttaatttaggctttagaaattattaattactccagactgtatgcacctgaatttccctttcagtgactagatgaatattatataatactcttcaacaagcacattatg

SEQ ID NO: 51289 - DNA, 1021 bp, Homo sapiens
caaaaaaataaataaataaaataaataaaaattgcttaggttggtgcctggcatataataataaaaataatagctatataaataatatatatgtatacacaaacacacacacaactattattatataatattcaaacaactcactgccatcggtagcccagtatatgagaaccgaaacatgacttctttcattgatagatggatgttagtggatgtttccttttagcaggaaggtacagttacttggatccttttgactctagtctccttcctctagccctctatagaatggagagaagccagtagtaggaaatcagcccagtctaatttctgatcacatttagactgcagcattggatgttggcttgggattcacactgagagactaacctgctgtttcccctgcctttttgcatctctcctccttcttagtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttaca

SEQ ID NO: 51290 - DNA, 1027 bp, Homo sapiens
aataagctagtatattttttggcatagaaattgaaccttcagtaggtgaagtgcaggtcttaggagaagatttaagaagcatgttggagaaaattatttgaggagttttgttgcatttgtaggttgtgcctgtgtattttaagatactggtcatgttagagatccagaagaaatttacctttcagggaatattgctagtgagtatctcaatatttgcatttattttaaatgtttttcataggatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagaggtaacaggaccaatgttcagatgtctatctttcctcatcaagatcagtttcattcttacaggaatagtacagaaattaacatattatttagaacatgcacactatctggtttttcttattcctgttatagaaagtcacgtgatgaaaacagcattttaaaagcttctgataacatactcaatacgtttgtttccattttgtcacatctgtttcacagatgatatgtcataaatattatttcattaccagcgtattgtatagtggtttagttgctatgaaggctctgtttcctttaagttaaaattaaatgtttttcctccttcatgatttccttgtatgagaaattttactttggagataaaatttggatcattaggctgggcaaggtggctcacgcctgtaatcccagcactttgggaggttgaggcaggtggatcacctgaggtcaggagttccagaccagcctggccaacatggtaaaaccccatctgtactaaaagtacaaaaattagtcaggcatggtagtgcatgcctgtaatcccagctactcaggaggttgaggcacgagaagcacttgaacccgg

SEQ ID NO: 51291 - DNA, 1070 bp, Homo sapiens
aggaaacttaacaatcatggcagacggggacatgtccttcacgtggcaacagcaaggagaagcgccaagcaaaagggggaaaagcctcttataaaaccatgagctctcatgagaactcactatcacgagaacgggatgacggcaaccacccccatgattcagttacctcccaccaggtccctcccttgacatgtggggattatgggaactacaattcaagatgagatttgggtggggacacagccaaaccatatcaccttttatgtaaaatcttaatatgccctgaaataattcttttggatctcaaaattcacttatgccataaggcacgatataattctagtttactctttatattgtacttttgccttatgaatctcaaggattgatactgagagcagttggttaatgccaccccctttataggctatgcctgcgttacccccttcgattccttactttgagcacatagaacatcaagaggacttaggaagcaatccactcagctgttgtcaacctctggtcctgtattagaatatgtttctatttaacatgtcttgtacaaacctcttagaaggatctgaccattacttcttcagagtacgcttttagaaacaagcatcacatatttacagcctaggaatggaaatgcattgtgggtgcacgtctgctgtcttagatcacgtagtctagctttcagtggtccaggacttctagtgagtgcagttggagttcatgtgtctggtgtgatgaataaatggtataagcaaactgacctcacagtagaggccgttttctgtagaagattataccaatcttcagtgctttattaatgctttctgactcttctgtgatcgtctcttagaagtatcaagacctgggctgcttattcaatattttggttgttttggattttcactgtttatgctaccttcagtgtatattttttgaacatctcacagttttccatggttcctataactgaagacttcttgtttcagtgaacaaatgcccaaaagatattcaggaagctctaatcagaggaaatacatatagtcaacaaacactgg

SEQ ID NO: 51292 - DNA, 1863 bp, Homo sapiens
gggtgggccatgcctggcctgtgggaggagtgacacggagctgctgtggcctgagtggaggaaggaacgaggatggaagaagacgggaaagcacgggccacaccacagggagcagtgacttctgcacgaagtgttttatttcagtttatcacttgcttattttcaaaacgttttactttgggaattttcaaacataacacaaaagaagagaagataatgtaatgaactgctgcggtgtcatcacccagctttttaagaactcgaaccctggccagtctggcgtcatctctgccagcagcagttctttaaccccctcttcccaggttaccagacagcgtagctcagatctcgtctgatttcctgcatcagtatttcagaatgtcattctaagagaggaagttctcattcacgtttgtggggttcaaaatggtcccatctttggccagtaggaatccctttgggttggcccctgtacccttgtgagagtgccccatggtctttgacagcttccattgttttaagcatgagacaccccagacccattttagacattccttagcccagacttggcatcagccatttctctaaggatccctggttccttttggtgggaaatggcattcacatttggaggccaaatctggatggtagggatggttattgctacagggttatcattgcatctagaaattttcagtgaacagaggtaggaaacgttcatttcagtttcctttttttttttttttttgagacaggatctcactgtgtcccccaagctggagtgcagtggcacgatctcggctcactgcaatctctgcctcctgggttccaacaattctcccacctcagcctcccaagtagctgggactacaggcatgcaccgccacagctaatttttatattttttgtagagacggggtttctccatgttggccaggctggtctcgaactcctggcctcaagtgatccaacctcctcggcctcccaaagtgttgggattacaggcgtgagccaccatgcctggcccggaaacagtttccaatatgaaagactggtgttggctgcagtgttgaagatactttggagggggaagaagggaggcagggagggcagttagaggctgttacagaggtacaggctataggccagcgttccggggggaggtataaatatttgtatattctggatattttttacacttgatcttagccaaaaggccaagaagcgatattctggatatttttagagaacaaattaccagaatttattaatgggttatatttggagtgagtgtgaagtaagagtcaaggataataccaggagttttgggctggagttatcattttttgaggcagacgaaattctaggaaaatcaacttcctggaggtggagagaaagaatgtggtgcttagttttagataagttaagtttgtgatacctgttgaatatccaagttgagactctatgagagtctggagttaaggaaaacttttaggctagaggtagatatttgggtcatcagcgtgtaaatggcatttaaaacctttggactggatgagcctggaaaatgcattcgtggatgtggagggaagctggaaggtgtgagcatggatgtgagcatggatgtgggtcggcagcaccgggacacagctcacttcccggtgattctcttttcttggtgaaatgggaagcaaggtcatcagttgagggtgcagagtgggagaagattctgtagtgtgtggtagaagagaaagagcaaggtggggctgggcgcagtggctcacgcctgtaatcccagtactttgggaggccaaggtgggctgatcacctgaggtcaggagtttgagaccagcctgacgaaca

SEQ ID NO: 51293 - DNA, 1064 bp, Homo sapiens
attattcatttaacatcatcagcatctttctacgttacgatgtgctttttgtagactttttaaatggcaacataaacataattatggagggcatcagagtcctctaaggaacttgctaaaagacagatgcctggtcttatttccagagcttctgatttagtaagcatacagcgagactgtggatctgtattttagcaagttcgctagatgattttgatgtaatgtgtcagatgaccaacatgtgttagattatacagccatttcccccaggatgggcacttgggttctttgctgtttttataaatgctaagataaacagctttgcataaaattgtctcacatttagaatgaaatacagaagtatttttaaaagtgtataagaattacctgatgagtatgccacctgtgttgtgtatctgtatcccagagcagtgcctttgctgggttacctacctcaggacctgattggaacatcgatcctaagctacctgcaccctgaagatcgttctctgatggttgccatacaccaaaaaggtcaggacctactcctttataggaggaaatatttttctctcattgatttgttctaatttttcttttcatctcattagagcgcaacctttaaccagagaggcattacattgaagctgctaaagcaattgttttctatttaaacatactaaaacaggccaggcacagtgggtcacacctgtaatcccagcactttgggaggccgaggtgggcgaattgcctgaggtcaggagttggagaccagcctggccaacatggtgtaacccatctatactaaaagtacaaaaattagccaggcatggtggtgcacgcctgtaatctcagctactcaggaggctgaggcacaagaactgcttgaacctgggaggcggaagttgcagtgagccaatatcatgccactgcactccagcctaggcaacagagcgagactcaatctcaaaaaaaaccactaaaacatttacaaataaatggcttaaaaaggacatttgtaatcagtatctgtgttaagtaaatcctatttttgtcttattatt

SEQ ID NO: 51294 - DNA, 1060 bp, Homo sapiens
cctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtatgtaagtgatgctcattttcaacactcaagtgagaaagtgaatatcttactaaagttaaggtggttgcgttgggactcagtgctgacattctcagtaggtaatccgcgtggctactgtgagtgagcctgttagcctaattctgtgtaaacatgaaacacatctgcctggctctgtttggaaagtagacatgaaagaatcatctatgttctagtttcttatatactttgtgaggttttttccaaagtgctatcttttaagttttcatgtgaactggattccctctactctttaaaattcgttacaggtattacgcttaagtgttcattgcctataacacgtatttgtttacttacaaccggggttatggtcaggtgagataggaataagccatattgacaatttaacgattgtacttcttcatgcacagtcacaggacaacaggtgtgtatgaagaggtaggagctattttatttgttatcagtagagtaggcagtttatagtttcacacttaaacatgtcatttttttcaaaaccaaaagcttttttggtctgcttcctttaacttttcatccctttacctaaaaagccattctcaggtttatttagcaggttaaactttggaatctgacgttcctatatttaggtatagaatccaaggcaagtgtgaatatttacacagatttttctttgaccttctctttaaggtacaatacccttctttaacagatattcaaaatctagtgatacaaa

SEQ ID NO: 51295 - DNA, 1036 bp, Homo sapiens
catatggcaaaatgctgatcactgttttgaatttggtttcattcctctaatctcaaatccagtgttttaaggacatgctaaatgctttgtcctggagagctatcttaagggacaaaatcgttttcccagcgtcatctgtgacacatcctgacagtagagagctgcttccaagaagcaatttgaagtgccattatcaggcagggacgggggctctaggggatttcggggtcagcagatatgaaatgaatgatttcatagggctgtcacagagctgtggtgggaatttcccatgagaccccgcccctggctgagtcaccgcactcctgtgtttgacctgaagtcctctcgagctgcagaagcctgaagaccaaggagtggaaagttctccggcagccctgagatctcaaggtctgtccatctgggggagtgggtgggggcactgagaaggggtgagattggaacttttgctccctttgcccatttctagactttttctcctaatatgtaataacttctcttcaatagccctttaaataaacatcaataacttagcctgaagagtttttcactccttagttttgttaccatacaaacttcacatctcaaaacatgtctctgtttaagaaaatgtgttagtgagttgaacagggaggtctttccacatgttagtagttaggtgttcagctaaagggggaagagtgattatgtgatagcttcttcttgaactgaattgtctgatgcccctgacagattctctttgtaaggagtttatttcaggggcaataagtaattggcattattgctggttggtactgcaaagtacctatgaaagtccccaaaagttcttgctattgttatttctgcattttggcagaacatgatggaaaatgcaccctcaaactttggcaaaccggcacaaagctgtgtgtttaatcacgcctgccttgtcctagtggtttctatgaatctgctacttttccgtaatattgcatcattaattgttcctgaaaaaccctgagttatcctcttatagaat

SEQ ID NO: 51296 - DNA, 1260 bp, Homo sapiens
tggctcaacgtctataatcccagtggtttgggaggctgagacaggaggattgcttgaggccaggagtttgagaccagcctaagtaacacatcgagacgccatctctacaaaaaattttcttttaattagctgggcacggtggtgcacacttgtagtcccagctactcgggaggctatggtgggaggatgacttgaggccagggatttgaggctgcagtgagctgtgaatgcaccactgcattctagcctgggcaacaaagcaagaacctgtcttatcagaaaaaaaaaatgttgccatggaagtaagctgaattggtgggaccgttatgaacagatgtcgatgaatacagtccaaagtaagatgatttggtttttttccaccagcagaagaatgatcagattttgtgttttgagaagggcaaattgtctactcaaagtcttaactgggggaagctgtggggctagggctgccagcaggaatggcaaatgccatcagcagagaccattgttcctcattttaagtcgtatgtgaggagtcagaggccagggtgaggggcacacctgcaggcagagttggggctgccagaagtaagaagtgggttgtgtcagacacaagggatcttttcctgctagattctgttcctctctctgccatctgaaaacacccaaaacaccacattccctcccatttctttctccctggagtacaaaatggcaagggtcaaattgcttcttctgatctttaaatgtggaagagtgcgtttctcttatgagaaatgccttgcttgggtttaagaatataatatagacacattttgatcatttttataccaatgatttagaaatattgttggaaaataggtcagagagcttgtggtttaaactaaaattaaattcttccaaagtttcctagtgagtgattggttagtggcttaatgataactttatgtatttttggttttcttttcactagtctgctgctgtgaaggagatactgaaggagcaggaaaaccggaagggcctgatagccgccatctgtgcaggtgacgtgcaggggcagcctgtgttgcagcgtcattggtgggtggggtagcctttcattcgatggtttgattccaaatagctcttccccttcataaagcatgcagggcatctgtgttggtgtatttagtttgggtggcatgaagttggtgtcatttcagagatgaggacaattgttctgttttctgcctctccatgcctttggtctacatgctgtga

SEQ ID NO: 51297 - DNA, 1006 bp, Homo sapiens
gggaaggtgagagaggtgagcacattttgtttatctgtgtatgctctgctggtatcaaggtaaatcttcttgagtaaatggttattgaagtattttgagtttctgtgcttttgccagatgtgctcagcaaatcgtttgttataaacatactttatctctcatactaggaagtgtttcatttcagaatcgtagctgtatgtttggtaagagcctcttgattttgaagaatactttgctgttgcagtttttgttgttgttagagaaggggtctgtgttgcccaggctgatgttgaattcctgggctcaagcaatttttctacctaggcctccccaattgctgggattacaggcatgagccactgtgccaggcactattgcgattttttaaacatgggcttttctatatctgcacttagatctttttatttttattcttaggtcctactgctctgttggctcatgaaataggttttggaagtaaagttacaacacaccctcttgctaaagacaaaatgatgaatggaggtaagtatatgcttgtttttgtttgtttgtttgttttttgagatggagtctcgctccatcgcccaggctggagtgcagtggcgtgatcttggcttactgcaatccctgcctcccgggttcaagcgattcttctctctcagcctcctgagtagctgggattacaggcgcatgccatcacacccagctaatttttgtatttttagtagagatggagtttcaccatgttggtcaggctggtctcaaactctttttttttttttttttttttttttttttgagacagagtctcgctctgttgcccaggctggagtgccatggtgcgttctctgctcactgcaacttccgcctcccgggttcaagtgattcttctgcctcagcctcctgagtagctgggatcacaggtgtgctccaccacgcctggctaatttttgtattttttagtagagatggggtttctccatgttggtcatgctggtcttga

SEQ ID NO: 51298 - DNA, 1363 bp, Homo sapiens
gcacacgcacactcacatgcatacccgcctccattacgttgtgctgtggttgtttttgaggcatcagagggtgtgcgtgccgccacatgttgattggggtggcttctgcgttcagcgctgccgcatcccttcacccttccccggcacttcagaattgacacttgagctttgttgtaaatagtgatgtgagtaactgtcattcaccgacatctcccccaacacttaaagtcttagcagctgcatttaactcacgcatatttgtttcattctaacagtggtttctgtcaccctttgctctgcacagttttaaaaatacctttgtagggggcttctaagagcttggagtgcctagtaaatgtttttgaatggttagctacagtgttgggtttatatgctgtaatagtgaatttaattggtaagtaatcgtctttctcgtcacatagcccattaggatgtcaccttttctgtttctactttgcaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttcatttgcagctcttaactgtccatatggcactgaaataaaagaacagtgaccacattttacacagcaaggaggaaaggcatacaaacagaatttaagaggcttgtgattttctctgcttattagctgtgtgtttttaatgtgctattaaaaaataccaatgagggctgggtgtggtggctcatgcctgtaatcccagcactttaggaaaccgagccaggaggattgcttgaggccaggagttcaagaccagcctgggcaacatagcaagtctccatctctacaaaaaaatacaaaaactagccaggcatggtggcatgcacctgtagtcccagctacttaggagcctgaggtgagaggatcacttgagccccagggggtcaaggctacaatgagctgtgatcacaccaccgcaccccagcctgggtgtcacagc

SEQ ID NO: 51299 - DNA, 1382 bp, Homo sapiens
gatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgta

SEQ ID NO: 51300 - DNA, 1032 bp, Homo sapiens
gaactactaatttaagaaaaatgtacttattttgttatccatgccttgcagctaagcaagatatgagttactgggtgtttcacaaaggaggatgtaaagaatgtacctttaacttgtctttaaaagggagggaggaagctgtcccaggcttttactgaagccagtaatcttgcagaacttgatttttacaggataatggaaattagtatcttcatatattactgtttgttccttgaacaagtagtaactggagaatttgtctccccatggccaaccctgaaatacaaaatccagataaatgctagaccctggggtagtcaggtgccaatactgtagaaactcttgcttagtttcagcattgtgttttagtgagtattagttctacagcataaaatacagtggcttctgaaattacttttttagcttgggaaaaataagcaggatccactggtgcttcatgcccagtgcagccgtaacttagaaggctggtttaataagtcaggggagggtctgtgtgcattgccaagtgagtgtgatttgttgtgcaactctcaggctgtgcagtaggaggtctgcttttgctggcaatagattatttctcatttcactaaaacatttcatgtcttttggattagcatttacacaaaaaatcatttttagtgtttacatataagtaccctcacgagctgtgagaattaagtgaaagtctacaactaattttttctattcagcatcccccaaatcctctgttagctttgctgtaatttagactgtcctaatggaggtatttctgaattgttttctttattctctcatctcttctacctcccagggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaagt

SEQ ID NO: 51301 - DNA, 1017 bp, Homo sapiens
atagtcagtcggatcctacttcgccagtttaaaaagccgtagggacaggaagaggcagtgtggtgtgttggtgaagggcctggacactgaggccgggctgtctagttgaagtcctggccccattgctcaccagttttgaccttgagcaagttctttaactctgtgcctcaagtaagtgagagtaataatagtagcccaccttatggcattgtagagaggattaaatgagttcatacacataaagcacttagaaccatgcttgcctggcagttgtatgtccagtgaatgttagttatcattaatggttttatattaattgtaacaatctagagttacccatcgggtaacttaaatgcttgttaaataaatttgaagttttaaagacttgcgtcccatcattagaccattgtgctcgttgtctttagattagaattcacttttatagtaagaaataatctattgttatatgtcaaaaagaaataatatttttctcccctctgtgtgtatatatagttactgattgtgctactctgtaggagaaatacaaaggacaaaagaatgtattcctgctatcctacttttctgctgtcacactaaaattgtgtgggaggcttaagtgagttgaaagactggattatggtagttgagggaatgggttttttgttagtttaccattttttaaaatacttagctagaaagcattctgaattattgaataaattacgtcatttattttttatttgacagtttgaagataaattattttctctgttgcctctatttcaccacctacaaatggtccattatgttctggacatgtttaagagcctctgaggaatggagctgcaaacacagacacaaatgttcatctttgccacactgaactatattttaatgtttactgaagccatcaagcttttcttgaattcatgcaggagtattttaattacattaaaacatggcattattttaaaagtaatctatgtttttaatttaaaggctacttatgcttaccat

SEQ ID NO: 51302 - DNA, 2188 bp, Homo sapiens
ctttaaccgtgaatggtgctgtattagtgcttgctaagtctttattaggatttcatcattgcttgaaagaaaccagtctcttacctgataaaaatatgaatagatggttagtcataaacttaagtcagaatggagactgtagctttaaaagagatgtgtcggtgacttgaggtacacctgcaacacaggtagggcaagactggtttctaggcaactgtcaggggtgaagaaaggtgaggttaaaatgccctttttttcccttccagaacaaatgttcaaccttttataaatgtgtaagaatgcagtgggtacacacatttgttgagactgaacatcccaagttcaccgtacctatttttttaactgcatttcttttcttatatttctgtaattacaatatacagttttaagtgaaattttatttgaacagagaccaaagacaggctaggtatcagcaaatgatcaaattttgcaaagaccaaaataaaagaagctggtttcttgctaacatgctggctataattggttaccaatatgttatcaagcaagttcttttccagatattagcaagtttgaagaaaaataacaaaggatttagcatggacttcagaaactatttgtcattccctttgcttcaagcagaagtttattttcacctgtgtgttccaggggacactcgataataagtgatagaggtcttagactaacgatttataacctgacagatatattagattgtaaactccttaagggtaggcactctgccttgtatagcttctatcttatgcagccttgcacatagttgatgttgataaataattgcatgaaagcatgttttaccttttaaggctcagcaggattggagcagtcattgataagggttggaaagcaaatctgtttaatttttttatggctgttatgaaatgcctgaattattgatatttttgacgggtaaaactgttgtttcaatcatcggttttcctacttgcagttcacaatatatactggtcactctttataagatttaattatgcttgagtttttgtgtgaaaatacctcttgactgctgcttctcaaaagttgagctagataatacttcctttctgctgaaactaatggtggcttttcaaagcaatttgcgtaaattacaggcacaatctaacatgcttgaaactgacctgattgtctgcataccatcagattgctttagaaaggagcagaggaaggaaaggaggtgtcaggggtaactccaggaattggaatggcataggctccctctgccagagaaacaactctgctcttgatctaaataaatttgaattggtacctcatcatctggatccatttggatacatttagcatcctttgcgggtgtctggctatacaaaagctaataaagaactcgctacataaacgcagtccagttgtggtattctggcattgttcacacagcataaacacgtgctttgtaaaggtagatgaggcgaatgagtttgagggtcctaaatgtaagttactaccttaacaattagttttaagatagggaaaagttactgaggggggttcagatttcagaaggtggtggggaggattctcagatttcaagtctttgttgatactgtagtccaattcctcacaccataaaattgggcaatattacgaaaagaccactcttccaggtctcaatgaatgtgtctttaaaatgtggggcttttggccgggctcagtggctcaggcctgtaatctcagcactttgggaggccaaggcgggcagatggcttgagcccaagagtatgagaccaacctgggcaacatggtgaaaccctgtcactacaaaaaaacacaaaaattagctgggtatggtggcacacgtctgtagtcccagctactcaggaggctgaggtgggaggattgcttgagcctgggaggcagaggttgcagtaagccaagatcacacgactgcactacagcctggtgacagagtgagactctgtctttaaaaaataaacaaacaaaaaaatgtggggctttggctacagaaatggagcccttttcaacttggaaacaataggaaggtaaggattggaagacattatccaaaagctcttattcaataccccagatgtgaaactggactagttacagattgttttttaaacaactattcgctcagtagaattgtcttctg

SEQ ID NO: 51303 - DNA, 3620 bp, Homo sapiens
caccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacaggtgaggtggggtgctgggagggagtggaggggttatctgagcccaggctcccaacctccccgtgtgcccagggccaggctcctccccctctgcctgctgggccctggaggggacattgtggaaccatggtgatgggagaaacagaggaagggaggtgttgggagggtaggtcagctacacaggaggctgcgggcttggggttggattgcctggctgttgtctttggggttgcctccagcctgcgtgactgcctgcctaggcctgagactaaatacgctttcctgttttgtctttccagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaacccttgggtgtctcccgtgcactgtctcattcctggagagtgggcggggatcctggctgttaccccaggtggggaagggacagagggagagtcggctgttccctgctgctcgggaccctgtttgcatcccagagtggcttccagaaacatcctctgtctgggaagaggctttccctggtgagggtgctgtctttctttggaggctccccaagcagcgggatgggccctaagcaggcactggcattgggactaagagcatcttcccccaccccttgccattcaccccacacctctaatccgtgggcgttaccagcatgtatgggcatgtggcaccctgcctgctcaggagacacatcggaaccaccccatcctagcggcctcctgcctggcccccatctgcctccccgtggcctaccagtgccccc

SEQ ID NO: 51304 - DNA, 1832 bp, Homo sapiens
ctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggtacgcttcctagggctccaggacgggtcaggcacaggtgggctggtgggggcaagttctggtgggagggagggccggggtgggtctcggcaggagctcccagcaagatctgtggcttttctcaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctgtgagtccagggttggcgaggtgtgacggggggcgctggtccatcctgcgcctgggagccacgctgggccaccgagctctgcccttggctgcctgactcggcctcctggcagctagagggttgggtgctatttacaccctgtctccacacctctgacgggtgctgcacatccgaagctgccggggtaactgcgcatggcaggtctaggctgactcccagcagtgactgtgcgtcctcctaccggagggccttcgaggaaagggcctgtccttctcctgcagcctttgggttcataacttctaagtaatttgaaggagtcggggagaagcacaagggggcgccttgagagaagacctgagcactcaggcgataagcaggctgcgaggggcctctccagctgccctgcctttgtggccccctcgtgggctgggtgctgtggtggtggccagctctctgc

SEQ ID NO: 51305 - DNA, 1042 bp, Homo sapiens
ccacaggtgctcaaatctcatatacatcgacacatggtttgcatgtgaccagtcacatcctcctgtagactctaaatcatccctaggttacttctactgcccagtgcaatgtaaatgcagtttaaacagtggttccactgtctagttcaggagataatgacaagaaaacattgtgtgcacgttcagtatagatgtaaccatcacagtcctgcctacattttcagtccatggttgcttgaatctgaggatgcaaacccacaggtgcagagggctggctctcattcccacccccagatacgtgttccttcttggccccagttgacccttctagagctttttgctcctggagatggaactcagaatgagggagcaaagtgtctgcaaaccgtcatttccttgctgaggctgatgggatggtctcccttggcctgattgctccttgtgggcttttcccctgcagaaggtgaaggaggaagcctcttcccctcttaagagtaacaaacgccagcgggagaaggtggcctctgatacggaggaggctgacaggaccagctccaagaagacaaaaacgcaggtgaggtttgctgctgagccttgctgagtaaagctaatgcttcttcagaagcccccagccggggttctccctagttggtggccgtgccctgtctcctagggtggggctggagtggcctttgacactggctgggtcagggcacgacctgtggtcccggagccaagcttgctgcttcatctgcacaaacattactgtgtgtccggcactggtggtgcagagcagacagggctctgccctcctgggacttccatccttcccttctctgactccaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagc

SEQ ID NO: 51306 - DNA, 1050 bp, Homo sapiens
tgtttactgaatacttattcaagatgttgtcttagacctgtggggtactcacagatgagatagcacgtactttggcaagttgggtgggcccatgtatggttacagcacagggaagcctgtctgtgccagcacagaggcgggaatgaaaagatgtaggagtgaaacctgtatgatgccatccagtggtgggggagtgaagtgaagggaaggcttcatggagaagaaggcagcaaatgtgatgaattgagtcctgagtgatgaggaggactacagggcctggacagaggaggaggtgggggtggtatggggctcaggggctcacccagcaggcaggagagtgctgaggaacagaaaactggccattgtgtttgacataagccaaaggccgtgaggcgggggaatatggtagaaaggaatatggtagaaaagtcttccggtaacacagagaaagtctcagaagaagtagtcaagcagctgggcctttgttccttaggccctgaggaacctttgaccgtttggagaagaagtggcaaggtactagcggggctttgggaagactcacctggtctgtgtgcagcatgggagggccggcccagggaagagctgtggcaggacctcaggtccagacgtctgagtggaggtgtggggccagggtgggattagcaaatggctgagttcatccaccagaacaacacagagcttaggaaatctcattacagtgttcagtgttggcagaaatcttgagctattgcagttcctttgcactgtacaaatggagtggtaaatgtagtggtaaaaaaaaaattttttttaactgattttttaaaatgttataaaaaggtgcctgggtaaggaacatcttcatgagtgtcttagactggccccacctatttacaagttaaagccacaagaccttcacgtacttccctcctttccctttgcctttccccagaagaggatctggaggtggcaccgagggactgccttgcctggaggcagctgcctcctcactgtgggcttcctcgtgggtggcggtttagatcagagccc

SEQ ID NO: 51307 - DNA, 2027 bp, Homo sapiens
tcgttaattcatgtggaggcagctgagagtgccacctggtcctgaagaaattgggatacttgtgggcacaaaggtggacctgagatcactggagccaagctggtggaagtgttgaccactgccgttggcagagagctgtcattactggtgcttcaggccacagctcagcaggctgtccttgttctgttttgttaagagcctagcagcatggctagcttgcaggcataatcccagagcctcttgctatctgcctgcaggaagtctctatgtgctccagcacactgaaggaatttggtgctcactttctcctgcttttgagctttggtcctgtgttattactaatccttagaggaagattttgactgtaaccactttcctgagtgctcttaaggcaggtccagaggattctcacagcgtgaaatgagaaaacgctcagcctcagaaaaatggaagttattcttttagtgccaaagtgtcattggaccacagtgcagcttggttaattcaggttaagacttagcccctggaacagtgtcaagccaaggcctgtgtggtttcatcatagatttgtaaaacaaaaaacacgtgtgttctggtaaattccaagcgcacattagtgcatacgtgtatgtgcaggaacactccctgtaagactcttgttctcatttcacactggcgcgtccccggggctggggaaatcattttcatttttgagagtaaccttaactaattaaatggatcaagggactctttgtgttttgttttcattttgttttgttttttactttaatgtacagataaattaagggaaataataattaccttgaataattttgattctcgtaactaattttccacctatgtgtgtttagctcaattttgaaatggttcactgaaagatttccaaatttcttatcactgaaactgagttatttcacttttatgactgttagtgactcctctgttttatgtatttctggtgcagtataattcttctatgtctgtgtgtctgtgatagatctcagttcaagttagcgtttcccgagcacccatcttgtgtcaggcactctgctaatgattgcgcaggttacaaggtttagagtggccacatcccctgttcacttgcagtttagagtccagtcggaggaaagggaggaggggaatcatgttatagacataacttgatatcctgcaggactcagtgatgtatgagccacaaaaaggtcacagctgagtgagagagttggtaatcatggaaacaggcgcatcggaaactcgcttcctatgggtcagtaaagtgtgtatgaggtggtgtggatgacagcacatagagctggaggggtgggccagcagcaaccaggagaaggcgttccaggtgtctgcacccaaggagatcctggggtcagaggcaggacatgtgggaaaaaccattggtcccttttacccagggaaggactcaagaagccgaacgtggtaggagatggaggctcccaagccctggcagacgttacagcagcgctgagcactttcaggaccaggactccaaggtccagctctggaacgcccctctctgccctgactttggttccttcatcagcagaggggctcctgggctatgggctcaagtctgaagtcaccttaaagagaaatctctacctttctgttctccttcattgctgaggattttgacttgtgttgaaaagtttctgaagctttctgcagctggaaaatcaagcttttaaaaaagctcttgatgggccaggcttggtggctcacgcctgtaatcccagcactttaggaggccaaggcaggtggatcacgagatcaggagtttgagactagcctggtcaacatggtgaaacgccatccctactaaaaatacaaaaattagccaggtgcggtggcacgtgcctatagttccagctgctcaggaggttgagggagaagaatcacttaaacccaggaggtggaggttgcagtgagctgagaccatgccactgcactccagcctgggcaacagagcaagg

SEQ ID NO: 51308 - DNA, 1039 bp, Homo sapiens
tgtcatgctacggtccaatcagaaaggcccagatgatgtggatgctatggttcctggctttgggcccccagtcacacaggccacgctaaataggatactgcatcttacttggcatttattacccttgatggaggcggaaataagaactgttgtatttggatcttcctagagcagttggtgaactgatggtgcactagactaaaaaattcacagaaacatctggaaaggtaagatcaagtactataaagtgtaggacagtttctggcaaagtagcctccttcttggtaggttgagtctttgggaacttggggacgaatccctgcagaagtccaatctgagcaccttgctattccttctcatgagtaagcccaccacattctccttctcctactttcaggataaacttcatcatggtattttggtgcacatcttcattgggtagtatccaactatattttccaccgtctctacatggtttagaatcctttcattttctatgaaatggaaacccttgaaaatgcccccagagaatgcacatcgtgttctctgcagcactctgtatcgcttgctttggtcagagggctgcttcacgaagagctgaaactttgctcgcaaacatccctccagggctggtaatcttccagacaggatggcccacttgatagaaatgttttcagcacaaccttgcagcagatgtttgctctggtgtgctggcgtaacagatgctgaccatatctcttgagggcctccacgtccctcatagatggactctactgctagtgtgagttatgcgtacttcagggccataattaaagctcctagatggaggggtgggggtagatactggctgtgttcaaagtgggtgtttatggttgataggaaaaggcaaatgttttgtctttgctgaatttttagaaagctaggaatgaagaatgagacccaggggagaggaaaaagttttggctaagtttgtttttatctagatagatagatggatagacagagagatatatagatagagatattcattttccaggtt

SEQ ID NO: 51309 - DNA, 1088 bp, Homo sapiens
ttggccagcctgtgggatgtgatacagtagaaatgtttctggtgccctttgttactactcggctttgattaggtttatttcccgtaagcttgattttgctagcccttcccccaccctccctttttttaatggctgaggaggttaacttagccaaggttaagcgttttattatgcaggctgcttcaacctagtagagtcactttggccaggcttttgtggcagagagagacaaggggaagctatgttctccctctgtgtttgcatttcttcctcccaaggctgccttttacttttaatgccagcgttcatagaaggtaacaagctaggtaagctgtattggtttcccatttctttactcagaatgttccaggaaaccattgtacaacttgtcttgagattttgttagtcaaggtaaaaatcatggtagacctctctagggtttctgccaggtggagggcaaggccttgagagccgcagttaacagcagcacgcctttgatcctccctgtggttctctgtttcaaaagaaagaagtggctgcagctttaaaaaggttttaaatgctgctttgaccttgtatttatagctctttcgcccttgccattaagaacattttatagacatcagctcagcagtcatccccataagtctacgggggctgccagtatcattccacatgcacaggtggagaaactgaggcacggtgatactaaaaatggcaccctcacaggtcttgtccaggtcatggggtggggatgagccaagaactagggccttgagaggtaggcttcccccacagagcttctgttgcaagtgcttgcatctgggacaagatttgctttttatagaaaaaaaaagtggaattttattatcttagacattctttgttcacagtaggattccttggccaccttataaagtataaatgtatgtgcttcctttgtatcctagagctgttgagatgcgaactgtctcataaggtagcagaaagcactgtgatggaagcttctgtttcatcggtgtcctggaatctgctccatccccttctctaggcagcaatatggtcctgcttccttctgggtttaggtc

SEQ ID NO: 51310 - DNA, 1051 bp, Homo sapiens
tcacaggaactgtgtcccgacagaagtgtggacagttctccttttctctctgctgcctcatgcggttgttagaacaagctaattccatctgagtaggtagtatagcttttctttctgtttactattgctgggtgacaggagagcaagggcagaagttatggtagatagctcagctttacaaccattgtcggggctaaacatgaatcctcagcaatcgggttggccattcctcttctcaaacgttgtactccctctgctggttttgagacaactgatatttccttaagaagtgtgaggctctgccttcaaaacggcacagtctcttttccccagatctgcaactgtgtgtgttgcacacccacaaagaagacagttctttctggctgtggggaaatgatttcagttcttgggcaaggatggcaaggaataaatgtagaagaaattcctttctgataccattctcctacctcacatcctacccccaaatcattgcgggacatttagacttgtttgggggacccccaaacacagcattctcaggcgttgtattcacttctacttgttttctttgaccaccaccacctcctgccccaagcccagcctccacctccccgcagcactcacggcaggagtcattttttatagcacacataacctttacaccaaaaggaaaaagtgcattgcttgtaacaaaatgaatctcttttctgcttttattttgaaaagtcctccctgttgtttaatgtggaggatattcatgctgaaagcctgttccaagtaggcatttgtgcgtcccagaggaacttttgatttatttccttaactctgccctcctttctctgtggttcagaaacctttaatgatctgtgaagctcagagacttcagtgcgaaacagtagtcgttttaagaacccctcccactatataaaaggcctgccagtttccacatgctgggtttttgactccctgaaaggctgacctcttacaaattttggttgtacagcagggcatcctgggttggggccttgataatgcttttgtgaaatctttt

SEQ ID NO: 51311 - DNA, 1051 bp, Homo sapiens
ggtacatgagctttgatgttaaggtaatgcctgaaaaagtaggaggcctaatagagaatcttaattacctaaaggtgaatccatgttaggaataacacaaaatcgtggatgatccaaaaataattttttgtttgatttgtctatacattgcagttttcttcaaaatcatgagataattattcaagcagtggtgacatatctcttctctgaggacatatcagttatttgaaccaaagactttttgtgtctggcacctggatgattgtcccttgaatcctggcctttgtttatagctgtgtctcctattacttagacaaattcagctggcactgggtcgtagtccaggagcgcttcctcagtgacctgccgttgcttgtctctggtgcaactaagattggtgagaagacaatgtgatctaccccagcttggtagccaagaggtgttcccaaagtgttagcccctggagggagatggaaggtgaaaggggacatgctttggctgtctttctcgtctctttctttttatttttgagcacctagcccagtgaagattaagcttgtgtcatttgtaatcccagttggtggtgcattgacacttactacactggaaactcattttcattcacttcccattatcagaactaaattttgtgtatagttcaattttttaaagttctgggtgcccactgagcactgcaatgggtagggtatctataaagagaagcaaggtgccatccctgccctgcagggagccagcacgacatttacatacctgccatacttggtagaatgtgctgagggccctggtgggtggaggttcaggccccacaaagtgagcacagaggctcctggaaagctaattggaggggcggtgtttgaactgggctttgaaggaaggattcatttttgacaggcccaggttgggagggtagaggaaaagcaactttccagccataggaaatactatgaacaaaggcacggagacaggaaattgtaaaacgtgcccagcaagtacatgagcatggttggaaaggaggttgcataagcggatg

SEQ ID NO: 51312 - DNA, 1138 bp, Homo sapiens
tattatgcctgacatttgctaaatattcatagtgtccttgctgtcttttgcattgcactggaggagtttggtagtagggtaaatctgtaagtattataatgagctgggagaggcactcatcttgtgttttcttattttctctagttatcaacatagccaagctaatcattcacagcccacagggaggggagggcagaggtcattttttactttttgctgcagaagatgagatttgcatgtaccagtgttgttgattcagaacttgctgggtagaattcttatagtcatgccccttttgatagcaaatccctctaatatagatacttttcacattctctctctctttctctctctctcttttttaatgagacaagatctaactctgttgccctggctggtctcaaactcctgggctcaagtgatcctcccctgaatagctgggattacaggtgcacgctaccatgcctggcttacattttcttctgtctaccagaattattaactcatttctttgttattcgcaagtgacttggaacttgagaagggtgtcagcatccaaaagaacatgcctgattgggcattggtgcaagggtcagcagacctgtgttctattcttggccttactggtaactatagtacttgatgatctctttttaattgtgcagtctgccttgagctgttcattggaaagctcaggtcaaatcttgacaacactgggaagttattttctgtaaaatggtgtttctctgcatgagaattgtgtaggtgctgtggtcgttataaaatgcctgtacgtcgttacttgctgcagtgcctgagaacgaagtgatgattcttgccttctctgctacttacttgctctggaaccttaggcagattattcatcccctctgtcctttaatttctgcgtttgtaaaatggggtgataattcctacccttttgattattttgagaatttaaatgagataatgtttgtaaagagtgcatagaaatacttggaaatgattgttcttcctgtctaccttaaatactacataaggtggtagctaaatgctttgaaaagtacagaattcctttctgcttgtaaatatactgagcctgtataaaaataagttacctgtttttcattaatctgtc

SEQ ID NO: 51313 - DNA, 1044 bp, Homo sapiens
ccctcctcatctccttccctggtggtgtagaggcagatggggagagagtcttccctctggctaggccacgggatagggcagatgggatggagttggagcagccactccactgtctgaaggcgaagggaggactcattaaccagaaacactcttcaggactttgggaggagtgatccatgtttaatctgcctagacattgagctgcttttttagggagtggaggtgggagatggatgcaagaatatctactataaaagtatgcggataatttgggttttttggcttaattttttaattggatgttgtttactgatttcctcttgtttaattctgtctttttaaaaatgagctgtttttctggacacttactgtatagtacctcaaggacagtgataactcatggggaagaagggttttgtgatttcaagtatagtcttgtatatataaatggatgatttgcatcagtcaatgacaattaaatttaagtattacgcatctcatatgctaggatggatcatattgagaatggtaaaaaacagagagagagaaacctgtttatgaacattaaactaagatgtattatgatgccaatctatataatcaacttatttcttacccttcccagaacagggtagagttatttaatatggaatattgagatacatattttaagttttctggggatttcagtgacttgaagtttgatatgattaaaaattaaaatgcctttgcccgagtgtaggaagtttggtttggctgagtaaaaaagagatcagtgagtagatttctcctgatcgctcagattgtagcctctcaagttctctgtctctgctctgctaaaagttgcaaaccatgaagaatttgatacagaactatcttgacaattattttatctttcagttttaaaaaataaattcataattggaagattaagcattaaatctaaattctaccatctggcatttggaaatgctcggtaattttacttagtgttttatctccgtagtggaagcagatgtgagtaacctttaacctagttaagtt

SEQ ID NO: 51314 - DNA, 1033 bp, Homo sapiens
gcagcacctagttgggttggttgggcatgaacacaccagagaaacaagtgccaacatctcaagacgctcagttcgtgcgtctgagagtgggcaggctatgagctggggagcataaacagcagagctgcccagcgctggcagcagtggccaagtcagtgacttgccttctatatttccttcctcctttacccttggcatcctgctattctaatatctatacactgggagtgatagaaaaactaatggacacagaaataattcatgagaccttgaatttcagcactggaaatgccgaatttcagctcaacaactagaagactcttaagaaacagactgtctccatgaacttgcatttagaggcttatagggcctgttgatttataagtcaatagtgttaattgttaaagtcttaaaaacttcggggtcttcatttgaagagcgatgaatttatagagggaaaggagacagccgcaacagaagtctctttcacgtgtgaccccttccaatcattgactactgtgagtggtcgtctttgtttcgattttcagggctactctacatttctggtaaaccacaagctaaaggctggtctctgagaagcagatgttttgctggttttgaggccttgtggctttccatagagaagtaacagtacaggccacatgaagcttttacttccttttttttttttttttttttttaaagtggggccaagggtgcttttgctcttgatagcattatattgacatacattgacagctgtggtaggtctgtgttcaccaccagatgtcaaattcctatttctggaagtaattagtttgagatacctgtgaaacgttcaagttgagtgttcccagtggacttggaccatagatttagtcttagaaataccagtgacaatctcgaaagatatttagagccaagggaacagtggagatcatatggggagaggatatatatagcagaaagccctaggacaaagctttggggagactccagcatttagaggttgagtagagaattaggccaagtg

SEQ ID NO: 51315 - DNA, 1051 bp, Homo sapiens
gctatttattgaaaaagtagtgccttactcaagtcaccctttcattaaaatgttaaatatgtaaaaccaaaaccaaatgatacatctcaaagcagtatcaacagtaaagctccagaaggaaatatgttttagatatggggtgacgggatctgcaaccaacaggatgatatggatgaagtacagttctcatccagtggtttatcagtgagagccagcatcatgtaatacaaatgtttggaaaggcttttatttcttctgcctggcatccatgttcccttttttcaccctacccctccttaccatttaacatttaggacatgtctttttcgtctgctgctctgtgtcttcagtggagccatgggtctgttcctcttacccactgcctgtgtgtctcctcgggggagctgtagtttgcttactagcagatctgcctgcttttctgtcccctgtgaaccaataaattattaacataaaattttgtgcagaaatcagggtaaaacagaaggagccattttcacagtgggaatcattttaatacctacagtgttttccaaacagttatgtaagaggactgagtagatgtcccttttcagaagtcatggtgagtttctgactgtgatacactagttaaaattcaccagagggagttaattttgaaagctctcagccaggggttaatgcagaggtatcttttagccatttttgtagcttagcccctgtcttctgctctcttgctactgcagataggggtcaggtccagcacctgggatgacgccagaatgagatgtgctgggagtttcatgtgtagatgaggggaatttgcacaccttaccctttcagggtttactctcagcccagtattctctatccacacatagaatttttgggaaacaatatcttgggatgcaaacacaggcagcagccacatcatcacatcccttgtctgcaccctcggctccattcctaggcccaccacagctctgaggcttcccaattttttacactggtcccccttgaccctcccagcctggttcaaggatttagtgataca

SEQ ID NO: 51316 - DNA, 1158 bp, Homo sapiens
gagatctactttgccaaggaaaggtgaacattttaatgacataacttaggagccactttacaggggcatttatgtagcgactgtagggtgatattgtagggagagaaggagcctcccatgcccatttggattctgttatgagtgttgggttattttatttattttttatttatttatttgagattgagtctcgctctgtcgcccaggttggagtgcagtggcacaatctcagctcattgcaacctctgtctcccgggttcaagcaattctcctgcctcagcctcccaaggagctgagatcacaggcacacgccaccacgcctggctaatttttgtatttttagtagagttggggtttcaccatgttgaccaggctggtctcaaactcctgacctcgtgatctgcctgcctcagcctcccaaagtgctgggattacaggcatgagccagtgcacctggccgtgttgggttatttttaatttgggcgtagctgtgtggccataattggcaagaggcatttggctggcacaatctctacatctgttaatgctgctgcttaactagccagttctcatttgacttgaaagtgcattgatgcatgctttctgatattcacccagtggcagtactttttgttgggcctgcaataatgaaaggacttcagtgtactcagtgtaattatctagacccagaggggcactgacagagatgtatatataggatagctcaatgggctgtgctagtgggtgcagttgctgtttaaaccacaacatgaggtcattttcccattgggcacatggtctttgaatgaaaaatggagtaacttttatttgatatttgagacctcctgggaagggtttttggcatgcaggtgtgttgacaaaggaaatcactggctctactctggatgctgagctggcatcacggaggggatggtgtagttcctctagtgggtttgaacgaagaacatctaatggttttgtcagtagtagttagagagttagaaacttaacagtgcagtgaatatatattaagagacgttgagtcaaactggagaacaggtgatgagaggtcaaatagccttggaggaacactaagcccaatcatctccagatacattcttgtactgaaccagtggttgtcaagcacctgctatatgt

SEQ ID NO: 51317 - DNA, 1044 bp, Homo sapiens
ctgtgaacctgaaattgctctaacaaataaagtttatgaaaacattttgaaaatgcaaagattctgccttactatatgctgttgtaacagatgttttagtaggtctccctcttcgtatgtatatacatctttttaactgaaaattatcctatattgatttttttcctacaggagtgagatctggctgggcacagtggctcatgccataatcccaactctttgggaggctgaggcagcaggattgcttgaaatcaagagttcaagaccaagcctgggcaacatagtgagaaccccgtctctacaaaaaaatatttttaaaattagctgggcatggtaactgacacatacctgtagtctgacctacttgggaggccgagccaggaggatcatttgagcccggaagctccacgttacagtgaactgtgatcataccactgtagcctaggtggcagagcaagaccctgtctctaaaaataataataaataataataaaagtgaaatctaacagcacttgttgaggtttctccttcatagcatctcaaatatcacaaacgaggatgaaaaggactctatttcgggggacatactgcatgggggtggggggagcagaagtctcagcctgggttagcagtaatctgagcatttctttttgtaaaattttagagaaatactttggaactcaaactcccctctgcatgcagcccattgtatccagctgtgtatgtaaatgagctattagtatgtttgtattccttataaatatacagatctaatctgtttgtgtgtgtaatttacacacagctgtgttcatgctcccgtattaccaatattgtcagcaagagtgaggtatcatgggagcgctattgttccaaacaaaagccagcagcgtagccttgtggtggggcccattaccagcccctgatcttgggaccctcccttgggggactctcttgaaagtcacagccattctgcatggggatagccatcctgcatggggtaggcgggagaccagagtgcctgtaatagaaaaaaaaaacaatgat

SEQ ID NO: 51318 - DNA, 1181 bp, Homo sapiens
gctctcataattcttcctctagttgaatcttctgttcctatcattgttagtttgttcttctattattcaagtgactttttttttatttggcttagttttttggaaacaagacttagaaaaaacattattgatttctgtgtacaaaaggaagggagcgtatcagtgactttaaacaaacagcatttgttctttcactgctaagatctctgcaggagttaccaccaaccttggtaactgcttggcagtatggcaggtgacatgccatcccactgtggtatccttgactgatttgggtagtgggtgtaaatgagtgcttgagttggatttatcaccacagaatctagagaggggacagcagccacacaattgaaaatttgttttgagtgcctcttttgcttcagatggtgttctggggctcacagggcctgctgaggtgagcagcttgctccctgctcttggacagggagatcaggaagggtgctgtagaggaggcttatttgagaggaccttgaaggatggataggatttcaccgggcagagttgacagaggttagttaattggagaacaagggctaaaagaatttgagtggttggttagtagcaagttgttgcccagtttggatgaagcttatgggtgggggaggatgtgaggtagctaattcagagccttccacttttgactgagaagtttatgtttaattcaacaggaaacgaggaaaaattatatatttttgaatgtgtggggaaggataggactggagctgcccttgaagaccagtctggcagtagcattggaagagtggaggtgggctgaggacgtcttgtaaacttggctgtgcgttagagtcatcgggagaacttgaaaatgccccaatgctggcctgtaccccagcaagtcagagcagaatccctagggtgggacatgggcatccaggccctgagaactactggactggatcaggactatgcccctagtgagagacgttgagagctgtcggtgtacagcagcacttcacactattagcacgctggagtcacatgaggaacttcagacacacagagcagaaacttgggtccaatttaattcatctggggtacaagtttccagtgtcccaggatgttaggacactaatatgcagccaaagtgggtggaagattgggctagaaaattggtgggaggt

SEQ ID NO: 51319 - DNA, 1171 bp, Homo sapiens
ttactcattttcttttttcagatagggcctctaattaattagggtgacagagctaagtaagcttggttatccaattttaaaagagaattttagaaaatgaattaaaaaaaaatttttttttgagacagagtcttgctctgttgcccaggctggaccagtgcaatggtgtgatctcagctcactgcaacctctgcctcccgggttcaagtgatcctcccacttcagcctccccagtagctgggactacaggtgtgtgtcaccacacccggctaatttttgtatttttagtagagacagggtttcaccatgttagccaggctggtcttgaactcctaacctcaaatgatctgcccaccttggcctcctagagtgctgggattacaggtgtgagccgccatgcccggcctaaggagatcttgataagcaaaggtttgggaaactggttgacctcgaccaaaaacccacctaacattaatctaagaaataaaggagctttgcctagagaagacctggagctttgatctgtggtgatctctcccacgttgaagtcttgatttcatcaggcagagctgttccaattctcagagcagcttaaagagtggggtgggctctggatttttgggatcctactgctcagttcagtccatggaaatgaaattctccagtcctttagcaataacaaaagtagaaaattattttcagatcgtcctttgagacaacccaacttctttgtcagcttcatagtcactttccaagtttatgaccccagagcaatctgaccttggtagcttgtctccctcattaaattctctgacttcataatcagctcacattcccttcctctctctccctctctttttaaatatctgtaaaacattcaaatgatccacgtagatttatcttgcttttaggccacactctgagatgtgtaatccggttgctcacacatttagaggagtccatgagcatcacgccatgctactctccactggtttgaacatcttaggcactcaggcattccgttacgaagatgggcatgtgtacgggtgcactctactgagcctgagtatcttcacaaaaggggtggtggattcttgaaggtgaagagcaaacatttttgtctgtttctggataattaaatttaccttaaaaatatacatggaaaaaggaa

SEQ ID NO: 51320 - DNA, 1052 bp, Homo sapiens
ggctctcagagcttgtagttatggttacgtggatttcagatactaataatcttggtgattttgttttaaaattttacatccacaatataggggaagggttagttatatttattttaggaatggtaaaatttccagagttgttgaccattttatgtagtcattcaaaaatgatgataggagagtcttgtaggtcatctagtacgaaccttttcactttcttattctttttagggttttgtgcagattgttttttttattgttagaacaacatcctaaaatcattaaagggaatttaaaacctcaccactaacacgtcgtctcacagtgtctggcttcatcgtctcatttgctggcttcttgctctcttctggtctttgtttatgtacgtacgtggttttatgtcattgtcaacttacgtatgtgtacaggtttgcatacatgtgagttgagtcagaacattgaaattatctttctaaagaaattataacttgaaaatttttacaattcatttggaacctttgccattaacccaaaatatagatacaatgtatctactgcatcacatagtaggtacttagtacattttaaattgaatcacagtagattctcctctctactaaccacccttcctccagttttaaatgacagtggtactgtttcttatgaagaactaaatttgtatatatgagagtaggaaaaataagagaaatagaaatgttgatatattacacgtatgtacatattactccatattatgtattcttaatgtgacctatagtgagaattagcccttaatattaaaaaagaaaaatgtagattcaagtgagatttgcctgaagttccaactattaataaaattggactatttttcctatggttaattcccatcggcctttgaaccaaacccttgcttaaagaagtcaatagtatggatagaatggagtttattgtcaagtcctttcggaaatgagacagcaaattaaaaatcaattatatgcacagaaaagttggtgtaaggcagtcagttctgtcaattagtttgcagaaagatt

SEQ ID NO: 51321 - DNA, 2033 bp, Homo sapiens
gtgacttgctccgacagtggggctcacactggccgctgagtccggtggtctctgggggttgctgcacaccaggctgggactggtggctgggtggtgtggcagcagtggtcgtgataagaagcagcgagatccaggctgcaccttgaaggtagagaaaagagaatttgctcctagaatggctgtgggtgagggtgggcaagggctgaggaatgggaaaagctaggcggagctgagatgcactgaaatggccctagggtttggtaatggagtgcttgttgaatagttccttaagactttaactttatcagacttacagagttcatgaagctgttttaaaacaaacaaaaccataaaaatcttaacgttattattaaagagaaagaaacatcttaaacattttaaaatgtttagacaacgttaaattcagttttgagaagtcgtagtgatactgtttttttactgtaagcctgtttatgtgaggagtggataagagatctgattgacaaggttttaaaattctgcgaaaagcctgtgtggaagaaacacataaggagatgaaaaggatggaacaagtgtatagactgtggtcgtttaaccaccctttgtgagattgtcttcagtcctctcagcctggcctaggcggcctcagggccttgtcagcttgcaatccatggctgcttctgcttctgcatttccctcagttcctggccatctcctctctcttcagtctccatgccctttggcgtcctctctccttccccacttccctgcctcttcttggtgtctcccaccctccccactcctcactcatgcctcccagcccctcgctagccatggctctcctctctcccttctttcatttctcttgtgacctttcattccctctggaattttaaaaatacacagccaaagtcctctcttcctgctgaagagaaagctgctttccttttcctgcagcgcctgcttgtaacatcaggcagctgttgattgtctccccattgctgctgcttgaggatttgtcgctgtgagctgagagggaagttttgcacatcagaaagagcctggtttattttgaaaaacaaaacaggactccaaagtggtgaatattttgagtatggaataatgatccttaactgtatacatccgtatccgtttggggtcatttttatcatgtttgcttcttggtttgaaaaatgtcttggcagccatccagcccttgtagagcctcaggatcaaatggttcccttatgtgtaggaagtgaagcttcactttgaaaacctcagcagtgaagaagagagactgactgaataattgagaggttgaaggaagcttctggtgaatggatccaaatcaaatctttgaagagatttatgtggcaacaaggcagtcccctctttaccctcgcctggctttggctgtgaaaaaacacctgctgtgttcatgtggcccccttctgttaaatttaccacattttctcacctcaggaatcacaggaataagcaaaacaaatgtgttccagctaacataaatacatgggcctacctcccccttttttcctcccagttttctatatacttggaacattctaattattatttttattattatcattactattttttaagagatgggggtcttgctatgttgtccaggctggactcaaactgttgggctcaagtgatcctcccacatcagcctctgagcagctgggactacaggcaagccacaatgcctggctacttattactaaacttcgctgccgctggcatattaatttgttctaactacccagtgtctgatctgactacaacagtcttgatgaacgggtttcccttggcatttttacatgaatactttgaagcagctgctctgtgagagggttggtgaaataagcacctgaaggtgtgagttccctgctgtgcagcggacaggctgggcctctgcacctcctgggcctggcaggcctgctgctctatgaagaaactaacctctcatgccagtgcagaccctactcgttctccagtctcagctc

SEQ ID NO: 51322 - DNA, 2080 bp, Homo sapiens
ctacattatctgcaagttggaactcagaaacttggagtgtctggagcatctttgcgaggtgggaaggtgtccatggtgccagacactacacagggttgaaaagacgcagggtgagaaaagttgattagctttgacaagaaacaagtctggtcctaaagggaatatgtagataaacctgcatctttattcatatgtactgaaaaactagcatactattacagacttactttctttaaaaagctcttaaattttagccactttaaatattttgtttttgtgtgaaattagcacagtcaaaaaacttaagaaatgctaaaaagaaagaacataatctagtgtgactttacgctgctttgcggagaatgaggcaagagtaggggtcctcctggctgggttggagtcttggcttcaccacctgctggctcagtgtggtgaacatctttacttgatctttctgtgcctcagtttcctcatctgtgaagtagggcgatgatagctcctaaaccgtagattaaatgagagaatactttccccataggattaagtaagataatgattgcatggaatgtcctgagcactgggcggggccaaacattccctaaatgtttgctttatgggaatataggggaatcctattcctatctttgccaaaatattttctgccttgcctgcctccctctcccagagtgagtagaataggggttgggatagggtggtcttggatgagaacaaattcctgcgcctactgaaatgatggagtctcagtgcccctttcctgactcttctgtgggagatagtcaatgaggagcttgccttggatcgattgtgtcctgtctgttatttggtgcagttagctaactataattgttgttgttttagctgcatgaaagcggttacgatgctggcaaagccctgcagcgcctggtgaagaagcctgtgcccaagctcatcgagaagtgctggaccgaggacgaagtggtgagcaggaaccagcatttgccttgtgctctggggcatcgggccaccggcgtctcagtgtgtgacctccctgctgctcagggaaagcagaagcttcagtcatgcagaatggctgtccgtggcagcgccaggcaggaggatggggcccttcagccccttaattgtacagaaagacttgattttattaagattaggcttcatagatgtcgggaaagattgtccaactttcatggaaagaaaggagaaattgatagttactcctaaaaaaagttaatttgaacttgtttttggtgcaagctagcttgtgatacctccctatttaaagacagcatgttaaaacccgtggacatataacctaaagtagggttggtgacttgtcttttttttaatcataattattttagagaagggggttttgccgtgttgctcaggctggttttgaactcctgggctccatcagtcctcttgccccagcttcttaagtagctgggactgtaggcatgctctaccatgcttggcttggtgacttgtttttatagggcttgtaagacccctgacctccttaaaggacattgattacaagcgggaagcagagagttgatgaaataaatatgctggattttacatactgattgtattgctgtggcctgttgaaggaagtggggggagagaaatgtgcccacagatacagccttgcaaacccatggattcccatccagcagacagttttaatgaagctacatctccatcttgtgacttgtaaaaggcattgctgtaaacgacttacggatttcttgtgcttttgcaaatacagtcttcagtatgaatgttaccgcttgacatttgcctttcaggtcgaatgaaatttaaatgaaggctggcactaatacacctattgattgcaagttcctctcctgtattttaaaatatgctaagaaagaatgtttagaaattgtatgtgctttcctgatcccgctctttcattgattcagcaatatttactgagtgcctgcttgcgtgccaggtgttgtccctccttgggagtcttaagttttaagaggggagaccttcataaatgagtatgtgccgggggtggtgaagc

SEQ ID NO: 51323 - DNA, 1035 bp, Homo sapiens
gttgaggcaggagaatcgcttgaactgggaggcggaggttgcagtgagtcgagatcacgccactgcactccagcctgggcaacagagtgagactccatctccaaaaagaaagaaaaaaatttgtcactttgggtaaataatcccacactttttacttctcagatgtgtctttgtgtaggggtgaggacgggtagggactctcaatacttactgataacatgggaaactcaggaatagggactatttttttgaggaatagggatattttaagaggccagccagacaacaggtcaaacaaaaggagagaatccgccattatatagagaacagagtagggaaggaagctcgagttaccgtgtcactggaatagcttcttcaggagaaactgccatctgaaataaagttttgtgaaggaagtaggaatgccaggacttgttcagaggagtgcctctttccccattaagctcatcactagaaattcagctgaggggcattgtgcaggctgcagccatgctctctaacaaacggaacaaccacaacgagatgttcaacacttcagtggaagcatctcttccagctatagtttaaaactcttcttggttcaccaaaaggccggaatgccacagggattaatgatatttgattgagcttcatccactcagcagtttgcttttggagtgggctttatgttctcacgagcaatttcctggtagcaggcacataagattttatttttcttattactattattatttttttgagacggggtctcactctgtctctcaggctggagtgcagtggcacgatctcagctcactgcaacctctgccgcctgggttcaagcgattctcctgcctgcctcagcctcccgaatagctgggattataggcccctgccactgtgcctgcctaatttttatagttttttagtagggatgcggtttcaccctgttggccaggctggtcttgaacacctgacttcatgatccaccaacctcagcctcccagagtgctgggattacaggcgtgagccacc

SEQ ID NO: 51324 - DNA, 1545 bp, Homo sapiens
aaggtgggtggatcacctgaggctgggagttccataccagcctggctaacatagtgaaacctcatctctactaaaattacaaaaattagctggacgtgatggtggcgcctgtaatcccagctacttgggaggctgaggcaggagaatggtgtggcctggaggcagagcttgcagtgagccgagatggcgctactgcactccagcctgggcgacagagcgagactccatctcaaaaaaaaaaaaaaagttttatttgtatttttatatattaaatataagcttatgttaaatatgaagaagtaatggtgtttccccagaaagatcttgtgtggaaatatttctgtgtgtgtttcctcatacagtgtttgcattaggctcatctgaacacttgcagctgacatataatttgtaaacatcatgctatataacatggagatgatctgtcttatcctaatggggttaatttagccacctttgagtgcttacatttatttggctatttacaaaatagacctttatattcctacttagaaactgcagaaaagccccatcatttgagactaaggttttctagaatatatcttgccaacttatttttactaaactgatattggatttccttctttgggctcaggtatctttcctggtttctaatacaattcaaattattttgctttttctttctcagtaatttattgccattttctcaccaacactaaacataactatatattcactgtgtgtaagtaaaatttataatcatgcaacaaagatttcacctccgcctggacagttttattccctgagatacgggtggcttttagacgtttggattaagctctttatgtattcaagagagtacatgtttgtttgcttatttatttatgcacacccacatctccttcagcaaagaattcaaggctcccagtggcttcatagtttttcatctctggtctataaatatcactatttgttaactgttgagtattaattatttgtgttttctaaccctagtctgatgcctgacacatggtagagagatactaaatggttgttgaatgattgaatagataaatcaagttcaagttcatatcacacttgatcatccagaaattgatgttaggaagttggcatagcagaatatgcagataaccctattctaaggatcattttcatttctcttttattctaaaaaattaagtccatagaatttttgtcagattttttgtttgttcattataaatggccttcactaaagtatctggacctggattagctttgcagtgcttatgacttgaatgtggaatatttctcagctcccaaataaggcattgccgggaggccctttcataagttttccctaagcatgtgagaggagccttctgacattcattccatacccacaccctttacttaaatgtttctatccagatgagtcaacattaaatggttagtgtttgctggcttgggttaaggtaagatgttgggttttcttgtcgttcaggattttttatttgttgttggaaagtctaatgggtaaagctg

SEQ ID NO: 51325 - DNA, 1046 bp, Homo sapiens
ctttctgcgtgagtgaagaggaacttaaatttatttttggtctgggcgtgatggctcacgcctgtaatcccagcactttaggaggctgaggtgagcagatcacctgaggtcaggagttcgagaccagcccgaccaacactgtgaaaccttgtctctactaaaaatacagaaattagctgggcatggggtgttcctgtaatctcagctactcgggaggccgaggcaggagaatcccttgaatcctggaggtggaggttgcagtgagccaagattgcgccactgtactccagcctggatgacagagtgagactccatctcaaaagaaaaaaaaaaaaaaataggagcagaggcagagctgggaactggttcatcatgcgtgtagtaatggaatttgttctgggctggaaatgtcctctgaaaattgaaggtctaagtctctgtcctgatattactatgtactaataaaggaaaaaccttttcttctgaaggagcatggcggcatttgcaggaatgtgtgatggaggctctacagaggacggctgtgtcgcagcctctcgggatgacaccactctgaatgcactgaacacagtaagtcttttgaagtcaccctgagtgggaagacacttctttttcccctgaactggctgtagggaatgtgtgatgagtgcggagcatgaagtcgcctgtagactcaggagtgagttgtggtcttggctgttgggtgccatgggggctccaggccagtgatgtggcacctgcaggttcatttcctaatctgtgtctgtgctgcaggtttgaggtgactctcaaatgagatcctaataatagcacctgatacttaactgaggcctcacaaagccaagtactgtgcatagaagatcttgcttaatcctcacaaccacctctaggttctatttttatttttatttattttttatttttttgagatggagtctcgctctggcagtggcgcgatctcagctcactgcaagctccgcttcccggcttcacaccgttctcctacctcagcctccggagtagctggg

SEQ ID NO: 51326 - DNA, 1526 bp, Homo sapiens
gcctcccgggtttaagcagttctctgcctcagcctcctgagtagctggaattataggcgcccgccaccgtgctcggctactttttgtatttttggtagagacaaggtttcagcatcttggccaggctggtcttgaactcctgaccttgtgatccacccacctcggcctcccaaagtgctgggattacaggcgtgagccaccaggcctggcctcaactatattttttaatgtttacttaatactcatctagttttggtattgaccatgacttatattgctattgactgtcttaagagtaacactattctaataggatagctcacttaattttttagcaaatatccttaggtgaggtatcatttgcatatgtcttctttgtcaacttgttatattggaaatgtatgtgtgtttccttctttatcaatagctgttatcatctaaagacattattttgtttttttgtttattttatgcatatgtgtgtgcttcagttttactcttggtatcatgctggcactggtttactttgacactgttaagcagatattaagcagtctattgtgaaatcttctatggtgaaatgatcctgacatgtgaaataggtcagtttaaatgactcatggttttgttgttatttttctgctgtccaaggaaagagtctcagtaaaacattgtatatgttcctaaagactgcttattgagatagctctttataattaatacatgccttgattgtgacttactcatccctgtcttacaggccaaacttccagatctgcaaccatttccttctccagatggtgatacagtgacccaacatgaggaactggtctggatgcctggagttaacgactgtgacctccttatgtacttgagggcagcaaggtaataggaatctacccccatcctgctttctgaattagaccatctgaactgattataggcagtaaactttgcatttcccctgagattttatttctatattgggcgttctctgactttaagtttggttacaccctctgtaatcgggaccctggctcttcttaccagagaaaaatagtttgaagtaatttttttcatgatgaagtaatgtttttcttcttggtgtttgccccacatcaaattttggaacttttcaagaggaaaacagcttaggccatacatacagttaccaaaacctctcaatccagttgagtacttcagtcattcagctcatctgaaaaccccactacagaggggtgggggtgaggggagggagagcattaggacaaatagctaatgcattcggggcttaaaacctagatgacgggttgataggtgcagcagagcaccacggcacacatatacctaatgtaacaaaccgacacgttctgcacttgtatcctggaccttaaagtaaaatttaaaacaaaaacaaaaccctctacagatttcatgttctgtctctactttgtggctgttcattagtgcctgtcctgaacttgacatttttgtggcttgcctacatgagaatatttatctgtgat

SEQ ID NO: 51327 - DNA, 1048 bp, Homo sapiens
tacattgtcttccctagatgtggaattaaacttgtctcagaagagccctcttttattgtagtgggaagtggtatttacatactgggtgctggggtattcattcttactgggttggttgctatttcgaggccttttcagtagacagaataggaaataggtgttttatttccctactttcttaaagataaaatacattctaaatttatgctgatacatccaattcaaattcagatttttctatggcctttatactaattctgtccttcttttatgtatatctttatttttttcccgtgactcaaatcccattttttaatgacaccaacaaaattacttatttgcttcaattccataatacacatataacagcccagaatagcaataatcacatggctacaaacagtatgcttattgaaaacagcttggtattgcattttgttatgtatatcctgccagggctgtataagcaaattaatatatcttagagttacttgaaacagttcctagagtagaaccagctcaattgttgcatttctttccatttggtgtagttttaatgagattattattatttaagcttcttattttcattccctctgccccttcttagataaataataacataatatacatccttttgctacctttcttttaacagtatattcttgtgttctcctcatagcagtatatagagctccttctcattcccttctataatactatttcatagaactccatgtatgaatgtagcagtttattcatctgatccctattaataggcatatgagttgattccagtcatttgccattacatgtaatgctgcagtgaatagcctgtgcatatagattttgatgtttttgccagtgtatcttggggctatatccccagaagcgggatggctgacttagaggacaagtgcatatataattttgggggttttgccacattcccctccacagagattgtatcagtttgtgttgacactagcaactaatatgagtgctaatttttttcgtggctttatgtgttgtcaaacatttggcttta

SEQ ID NO: 51328 - DNA, 1245 bp, Homo sapiens
cagaacaagggtctgacttgagccttttctgtcccagcaccttgggaatgggccacaggctacacgactgttaggacccaaggcttggggaggggctgaatgagggggtcagctcttgcccttagttgcttcatggtggtgccttctgttcatgtgttcttcccatatctctatcctcctccctcatcttcccttgtagaatcaagtgcctatcttaagcagtcaccgtgatcacatagagatctttgggcgtctttggtgaatgttcacagaacattgccttcctgccccttcccctttcttcagggtgaagaagtggccgcatcatgttctgggccaagcctctgggttgggctgggatcctgcatctagcaggcatgctcttctcacagaccctccctttgcctgccatcgccacctccatctcctctgcaaagatgcttctccctttttgatattcatttacaggctccctgctcctttctgtccattccctgtttacttcttagaataaaacgtttccatggtaacaggttacttttcaaagggaacatcttgtcattttatttaatccactgcagttgaagaggactgaaatattaagttgtagttgctatggatactgctttgttacactggggtttttttgtatcagatttcatatacaatgactttctgtttttttaatacttcaggaataaaaacaacaacttaccattattgttgtaatttggcttctggaactatttttttcatattctaaaacaaagatttgtagaataatgtaggctgaacttaagttgttttgaaaaacatattatttacattagctacacagagaaattccttcttttgctggggatgatagtgacacttcttaattcggtttttgtaatatgattcacagtataaagatgtctccaagatgatgaatccacagcagaaatccttagtaaacataaggaaaaaataaatatgtcacttggagttaatttcttgaatctcattgctaataagctgtggccctctttcttcagttactggttcagctgtgtacagtgtaatttgaggttgatctgtttgtcctttaatcagcttttctcatgtctggtgttctttctgatttcccatctgcctgtagtatatcccccccttcatttgacttttttaaaactttaaattttttggattcacaggaagttgcaaagataccacagagtggtctcatcttttgtaactgtaata

SEQ ID NO: 51329 - DNA, 1041 bp, Homo sapiens
atttcctgccactttctcacttacacacactaggtgcatgtgtgtgtgttagttattgcctgtttgtgttctcttccttctatattcataccactgcagcgaggaggaataaggcaattgtcatgtttttttataacatttccctgaggggacaaagaaacctttagacgtgttgtagacatgcttgcttggtccaaagtccctttttttttctgggggtgcttcattcagctttgttatacagtttgatttcaatatgcagaaagctagcaccatcttgggtcaggagagcagcttaatctacagtgactgctgctttgtaagtgggtttcggtcatagtggttttttttttttttttttttttaaaaagttttttggctgaatctccatgtgtgtgcaggcagctttgttaggccgcagcccctaaactttgccacaggccattacagtaaagttccctaggagcctgtggtggaatgttgttttatgacgttgccagatacacggtaggttaccacataatggagaagagagagaaggcagataagaaatttagacaacggagcaaagtcactatagcactttgaaactggatctttctcacctgttaaatttttttgaccagtttttttcctgacattactcatacattattgtgtgtggaggccatatttactgcatcttaccagcatggaaattcttattattcttcaggcaatgccaaatttctagttctggaccctgaattatatttaggaggaccctgtgggagagctgccggtgtggcctggagtcttcttcagtaattaactcagtgtgaccccttaaaagagcacttttctttcctcaggccttgatttcttctattaagctagaagattggatcaatggcctctcaggaactttccacagagaaaatttagaattttatgattttggattttggacaagttcttgtgttggcctttgtatttatttgtgtgtgaatatggaagtggtaactttaagttgactaaatctctttgttttttcatttgtat

SEQ ID NO: 51330 - DNA, 1017 bp, Homo sapiens
gtgataaagcatgagtctgatttatttttctttttggtctaatgagactcatgcttgaatgtacttttaaaacaattctgaaagataactgatctcatattgtatactctatgatactttgagtctaaggtaaaacacttaattcaactgggaaaattagagattatttctatcaaacttctttgagctacacatttatttgtgattatttgatttttttccctattggacatcaagcttttggggcaggggccaagtctattcttacggtctccatttctagtagagtacctggcaaatgggtctttggtatgaatatgttgaataaatgaatgcatcatctgtggtaagaggaaaggctagatttggagccaggtagtgtggttcagattccacctaataagtgacaattgggcaagcggtgacattcgacaggttccttccctcctctgagcttcatttttctcatgggtaatctggaaataaatatttcttacagtttttgtaaagattagatgaaaacaacttggaagtgcttggcacatagttgcttagtacattattgttattaattcgcaggtcaaatgtacagtctcaagctcatgtagatatgattatctcaacaacaacatatatttttaaatttttaattaaaaaaaataggcatgcaggtctcactttgttgcctgggttggtctcgaactcctggcctcaaactatcttcctgtcttggcctcccaaaatagtaggattataggcatgagccactgtgcctggccaacatctttttatttttaatagcctgttcaactaagacaatgctagggattgttttaggaattacactaattattaaccaccagtatgtttaataactatttactgatccactttcttcttactctctttgagtgtttatgtttttctttatacatcttggagttctttttttttttttttttgaaaaaaagaagctctacttccataatttataatattgggtgtgttcagcattaa

SEQ ID NO: 51331 - DNA, 3770 bp, Homo sapiens
tatttggggaatgttttatttattatttttagtttcttatctaaggaagattaagctgtttgcagaaaatacagttttctttagctaccctgctcacaataccatctacactgtgtctgtacctgtgtgacaaggccaagcactccataactttacccggattgtttggtctttttcaaaatgtttagagtttcaaaaagaaatttgtgaagttgcttctcttaagtagctactactatgtttttaaatgtgttgcagtatttctattagttgatcttgtgtgtagtcattcatatctgtcttttgattctatttcttggtgatcttgctttttaaaatcaccatttaccttaaaaaaaaaaaaaaaaagacaaaacttgctgttgtgctgacagagcagagagcatttaactgacgctcctccgtggcttggcttgctgagttcctgacagagcagggcatttaactgaagcctctccatggctgggcttgctcagttccctgctgttggctgtcttggatcccctttctaaggccccacttccctgcacactagcttggtgtgcagggagaagctgcagagtctgttggctgggctttatttacggaaacagcagggttgagattgattgcgtcgtggagagacagtgtgtggatgagggagggtcacagcacatgctcagtcctgtcagagtgaggggaagtttctgcgttctgcgtgaaggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcaggtaggctatcttcccctggcctcaccgaaacagtgatgggttttgctgctctttctcacttctgaaggtgtttatgaatcatttcatcattcatagtgcatgttcctgagagcctttaattcagccctagctggccatgtaggtggtattgtgaagcgtaaaatcagaactaagaatggggactaccggagaggcattcagcagatatagaatgtgaagctttgcgggtccctctgtccctgtcctcttccccttacctcttcggctcgtagtataatcttaacctcagtcgtgctgggtgtgtgttgccaagcttgtttgccttcaagacctgcagagcaagcctgcaggccgcccccttgccttgtggctagtatggaatgcctgggccgcagagcagctctgtttggatgttttaggaaggatggtaggtgggcttctattggttgctttgaaggtgggtggaaccttgttttgattgagagcctgtttgccagagcaaattataatttttgtgatctttttctgaagtctgacatattcagggaacagttgtgaattatgattgcaacaataacaccttaaaattgatttttttaaaaatgaaaggttatgtcacatcagtttttacttagtctcttgccttcaaaaggaagcagactcatcttccttttagagcttatggaaaattctttggcaattaaaaaaagtatgcattgacttttgtgttagaaattgaagtttaggtattttgtttatttttgtatctgttttagaatcggatagcattttttgcatatgtgtatgttgtcatgtgacttggaattctattctcttaaatggagtaaaaagagtagttggtgctgagaaggcagtcattgacaaggcctcatttcgtacccactgcttgatagccagacactagtttcttctacccaggggaagttgtgcttttggggtgtcctgttgcagagcaggttcagacagatggctttcactgtggtttatttagggagccagtcagaataagatttaggacaaattgaattcttacccaagtagatattaaatgaagtttttgaattatactgtttgctcctttttgtttccactcctttttcttctgataaaggttagaaaaaatttgaatgccacctaaattttgtgcatttgtgaggatggaagaaagcatacaatatagaagaatgtgcaactgaaaaaccctcataggaaggagaagaaatttactatgcattgatacaaggagaaattccttgtgtaagctcttagtggtgtagtgtgaatttggagtgttgcatggtcaactctttccagggaggcccttgattttagtggaaagtttttaggaaggctaatgttggtgaattctagtcactgaaaatattactgaagtataatctgtattcttacagattcaattttgggattgcaactaaggagatgaattgtagaaggataatttagggtgtgcgtttattatttttgtgatcaatttttttacccatgtgagggctttcttcccattgtgaccatatttatttgggcattgcactggggagttttggggaggtaccccataccatataatgttgcttctggaactcgccttattttactctgtttaaaagcaccattgctcttccttcctgcttcttttaataaaagtatcccttcaatagacgagaggaactggacactgcaccactttctgtcatgcacttgtgggatctgggcaggactcacatttcatgctcaaggaacaaactcattgtttgagtcaggagaatattgcctttctgttctagatctttacctcttctgaaactttctttacagttaacaaataaaaatgtgaacaggaagctgtgctcacagccgaatcagctctggatcaggttcctgccactggtgtggctggcctgtgtgggcctagtacaaatctgtatttatggagcttggatgccgccatctatttgatggtgaagacttgtggttgctgactgtgatctgtggatattctgttgttaagagtcgaatttgtctatgtttcaaatccaataaagtaactctaatgagtgtggtatgtatttcttctatattatcctgtctgggaaaaatattttttggaatgctaaaggcttgcttcagggcttctgtgcttgtctggtggaggaggtgagggaacagcacatgggaagttactctggtggttgatgaagtctttggtctgtgtagcttgaacatggaaaagatgctagtttgtttcattttggcttatggttctgcttctgttgcacttgagaatatcaggaaatgttgggaatgtagcaagtagatgtttcaaaaaatagagaagttcacaaagttaatatcttattagttgttcttatcattgtaatagaatctcgaattcgaatctgagggagcctcacatttaaagcgttcctctgtcaacataagttttgcagtctgtctttggttgaaagctagaatgaacttgattgtgtttaattgacatgtcacttttttttctttttctttttgagataggttctcacgctgtcacccaggctggatggagtgcagtggtgtgatctcagctcactgcagccttgacctccctggggacctccctaggctaaggtgattctcctgcctcagcctcccacatagctgggactacaggtgggcgccaccacacctggctaattttttgtattttctgtagagaagggatttcaccttgttgcccaggttggtcttaaacttctggcctcaagcaatccatgctgccttggcctcccaaagtgccaggattacaggccagcgtgcctggcctgacact

SEQ ID NO: 51332 - DNA, 1001 bp, Homo sapiens
ggattcatttttctacatattaggatataaccctgagacaaggtaagtgagtcacttgtgtccattcattgagaactcttttccttttctcatttgtgtgtgtgtgtatgtgtgtgtgtgtgtagtttatgcttctggacatacactagtaacatacttaaaaaaaatgactccagagtccttcagtaaacttctttgggaggagttgtaattaatgtctttgacatctaaagtggctttttgtttgctctttacttttattcagaaaaagaaaaatgagaaaatttgggttgaaagaaggtgggataaagatatacttttagtttatctgtattttgaattaagtattaagaattggtagattatttccctgattcacattctgtcaagccttccataataccatattgaaaaagactaagtaattttggaaagtttgttggttactcatttgttttgttcactcttggtaataaaactccaggaacacacactgaaatatctttagtaagactactagtatgagtcagacacatcaagttctcaaaacatcttggtaagatctatgtaacagtttgaattactatttttttaaaatgagaagcaatagggtcagagtaatttaacaatttttatgtctgtcatagatgctactttaatgtagcacgtggaagaatttttatgagtgtatatattcatacttgccctgtattgatcatgtgactgcatattttattaaggattttaaaaacaggatgttagccactgatcaagtaatatatgctctggacacccaagacatgtttatacatgtgaagatttagaaggaaataaaacatccccggccaggtgcagtggctcatgcctgtaatcctagaaccttaggaggccacagtgggaggattgcttgagcgcttgagcccaggagtttgagaccagcctagctaggcaaaatggtgagacctcttctctcaacaaaatataaaataaaaattaactgg

SEQ ID NO: 51333 - DNA, 1384 bp, Homo sapiens
ggtgtcacgtgtgtgtgaacgcactggcctagtggtgcagttttgtgtgtgtgtggacgtgctggcccagtggtgcagggtcacacgtgtgtgtggacgcacttccctaatggtgcagggtcgcgttgctgtcacttagtgatccggcctcgctcttggcagcagcgctcactgtgaaagaagctttgcctgtcccattactcccataaaacagaatgggatggcagtgccccccagcagtctctgtttgttctctttctcttcacgaaggtagattagcttaaaaaatgtttggggtgtatttggtgggggatggttaaagttaagctttaccttttttttccaattttcttctcatagtttattcacagaaataatttattctttctccatagttataaaccagtactactaaaaataaattcaattttgagagagatacaaataaaatagtctgtgggcacatgaaaagggatcaaacaaatgtaatgaaaaaaaccatggggaacaaaaaagaaaaaagaaaaagactgatcatgttagtgcttagcaccattcttcttgaagatcaaagggctcggttgtgtggtttcatccggtcacagtaactctgagggggctcttgccattccattcactcaggaggaaactgatgtataaggtttgctttcaagctggtgctagagttgggttataaaggaggagagagagctttatcctttagccatggtgaatcaaaaggaaaacaaaatgccctgtagtttctttgtaaattgtgagattatagctttttcctaccagagtttcttcctataagaaaatctgagcccttcgcagttgtagaaatgtgtgttgaagttcagcattactgcattgctgttagttttgaattcttgaccttagctatcccttatctctacctttcaaggtaagtttctacagctgctgatcttatttcatcacactttatccataaccaccatagagtaaagttagcattttgaatattttttgagttctgtttattcccgggtaagaatttttggctggcattgtggtataatagactgaagttagaggacttgtgtttgagtcctggctctgctgtagccttgtggccagtgtcacgttttttaacgtttgagctaacctttgacaaacttgttcaaggtcacatgactaatgacagaatcctgaaccaaacacacacatctggttccacatccagtatggtaaggagtgtgaaagtccctcaaagagcatctcaggccctagtaacatgtgtagtacactccatagctcattgaatttctgctgagttcttaaaagtataagtggaagaaaagaaaaagtgaaattaagtgtaattttgtactgagttaat

SEQ ID NO: 51334 - DNA, 1576 bp, Homo sapiens
actccattttgtaatatttagcaagaaaaataagacaggatcactaagtattttggtagttgaaggaggtgctaggataagatagttgtttttcttctttttccatttgtgcttaatccattttggcaaaatatagggtcttactaaggggtataaaacatagccaagaagatactttgttgacaaaaactgtacattctgttattgttattcttgcaatttatgattcctcttctctattttgcatacttaacgatgctaaccaggcccggttatttagtgggtggtaaacgtgaaagaaaagttttacaaattttttttacttgttttgggaaactcagttttaatgtcgtcttaattaattttttgacagactctggaagagaacttgtcattacagacccagttatcaagaaccgagagctcttcatttctgattacgttgacacttaccatgctgctgcccttaggtaagtactggagacgtgctcttccatgtgaaggaggagtcactgagtgcaggaggtggagagtaatttctcctgatcttttagtagtcactgtattaatcagactcctcttttggcctcagtgaacatgccagtgtccgctctggattgttgagattgcagaggttctccgtgtcttcactaatctagctttacttctctctctcttttttttttttgataatttactttttaatgctgtttctatattattgtatcttcatttccttggaaattattatcctggtattgtttgctgaagtatgtgggtgaaatgttccgatgggccaggtgtggtggctcacatctgtaatcctggcattttgggaagctgaggtgggaaaaagtgttctgatggtctgcagtttactttctaaagatttaattcctgccactagaaaagacagagaaatggatgaagcagatatggcagcgtgtaattacttgagaacccaggcaaaatttatagagattttcattgaactattcttccattttctgtatgtctgaaaaatttcctactatacagcttcattggcagggggaggagatgggtagaaagatattgaagatttcattctgaggcagaaggtaacattccagccagtcataatgtcttcagaaattatgtcaaaaaaatgaccatgacatttgcatctttgggtattttctgtctctttcaagaaaaggatgcccataatggctcattttgtgtgtgtatggctgactttgtgccttttaagtggtataggaagtaagactactgatattcttaaaaccctttcctcactggaaataaagtggtgaaagactactttttttttgttaagtactgtaatatggttttaacaaaatactaggattttggtagcttttatcttaaaactacaatgagttacaataatttctccattctgatgctcagatggtattcaggaaaaccacctggagtcttttttgcaaagctacatagctaaagtcagttatttcaaggtaaattagtagcaactttagggcaggctttggcaagcttttcgggtcagctgatgtttcacatggtatctgtt

SEQ ID NO: 51335 - DNA, 1019 bp, Homo sapiens
tgtatctaaaaggtatttctgttgcccttcaggttttcagatgtcttaaatgtgttgcagaaatacatagatggtagattttaaaagattgttgttaggagtgctagtagatctggactcctgtatgctcagtgaagtaatacatttctgtgagcactgaagcatgtattagtagctcagtgactagagatcactatcatcccttgtaggaaaccaagttctggtgaagaagtaactcccacacttctcggcacagttcttcagatttttctgtgaactattggttacaatcacctaccaatagaggaaacaatattcattgagcacctactcagttctagatgctttctgtcttttctattctttcagtaattattttaggtagatttcagtatctcctttttacagaaaaggggagattgggagaatctcggtaatgtgccccaagtcacatacatgggaagtcatggaattgagattggagggggccacaggccttcccatcttctttccagtaggccatcttccctaccctgtagtgctcgaaccaggttttatttttgccattctgattttgttttccttaaaaaacaaaacaaaatgaattactagaccagtgatttctcaactagggacaattttgtccccacaggggagatttagcaatgtttagagacagttttggttgtcagaactggacgatgggtgctactggcaattagtggttagaagccggggatgtcataagcatctaacagtgcacaggcagatccccacaacaaagaatcctctggcccaaatgtcagtagtgctgaggttgagcaagtccttattatagacagcgtattttaactgaatgcatccccaagcactgccaaacaggtgctgcttcttcccctggtttatatatattttttctataatgagtaatcttatcctggtcctgctttttattatcctgccgagggaagaaactaagttttcttggagacaaaatataatttttcctctacccctct

SEQ ID NO: 51336 - DNA, 1142 bp, Homo sapiens
tagttaccagataatgatttctttattaatgcagaggcagtagtctctataaattccctaggcctggttccactatcttttcttctgtgtggtcagattgaattttcttgggcgttgtttcattttatgttccaataattatttactgccatttagaactctaacagtttttcttgttagcctatctgacataacattgatggtagagctagaaaatgatttcctacaattccctctatagctaatttttaccctccaattatagaatacggtaatattgttaataggttagtggtggctctattatgtgttaattaccaagagtcagctattaaagttttcttttgacagtaaaagcttttctgaacacagaggattaggaacgttttcttgattcttgttttaaagatcatcatgtgatggtagtaggcagagagctggaatgtgcatttctacgtagccatgaaatttaacttgtgctaatcgtggtggttctgcgtgagtaacagacatggacacagacagcggaacacagtggggcatagctttgtgcttgatggctgctttaactttggggctccaagcaaggatttcaagaaacatttctttggtcttaaaaactgggaaattaatagatcttctggacaggagggctccctaatttctgtggggcatgtgcctaaacaagggctccttagatattaacataacttctttgttagtaaccttgacaaaagctcaatttttacatgtatttatttttcatataaaggatcttttactgttttgtgttttaacacaaggggcagatgtctctagctctgagctgtgctttacagcatgtcttgtcttttgaatgtttctttcaactggagcagcttcctttgttaaaaggccaacaaccccctaagtgagatgttcttggaaagaccccttgacacttgaaaggtgagaaatccatttaaaccatgtgatgccttccactgctctactgctgggttctgcttgttttaatattagtgatagatgctctggctggtgtattcagtaattggaagtgaactatataatataaatgacatttcatggcatatgtgagggcacagtggatgacacttgatttcagtgttgcctgcctttag

SEQ ID NO: 51337 - DNA, 1135 bp, Homo sapiens
tataatttatttaataatatctttagcatgttttgaagtagtacattatagttttttgttttttatgagcccagttgttgtactgtccttgtctgtaggggtgttattctgttctgtattctctttttaaaatagtaacattatatgaggtttgtataatgtactttgcttttgcttgtttttatgcgaatttaattttcctgaatttttaactttacggagctcccccttctgttgtttttatgcagtgttaaaaaaatggcagcttgctgtgattttctgactctgttcctctccttcactttcatttggatcttcttttttctttaatttatttaaattatttaattaatttaaattattttgtattttttgcagaatttatattccattactggtagtttctcccctgccttggctccttgtgccggcagggagctatggtgggccagttttgaagagttcaaaagtgtctagatgacttcagcccctttagccctgcaaggtctctgggggttctgacctgctgtcggcatgggcaaccccaccaggcttcagctgctcttcacacattggccttcctcattgcctggtagctattttacggtcctcctgatcttagctgtatcccatatctcattgattgattctgttttctctcgtgcagatgctcatatccagagatcttatggctgatggtagtttatcccttccaacctgcttatattttgcggtttgtagagatgccttatttctgaattttgttgtgtgtcagcaggaatttgctttgactctctaatctgtttttgtgtggggattaagggacatttgtaaactatgctgccaatgctaccatccttctagtacttctagtatgttagtttttattgaaccagagttttactaagccccaggaccgcagacacttgagttcttaaatcttaacccattatctctcatggctgccaccattcctgtataaaccatgagggagaaatagatactgaagacaagatcagacagaggaatcgttttatcctttgctagttggcttttgtccccaacccccattgatatgatctagtctgtgtcagaggtacaagcatgtaagttttttctaggatttttcctaggc

SEQ ID NO: 51338 - DNA, 1036 bp, Homo sapiens
aacttttctgtttaatatttaacagttaagtatggatatggacaaatgctttagcattttttttttcagatgaaataaaatggttgatacccacataggcaaagaaattttacccaaagaaaagttagtccacagtcacagataacatggtagatccaaaccagcagctttttttttttttttttggacacggtcttgctctgtcacctaggctggaatgagtggtgtgatcatagagcactgcagccttaagctcctgggctcaagcgatcctcctgcctcagccttttgagtagctgggaccacacaagcacatgccaccacacctggctaattttgtaatgttttgtagagatgaagtctcactatgttgcccaggctggtatcaggctcctggcctcaaatgatcctcctgccttggcctcccaaggcactgggattaacaggtgtgagccactgtgcctggcccccgcagctttttaataatatgcttttgctcatcagggcctcctggaagtgagtggggatggctctctgccaaccttctttaccatcaaaagaatggttcagagcgcatctgattgccagtgattctcagaagtcttatttatgctaaaggataatatgttactattaaccatgacattattattcaaactgtcttaaacattattatttattaatatattgtatttacatctagtattagttgagactatatgttatatgtagaggctcaaatgttgagactatattgtagtatttgctcatagttcacttgctatattgctggctaaattattataaaaattgtctgtggtttctgcgcctctgtctactttcacagatgctttgttaccactgtaaaatgcagtacattctcactgtagccattaaatctgattttatattaactagttgactgtgacatttttgttgtatctttctacccagtggcatacacattttatgtagtttgttgtaagtacacacctctgatcatttacagcgtattttatgtacagtcgtgatgaga

SEQ ID NO: 51339 - DNA, 1066 bp, Homo sapiens
agatgttgtgagacgtattctctaccatgagaacagtgtgagggaaaccgccgccgtgatccatttatctccacccagcccccgtccttggcacgtgggcattattacagttcaaagtcagatttgggtgggacacagccaaccatataatatggttactgtggtttaagtaggcagacacatctgtgagaccaggagtttctctacaaatggatgaggaatggcacagaatcctaggtgacagtttaaggattgcatggcagaaaaggctctgtgattaaattctctgatgttgtcactgagctgtaaggctggagataagactgtctccttctgctgaaaataagaatcaatactcactccttgatgggctaaactattaaaaagagcccttcttacaatgtttcattatctgggatttgcctcagctggtgatttgttggtggcacagggagatttgtgaggcatttcatattaaaattagtcagtagccggtgaatccctttagataattctcttccgttttacagtgctcctgaatagatttgtgatttatttttgcctaagtagctttgtgtttttttggaattattaaaagagggttggacatctatacactttttttaaccttgtttttcctcatattctctgtgtttaacagtttagtattggccttagcaaaaaacatcaaatatatttgcgtggtacattgacctgacacttgattaacacacgttgaacttgatgtttttcccgtatgaaggaagttatacaagaagttggccttgcttttttcgttgattttaaccgtggacagggttggggttgttaattgttaggtggctggtaggatttcagctcctcgattgaaaaagaaaaacagcccatctcgtgaacctcagtgaccaaaagaaatggtcactgtgtcatttgggtgcttgttgtgtctcatcccagtgtagtgtgatggctagggagcaaagagaaggcgagcctctgagggtgacccctgccccgctgtccgccaggctgggagaagttctgcaggaggtcctgtcatgggcag

SEQ ID NO: 51340 - DNA, 1027 bp, Homo sapiens
tcaacctcctgagtagctgggactacaggcacgggccaccatgccctgctaattttaaaattttttgtaaagacagggtctcctccttatgttgcttacgttgaggatgtggaacttctgatgcagttccagggtctttcatgtttttgaaacttgagtatgtttacttcaaaaatagtttttgtgttcttctatattacttaatttcctcccttccccaatacacaaattaggtataatttgtgtgcttatatccctaatgcagctataaaaggcagtttataaattaatttcaaaccaaactacaaaaccaataaagttctgactaccaacattaatttaatagactgggcgatgatgttgtgaaataagtagccgcttgtgatgtaactgttactgcttccttatggcccatgttcttggatgctgggatggtgcctggtttgtgtagacggctggattccttgtaatgactcggttttcctgttgcttttctttcagttattgccactcagaaaccatcagtgtaaatacagcttgccatgaagtgactttgcctttgtttggcataaatgtgcccttggcacattgaggccatcttgtttatttaccagcttgtgataattatggtagtactacttagttatatgtaaacttagagccaaaatcttgtgcctctgaactctattaatgaagttgtaaaacatgtaattccaaaaatggatgttaaaaatattaaggtatacattgaaatgaaaaataaaagtgagcctctcctctccacctcccacttccagtcatctctcgcttctgcctgagaggcactgtcagccagcatcattctcacatcatgcctctgtacgtgtctgtcctcttagctagattaagagaaggggctgtgtttcattcacctttttgtccccagtgtctggaacagctcctggttcagagaaattgccccctatccattgtattgatagtttgttttaattacaagacagaaaagtcagattgattttttttttaa

SEQ ID NO: 51341 - DNA, 1035 bp, Homo sapiens
tttgtagagatggggttttaccacattggccagggtggtctcgaagtcctgacctcaggtgatccacccgcctcagcctcccaatccaatcaccctgggattacaggggtgagccaccgcacccgtcctttagttacctcttaaagtaagttgggaaggccaggctcagtggctcacatctgtaatcccagcactttgggaggctgaggcaggtggatcacaaggtcaggagattgagaccatactggataacacgatgaaacctcatctctactaaaaatacaaaaaattagcagggcatggtggcatgtgcctgtagtcccagctacttgggaggctgaagcaggagaattgcttgaatcagggaggtggaggttgcagtgagatcatgccatcgcaccccaacctgggcgacagagcgagactccgtcttgcgggaaaaaaaagaaaaaagttgggaaagagttgatttgtcctgtttttcaagggaataactgtagatttcactttactgaaattagttagagacattgttatattgactgacaagagatttcgtggtacaatttcccactgatccattaggattacaaaaaattatcagctgtatgggtggcaaacacttttcttcagatttttcttcagtaagataaacctcaattccaagcatcacagattttcttgaagcagaaactgtgccttacaaaagtttagcacagaagcagatgttttatgtagtagtggaagggtttagaaattgttgtgtggtcagttgtttggacttcagaatgcatttctctataaacataaacaggtttttttttggcaagttcgtaaatgctagtttgaatttgtaatgtagagaaatacagaaagatcgttcctttattgcccaccttacagatatgtggacttccttccttccttccttccttccttccttccttccttccttccttccttcctccctccctccctccctccctcccttccttccttccttccttccttctttttttaaactcctcagcttgc

SEQ ID NO: 51342 - DNA, 1853 bp, Homo sapiens
tggtcctgagggatgtgtaagaggcagcaggatgaagtatctgtagtgctttatcccttaaaacacagggacccatgtgggtgatcataggggttattatcgtttagtacatctccctttttttaggaaagttcacacttgtcttccttttttttcctgtaatggtaggacttaatggaggatttaatggtagtgttttctgaaagtcgagtatttattattctgaatgactagtgggttaatatgaaagaagtgtagttgcagttacattgacgtcagtgtaaagaagtgactgtggtgccccagttcatactgaattagcaaataatacaagaggatagcaagctctctcacacttagacacacacaatgcaagatactgtcaatatatggtgagttgttcagctgcagtgtagaatattaatatcttgggtcgtagaaaagaaagtgctccagatgggctgtggcacttggggaagttctgtgagggtgggtaggttttgaggagctgggtatgtttttcatacatcaataagaagtggataggcagagtgtaggagccttccaggtgtacatggcagcctgtccttataagcaacgcaggcagtgaggctgacgagtctgggagttgtgagaagatgacccgcaggacgtcactgaagagcacaggttagtggattttgggaggcagatgtggagatataaatggggctagattatagaggatcttcaaagttagcaaagttaagattttgtgtaataggcagtagagagcctgtgtaagcttttttactctaggcaagccatcttgcaggccactgcttaagaagattgactgtagcagtttgcagtgtggaacggggaaagatggtgaaaattccaagtagaaggctagggccgccattcatgggtaagatgaagaggaccaagacagtagagatgatatattgataattgtaaccaaatcaggagtaattgttgcaacagcataacacgtttacatatttgctgatgtaattactcaagggtcataccaaaaaaagggatgggggtttcacattatggaaaccttggaattctctgtcttacagtggaagacagaacccagtgtagtatagataaaagtctaattttaattcccagagaaagactgacatcttacgggacaaattagtagattcccaatgtgactacctacttctaaagcttcagcctttagcaattaccaatatgtcttatttaccgatatgtcttatttccacatatatctaaaaagtaggttttactttcaggctgatattttcttaatcaatgtggatgctattattaatacttttatttactgtaatactcaacaggaattgctgaatggattttaagtcttccccataataacattaatttttttgtaaactttttatattagaattaatgattagtatttattttttagcaataaaaatatttgtgtctactgatgatttaaataagttcatgactggtggagcacttgggtacattatatgtaggtgtaagagattctgtagtgaaaggataaatcttctttcagtcaagatgatgctacataaagctaactgtattgattgttctttaatgatgctttgtgctgccaaagtcatttgagctggatctgaatcagatccagttggcaaagcttccccatatgtggagttctcataaatcctgcaaggcacacagatctaatacagtgtaatgagagagctgctgggagaaaaaattgattacagggttgcagacaatatcattaacatttcttgccatgatacaccagatgtcttccctaatagactatttttgttaatttagttttt

SEQ ID NO: 51343 - DNA, 1026 bp, Homo sapiens
gataaaacattctgaacattagcttattttcctggtatttgttttgttttgtgtgtgtgtgtgtgtgtctatgtgtagggagcttaagagacttacaaaaatagataatgaaatatattaaaatctttgtttacagaaagttgttaattgctctttgcttttcaaagggaattatgtgtaacaggacaccctaataatgatctaatattaaaaggttgttcatctgtaatttttagacaaccgtaagacaggttcttatataagtattgggattttatggattttttttagttcattcaaaaccacatgaaattggtttaaaaatgttatgtgctgtctaaaatatttgaaaaggaacatactcaaactgttatctgaggtatactgtgctagctttcagaagttgctctatagtcttttttttcctggtttttaaatgttttcaaagttaattttaaaaagacacgtgatacatactaaactagttttgcctataaaaataagtaatgtctttctggaactttatgctctgtgcctattcattatactcaccttgtgggcgtttggagaaaattataactcatgtgaatattgtctttttccctctgttttggggcctttgtctatttactttgccttcagctttatacagttaaacttgaactttgagaaaatggcagggcctttctttggccacccaaatgccctatttccttattaagtacatgtcttatgtctctagcttctgtcattagaaactcttctgaaagctcagtttgtccacttgtgattcattttacggttgtatctgacaccattgcatttctgtttttattataagcatagcatgttgctgttaactgtgctttggcactatctcacatcttaacttggttattttgaggggcacacaccatactgctttatgataggacctggattaaagtgtggagccagaagggtcatacgtttgttcacactgaaataaggtaacagctttgattaatgcaaaaaggttaactttag

SEQ ID NO: 51344 - DNA, 1008 bp, Homo sapiens
ttgtgatttctaattttgtttaattctttaagagttaagaggtaggatggaattcttttttttttttttgagacagagtttcactcttgtcacccaggctggagtgcaatggcacgatctcagctctttccagcctccgcctctgggttcaagcgattctcctgcctcagcctcccaagtagctggaattacagacacctgccaccacccccggctatgtttttgtattcttagtagagacggggtttcactacattggccaggctggtcttgaactcctgaccttgtgatccgcccgcctcggcctcccaaagtgttgggattacaggcatgaaccaccgcatcaagcaagatggaattctttagccctgagtttggtgtactgagtcagaggaggttgtatatctatactcccctcccgccacaattatggagtaatggtgttgaaagttttttgaacgaccacatcctttttgcatgatactgatgtcaacctctagtggacagagtggtattaacataagtggaaatcaaaatgaggccttgggaataaataatcccagcattttgctggccccattttctgagcttgccagcaatttgtcttcactcgtggctgccagtcagggttgggcacttgggattttaagttttagtgtttaactactactgtgaggttgggtaattcattttcttctaatttacttgggtcaagggactctaagaaactattgaaaaagttttgtttaattatatatatttccataaaatatatttctgaaaatgttatttactaaaattgttatctatatgtgaaatttttttcaatgcagaaaactctaggtattctaattttaaaggagcttaagaaaggttgagacaatctgatatttgcagccatctactgtgcaagaatattggtaaagtcttgttcaaacttaattcttttcaattggaaatttgtaatttgtatgtatatatggatgcttgcattaagaaccaactcaa

SEQ ID NO: 51345 - DNA, 1019 bp, Homo sapiens
aaatagtaaaatagctggcaaagtctttatttagctttttgaaggactagtaatacggaatgacagtctgtgatccttgtggcctggcatgaaaagattaattgagccaaatttcatttttagaatttagagttgagaaactgagagactgaggcagttagtagaggggaaaggtgaatagataattcaagaattacccctaatatatctgtaaaaattaaaaataaaagaattacctgaatgacaagagcaaggttagggctggcataggcaagctcacttgctagggtaggaaactgggaaaagcagaggacaggcaagctgtgggaagagcagcagactgccaagggaagtgtgtgcacagccgtctcttccttgactctcctgggtcccactgcactgatgttcttcccacaggattcttagattatcctgttcgctctgagtaaagagctctcacctggctagcttgagtggctcttcatgaattgcaatggaaagagcctagattaatatctccaacccttctgctgccctcccatagcttttataggtcaccatgtgacttacttacttttagggttttgttctgaatgagtcaatatcattgaggagcattatatcacagagtgcaaatagaaatgttttgagctataatcagggacttccacaggcatttactgaatacctgctttgtgttctttatggaactcagcacctaaagggagactgaagaagtataaaatattgttcattccctcagtgatcttagattctaagtggacagacaacttgtggcattattggatgtcagtcttctttggagaacattctgaataggattgacaagaagggcattcactttagttctaaaagaaatgatttgtttgtttacgaaaaacaataaaatcatatttttatagaaacccaggcattaagaagtataatacaaataatttgccatctggaagtaatcatggagtccgagaatgctaacaaggtcatggagacactaattt

SEQ ID NO: 51346 - DNA, 1146 bp, Homo sapiens
aaatgtgctatttacttctaagatggatctattcttgataagcggcttttaactttcctggttgcattgcaaggtggccttgcagtttaatcttgtaaatcaaatgctttctatccagtttttatgtctatatgaatttttaaaaaccatttttagaggtctttgctacttattatatctttccttccaaagtgtgtttttttttttttttttttttttttaaacagatacagcactgacacctgaaatacgggtgtagccttattcctgaagagttttgttttggtagtggctgctgctactgcccttttcctgcccattgtctttttgtgtgatttttactaaaccaaacatcagtgcaccgtgaaaaatatatagctgtgaaataaaattgtaaatatttttattttacctattagatcttgagccccctttgtacagtttttgcacattagcaggtgccttcctgtttgaacagcatctcttatgaaatgctgattacaatgtgatagttgctgttctgggcagaggttcctgctgagttacggtaattgctcagggtattaacagcaataaaagctaaagcttctgttgtcagtattggtctaatacaacacattaaagctgtctacaaaaacagtgtgggaagtagggtgcagtatgtttagatacctttttctaaatcacacactgctgtttctcatgtttttgtttgaggttctgtattcagcacatcctcatagttgttgtgtaagaacaacagatgatgaaatatttgctctgggaataaatatagttatttccactttcttattttcttacttctctgtacttattaaaagataatcagatgagaatgatcaagatttttttctccttcagtttactgaagctataagggtaaaagatgagcagaaggaaataagctttgtttctctgcaagattttaagaagaagaagaaattgaatttgattttgctcccagcaaataacatgactagtggagcaatgaaagaaacaaaaacccgatggctttgaaatgttgagtaattaggtattttatctttttaataatcataaaataaaaagttggtttggggttataactgagagatgtgtttcattgtttatactataaatgagaat

SEQ ID NO: 51347 - DNA, 1616 bp, Homo sapiens
ctttttatttaagtgtcttaacatggcattttaaaaagcaaccttggccaagcgtggtggctcatgcctgtaatcctgacacttcgggtggctgaggtgggaggattgcttgagcccaggagttggagaggagaccagccaaaacaaaacaaaacaaaacaaacaaacaaacaaacaaaagcaacgctttacactccagtcattgagagcatcaaaaattattttccaaccactgccatgtcaaatgtaatttaagaaagcacccttcttccctgaagaaaatgcaatttggtttactttattccatctctgattagtggcattgtttttgtttacagttagaaaataaaatgtgtttagggtacaatgtaatggcaaattgtctgtaagagattagttttctttctctttttgattagttgaaaaggtcattgtaatagcatgttcaagctagtcatctttgcgtatttcatttatttcctcacaaaatatttattacaaatatagtagcacgtggcaaagccgtttctctttttcgaagacatgtgaacatgtatctgaataagatactcaagatttcatcttgatgtgtgatcttgagcaagcggtttcttttatctaaatgtcttcatctgaatatggataatcccttggactcctccccttcttcttcagggactctgaagaaaataatttaggcttcatcagattctttaaattattagaaaaataatcagaaagaaccaaagggcagttttcctttagcctaaagatatttgcaatttaatatcatcttttggaaaaaatttacaataaaagatatgtgctttgtcatttatttatttatgcagtggctttatgggccctgtctttgttccttaaaggtaaatgccattgttttaaaatttctttttcttttaaagactgtgtgtatatcgagagtcggaggccaaacacaccgtatttcatctgtagcattcaagacttcaaactggtaagcgtttttaatgtgctgttcactctgctctgtattctctctttttccagttccattggctatctcttattgttcctccatcgctgttgacgtggttaccagttcaccttttgagtgctaactgcctcgtggcagtagcactgaaatgagggttactagttccatcttttcagctttgtaacacttactctcataatgcttatattgtaaacaatatttctgaagtttttatccctttagtaacttttgacaatttcagatagtcccttgaatttctgaagtagcttgtttcttctcagccattgttaagagcctgaagtaaagtaaattcagtaaattgatgagtaggggaaataatataaacgggtcagagaatagtttccagtggaaacctgtcacttccttcaatatttcggcaggtgtggagtatatgatgttgaaattgttgtgggggtttcccggggtagcggttgaaagaagtctggcttgggcgtggtaaagttgttatactttctttccagttttagtgcatgtgttgcagaagtaaggacatagctactgtactttctcattaaaaattcttcctgaatatataagtgttgatgttcctcattatgaa

SEQ ID NO: 51348 - DNA, 1048 bp, Homo sapiens
atgcacacacacataacatatacactctttgtgtgtcttggaaaatggaggacatctgttttaactgtagagagatacttgtggattttttattctgcaatattagaccaacatactgtacctcattgactgttacctccaagcattgagggtggaggagtcatgtagaggagaaacagaaagcagaagagcggtgcagtcctgagagtcaacttcccatttcaccgctgtgccacccagcttggtctctgagaaatctctttgtgagaaagtctttgttcatgcgtgctttttacaatggggttttctattggaaattatatcagagtggcactgccatgctttgcaaagggatgagaaggtatttcaaagattaataggcggagacacattgatggaaaggaaaattctttatgaggtggagcagtggctgagcattgcctatatatgttgtgaccacagttttagtactggcgtgtgtggcactgcttgctaaattagtgggtgaggtaagtgtccactctgctctgtaggaggctgtcagaaaagatgctgacaggttctttgtgtttcataatgacacactgcctaatgcttcagactgagatttttacccttgaggggactgtgcttttgctatatttacataaacctgctgatttgctgagggttgaaaaagcagagagggccttctttgccttgagaatctgccttcacgttttggctgacttccttccccagcttagcaaatgctctgttgtttacagatggcacaatagatctttggacatgaagctatgctgaggttgtgagaaacagccagaaatacctctgttcagtatcattgcccaaattacggattttgttgctccctgttcacaaggatttgaggtcacttaatcctgtgatccattcccagacagaggttaggtgttaagagagtaggtctcaacctagacccatggtttcatttctagacatccctagtaaagacacattagttatcatgtgttgtttggactaattgatattgatggtaatagcctca

SEQ ID NO: 51349 - DNA, 1048 bp, Homo sapiens
gggaggcggagcttgcagtgaaccgagatcgcgccactgcactccagcctgggtgacagagcaagactccgtctctaaataaataagtaaatctttattctttgacttcaattagaagaagtaagacctgcccaaacaacagcaatgacaacaaaaacccgaatgaaaacaacaacgatttaagggagagaaggagtaggtatgggtagatttcgagagtcagggaacaggtttcatttgccctttcaagtttatataaactaaagcaaacaattaaatttgaagcctgctgacactgtaatagatttcaagtaagctggtagaatttaatgaagtgtattagatgtcagctatagtattagtagcattttaacaatcagccaataaaacaagagcacagtcttctgtgcctgcaactttgtagaagatgttttatagtggtatggtactgcaagataaaaaaagtagaaaggattttagcccttgatccttcattttgtggggagaaattgctctcatttagggaagtgatacgttagtaataggcattgagtgggcagataactgaatagaacaggttgtaagttggtggcatttgggtcctgaaggttgagcaggattgtgataggacctggttgggaagagcggttgtagtagcagcagcgtgaggatgggcatggcttggtcttgattgaatgtgtctataggagaggagaaacaaagccaggtgagcagactttgcttgctgaatgaaaagggtgtctctgtttttcctttacttctcatctgtcattgtgtgaccctggtggttatagtttggggcagcaaattctgggtccttaccttattactgtttgggtgttgatttgataagttcatttctcttcctcttttctttctttgacagagtctcactctgttgctcaggctggagtgcagtggcaccatctctgttcactgtagcttctgcctcctgtggtcaagcaatcctcccacctcagcctcctcagtagctgggaccacaggtgcacgccatcacacctgggta

SEQ ID NO: 51350 - DNA, 1054 bp, Homo sapiens
tgcagttaccaaattgattgtggcaatgttagtaatactgtgtataattataatttttcctttttagtagagggaaaggaaatgtcacaaaaaggtctcacctggtatgctgtatttttacatccttaggaacagtttaactgaaaagtagtagtttaattaccactatttcacagcatagaaatacacataaggttttgaagtttgcatctggtaattactctgttagcactcagacttggggagatgatatttcttccttgcaaggagttatataactcagtttctaactagacaatggagacttgatttccagtttattctctggactggctggaagatatttggttggagaaaaactcggagctatctttcagggttataaaccagaatgattttgaagtctgcagcagctatccccaaaatagatatttggcatcatggagcgcaagctttttaaagattgcagttggcatttaggtcaggattggtggaggctggctgttgtagagaccatcagttttgtcatatgttttacttctattatctcccagttgtcaggattctaagtgctgtggcatctgatacatgaacgtacggatttccagcacccttttcagtgttgtttctctaacttagcttctgtaatgattaagcgtggtccatttttatgttctctcccctgaatttacttactgcttcttcttttgccctttgagtacatttataatatttggctatagacttcaaaaatttttcttggctgggcgcggtggctcacgcctgtaatcccagcactttgggaggccgagatgggaggataatgagatcaggagatcgagaccatcctggccaacatggtgaaaccctgtctctactaaaaatgcaaacaattagccgggcgtgttggcgggtgcctgtagtcccagctactcagaaggctgaggcaagagaatggcatgaacacgggaggcggagcttcgcgccactgcactccagcctaggcgacagcgagactccatctcaaaaaaaaaaaaaaaaaaaaaaaaatttt

SEQ ID NO: 51351 - DNA, 1046 bp, Homo sapiens
ggtgtcataaaaaaccccaaaccatttgctgagaccaaaaactgtagtttttaaattttaacacttaatttttctcctgtggcttgtgcgaagtttttaggtgtaaagcatgaataagtaagagattcatttaacaaaacattattttaggaaacaaatatgaaaaagcgttaaaaccattcttttttctctcctagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggaggtaaggagccttacgtttgggtcttgccaatgtttacagtgggggaatgatcttggcattatggtgaaataaatacgctttgtacactttaaggaaggcttggaatctagaagagtaggaaacttaatttggtaaacatgtgacccacttttggtcagttaggttcacccacttcttgcttgtgtctgccttaatttgctcttgtgtcctggtttatgcattcatgagttcttttcttattttcctgtgctgcttgttctctaactggaccatctgcttagtatttttttgtcttttgaattcatgcttgctttttaatcttcaatcataaatgagactgtggtgaccctgcagaattgactgcttggtggagacaagta

SEQ ID NO: 51352 - DNA, 1028 bp, Homo sapiens
cgctcggctaattttttgtatttttagtagagatggggtttcaccgtgttagccaggatggtctcgacctcctgacctcgtgatctgcccacctcggcctcccaaagtgctgggattacaggtatgagccaccatgcctggctgaccaaagagaattttctctgcatctgaagcatgtaactgcaaactgatttgtttgtggttgtcaagtaaagaggaccaatcttttgtttgtttatatgcactgtttcctttctcaccctagttgcatgagaaacagaagcttcttagattgatcggttgcctccttttgttgcatttgagcattgagaacaaggaccatgagttttctcctccattgtggttttagttctaacacttggcacatagtatttagtaaagatttgttgaataagtgagatagggtattggggaagatcataagaaaaacaaaagataaattatttatttataaatttattgttaggtctattccaaaactgacttagaaagacaaaattttttcctgctataaaatatctgtaagaactgtgttagcttggagtttgggattcacttttcccattgcagacgcttaaaaacctcaagacttttcttgttgggtttctttttggggagtactttattagggataccatttatagtagaaatctggaagactgtaaaaaccacttaatattcccgaaagatggaagcttgtttctggaagctgttatgttttgttaaggcagagacaatacattttcttttctttattgagatggagtcttttgcccagactggagtgcagtggtgtgatctcggctcactgtaacctctgcctcctaggttcaagcgattctcctgcctcagcctcccaagtagctgggactataggcgtgtgccactgtgcccagctactttttgtgtgtttagtagagacagagtttcaccacgttggccaggctggtctcgaacttctgacctcacgtgatccccctgccttggcctcccaaagtgctgtgatt

SEQ ID NO: 51353 - DNA, 1772 bp, Homo sapiens
cagcggccagagtgatctccggtaaacagaagtcagatcatgcctttctttgctactcacatccctgctaaagtgtcattcgagtaacttcatttcacttgagtaaaagccagagtcctttccctggcccatgaggcctgccaggatccaggtcctcctccccctgccccttcaacctctgaactcatctctgacctctctccccctttttgtgctattcctgcccctctggtctcctgtgtcttgagtgggcctggctcattcctgcttctggaccttgcactttttcccctcttcaggaatcacctcccttcatgtgtccttggctttctctctaatgctcctactcagggtcaaagccccctcagagaggccttccctgaacatcttgtttaaaattgcagtcctgcaacactgtgtcccccttagatttcccatgtaagatcttctcattaggtatggtgccttttgttggtggtctctctccactgctgagcacataagctcaagataagggcaggggttttatgttgagttttctgctgtttaccaacacctggagctgtaaatagcacataataggcattcacttgacatttgttcactgagtagctgaagcttgttgtaaatctgaaatgtattctacattagattttcttccttttcttatttaaagcatgttataatgtgtttcctgtttcactgggttgggtagtgattgacacagatattttcaatgtttttggctttccgactggagaaaaatagctttgggggcagagtgagtgtgtttcttaaatctgtctgcgtgaatcatcagcatggatgaatgtaggagaagttggtgcctgtgaagagctggagatcctggcagcacaggcagcaggagttcctgtgcaagccagatagggttgagctctgagacagctgcactggaatcctacttcgtgcccattggctgcgtggccttgtgcagatgatctcttctgagttctgtagactgtaaagcgaggatgacaacttctgtccagttcacttcatgagttggaagaatcaaatgagggacttgctctgtaaacctcatggtgctataataaagatgctgttgttgtatcgtctactttgtagatcatttctagcaaattgaagtgacaactctccttctcagtgccatctggttcctctctgggtccctttctttatctgtcacatcattggtatgtgttgatcactgtacactaaggcgcagaagaattataattcatatgctaaacatagaggaaaaaaatatattcccattgagctgtattttagagccaaatgtaaatggtaattggattgacttttgcttagattattaatgttcatacttatctgaaagttggttatataaatatgtcattaatatataaatgatatggtattaattattcatataatttaatatattaatataacatgcagattatgtaatatataaatagagccaactttcagataaatcagaacattgattttataaatatacacatatactggattttgttttatagacatctttattgtttcttgaatttttaactttcttgctcacttttggcagaaacaactctattttctttgtaaatagaaacagtgtatgattttgtagtgagtagtgttgaatgtacaatttggacttactattttttctctttgagtgctgaaaaaatgttttctacacagttttctggagcagttatcttgttaaccccagggagaatgattttttt

SEQ ID NO: 51354 - DNA, 1524 bp, Homo sapiens
ttttcatcattcccagaagcagccccataaccatagcagttactctgtatttacccttgcaaccctaggcaacaagtaatctgctctctgtccctatggatctgtcttttctgtacatttattacaagtggaatcatatagtatctaatcttttgtgactggctcttttcatttagcataatgttttcaaggttcacccatgttgtaacatatatctgtacctcatttcttattgctggatattttattgtgtgtatgtatactacactttatttacccatctgcttgtgttttgcatttatcttttccacttggttttctgtttacagccatgctttgggaaagtgagtttagggattcttttcccctttcaagatcagggatttggtttcatcggcatttggcttcccttgcccttggcatttgtggacaccaggttttctctttagttgtgtgacagcggaagcttccacttgaccccatgaccagagcaggtcacctatgagtaattctgttcctagcaagcttcaggacttgccagtaaacaacagaattttcaggatatttgattatgttctcctaattcaccctcaaacatctgtggaattactgtttcaagcaatactttgaatttgtctagtttatttcagagaacaaagaacatggcagactatagttttcgtaatggtgttttatggattgcatattagtgaagcataattttgcatgaagcaacacagatgcttaaccctttgaaatctctgcaataggcaaataatttgtttaaagcagtagttctcaactgtgggcatatttgctccccaggggatatgtggcagtatctggagatatttttgtagttctcactggagcagtgggttgcgttgttagaatctgtatgggttgaggccaggaatgctgcgaaatatcctacaatgcacaggatagccccccacaacaaaaaattatctgtccccaaatgttaattgtagttcagttgagaagccctgtttagagtgagcagtgtatttcccttaacctgctgagtagaagagacacaactgttggcagtgtacaagctaactgtatataattggaaaagcttcacatttaaaagtatatgaaagcagttatttgtatgaatgagtttgtgtgggttttgttgttgttgttgttgttttttgagacggagtcttgctctgttgcccaggctggagtgcagtggcgccatcttggctcactgcaacctctgcctctcaggttcaagcaattctcctgcctcagcctcccaagtagctggaattacaggcacgtgccaccatgcccagctaattttttgtatttttagtagagatgggatttcgccatgtgggccaggctcgtctcaaattcttgacctcaggtgatcctcctgcctcggccccccgaacatgctgggattacaggcatgagccaccacacctagccgagtttgtgtgttttttaaagaaagacaggattttaaatttttattggaaacctcct

SEQ ID NO: 51355 - DNA, 1040 bp, Homo sapiens
ccatagtgctgggattacagatgggagccaccatgcccagccaaattacttttctgacacttgaagtggatgtgaatggtgtgcatttatcaaaaacccctcttgggctagtggcaaggacgcatgagcaaaggtgaaagggtgagctcaagcacaggggatctgtagagaaggcttgtattggagagtcaagggggaggctgtttagggaggactggaggagtggtttcttgaaggaggaaattgggcctgacatgatttttctttgtaagtttttgaatgaagatattaaaaactgagacaaatgtaggtggcatttgcagagagcaggaactgaggtctaggacaaatgagggcgctttgaatggagaaaaagattcacagaactgcctcagacgttttcctccagttcaagttagtgaccagcaataactgccctatttggtactcatccctgtgggtggttggaactccctggggaccacagagggattctgcctttgtccctagtttggagcctgggttgtgatgagggctcattgagggcagagatacttttgccttgggaccctaaggtggttttaggcattaagagtctctttttccttgagtttctggtattccttcttggtagtttagtttatgaacattttgatttaatgtcacacttgggaggtgacacctctctcattgctgtcaggttcttcttttttttttagtgtaaaaaaatatgtgacttactttagtccttcagcttgccatttaagaatgttttgtgacagaatcattctttacatggttcttcatgtgagctgagtctctaaggtgaaaagaaaggtcagttgggcttttttggattacttttctgaaaccccatcagtagataaggcacatattgatgtgacagatgtcagattcccactgagaactcctaagatagttaagtgcagttaaattgtaagatttgtgttattctaatctgtgactcacattctattctaaggaagagacttggcattgatcatttataagttttgtaa

SEQ ID NO: 51356 - DNA, 1052 bp, Homo sapiens
ttgcatagggttgggaaatcctctgagggagggtagacttaagattgtacccaggctgtcattacatatagcctgtctgccagagactctaggccctgatttcagagtgatggtataatatgttgagtgagtcagagaagatcagtgtggagaggggaatttataaaggaagagtgctgacggtgtaagataatggaacctgtgattctaaaacttggcagatgtgactatgatagataaaggtagtggaaaaaaatggtttcttgctcttttttcctcgggtcacgttgtgtaaattgctgaagaaatggaagaataaagccttagattgctatgggactgtctcactgtctttcctaagaagaattgtaatctgttgcctttgtgagagtcaaagataaagtcccctgggttcatgtttatgcatattcttgtacttgaggctattagagttgattaaaagagagtggcttattgaggaaatgagaatcttaatatttgtacttaccatacatttagctttagatcagcactgtggaatagaactttcagtggcaatggaaatgttctgtgtctgtgctgtccagtgtggtagctgctagccacatgtagctagtaagcacctgaaatgtggctagtgtgacctagaaagtacattttaaaaattttatttaattgaaatttatttaaatagccatgtagatagtgactactatactggacagcatggccctagattaaagttcttaagtgggtcatatggctgtaagaggaataatatctgagagcattctcttatgtctagacattttgtggttttgtggacacatgattatttctacattttttctttagagaaagttggaatggaaaggggaatgtaaagactattagcatgtgagttggagagttataatttactttttgtatttttatttttatttttttggagatggagtctcgctctgtcgcccaggctagagtgcagtggtacgatctcggctcactgcaacctccgcctccctgcaacctccgcctccctgcaacctccg

SEQ ID NO: 51357 - DNA, 1021 bp, Homo sapiens
tttcagtttgcgttttctgtaagttagaaaagacgaatggttttaaaagcctaggaaatttgtttcccgggacctcgatggttttacatgctttctgactcccattctccggctctccactcaggtggttgagccattggaaattttgacctgtatttagcattcgtagagggcacttggtaatttttatttttgcaagtattcctgcgagattgacccatattagtggtaagcagttgtctcagtcctttgtatgtttacctgtctctttctcccgggctatagtgtttttcaatttccgactcccagtctgagctgaatgtgaactgtgaaagggtgtgtagcttctaaattggtaaggtttattatactctgaaacggagttgaggaggtacaattcttttcctttaatcctagctgagtgctttcttttctctaaaggacccatttaaacatagatgttacttttcagtctctctttcctttttaccctgaagcccacagttctgattctcatgcttaagaactaagattttctcagactcctcctctgtcttccttcttttcctttctttcccccatccatatggcattacgtccttgttcttgaattgcttctttctgttgtcagagtccttctggaaacattttctatggaatcctctccattcaagctagaattccgggcgagaatttgctttatacaccacactacgtttgcttgctttctcagattcagaagtgctttggttagaaaggaatagttgcccacattttggcctcttctcatggcagatggctgacctttcccctcagagatcattggtacctggactcagagggcagaaggaagtactccagagaaatgcaacttatgcatatactcagatgtatttttttttcttttagtgaagtaataaccaaaaaatcagaatgataatcactgaacaggtttttctggctttctccattttccaccaggtgtataggaaaaggacattggtgtcacgtgactgccttt

SEQ ID NO: 51358 - DNA, 1107 bp, Homo sapiens
cagtgtttattttaccgaagtatagcattgagtagtagttgtatttcccatcattgaatctgttaccttcacactcagatccttgattgctctttggattaaattaaggcatgcgaaagaatcacttgtcatttctaataaagactgggttgaaaacctgattgaggctggcatacctgtgaagtatgagtcatcacttgcctaatttttattctgcattatagtactagagccggcatttcttgttaaacattattacatgcttcacatttctaggtatagagaagttcgtgaattagtatagttatttttattgtgtaggtaacaatttttaccacctatacattggaaggcttattaccagtccctagtggacactgaaatgtcaaagaaatcaagaaatacactcataaaacaagacatggtcccaatcattttgagaaagtttatggtgggtaaaactgaactggacagataattaatgtcatacaacaacaacagtgcccacaggaaagttccatttaaacaataaaacaagccacataatattttcatagtacctcagaacaggaattggttgtgtggcttaagcaaattcaaaggctgtggtattgataaagagatttatattgaaatgtgaagaatttattgtatcatggaaagaaatgagataggatttagttgaaattattagtcatgaaattatgaagaatatagagcctgactttgttatagacagcctataatataaagaagggaacaagtcccatttcacctattactaagcagacttcatctcatgatacgacagagcttcagtacaggttgggggtggtaagcctgggtagaggaaggccaaaatctgtcacttagccaaaacagggtaggtagggttcagagtaaaggagattatgatcaaaataagcccttagtctgattagggctttgcatggttatgttgaaatgagagtagaatatacaaaaatatttctggtgtggagtttattgtacttaagtgcttatttctcaaacccagaaccaagttgacttactatatttgcccagatctctcaatatgaatattaggatataaaagaatcaatttcg

SEQ ID NO: 51359 - DNA, 1001 bp, Homo sapiens
ggccttaaattttttgtagagataggggtctcatgttctccaggctcctctcaaactcgttggttcaagcgatcctcctgacttggccttccaaagtgttgagattataggcgttagtcgctgtgccctgaactgaaagtgaaaaatggaatagttgtgtggttacctagagtatgttttccactgaatgcgtatcacttttggactgttgttaatttgaaaaaatcgtatgttagaccctcttaagttggggaccatctgtgttcatagagttgtgcaaccaggaccatattattagaaatagatttttatatggcagttcttggtgattaattgaatgctgttagataatctttttgtgtaaatttgtacttctgtgaataagaatataactaaactaaaactaaatttgtacttctgtgaataagaatataagatgttttactttgcaatatataattggcttaaggcattaaaaccctgcttttgtttactgtggtctgacataagggagttaacttcagcttaaggttattaaatccttcaatgactgatgactcccttcaagttatgtatgacgaagcaattatgaatatggtgtgaaaatgggatgtaatctctttcaacacattatttggagaaattacgactctccccaagtattgtatattcaaatatgttagacactgaccattttcagcagtttgttagagaattttttatttatagtagaaagtcagagtcagcctttatgtctcagatttggtgagtttctcagtgttaattcccaattggttaataaacgtcaaatggagctttaaggctcctgggcaagtccattcacttatgcagtttcttagatgcctgtttcatacattgtccttttatacttcctccttggcctcatggtgggcttcctacttgcatgagaaaatcagaacagtcttaagagcccttctgcagactcctaccacatcttgccaccttccagggcatcctgt

SEQ ID NO: 51360 - DNA, 1025 bp, Homo sapiens
gcagaggttgcaataagccgagattgcaccactgcattccagcctggtgacagagcgagacaccgtctcaaaaataaataaataaataaataaaaataaaaaataaactaaaattttggccacatctaacaaaaggtacaaaatgaacatgaatacatacttttatgtagcagctcattcatggtttcatcttttagattctcctcctcttctattttttcctttgttccaaggaaaagagaagcaaatattgtataattaaaagtaaaggctttgtagcctgtgtgacccgtgaaactaggtgtgtgacctaaggaaactatccacaaaggtaaatacttaatacttcttagctattattctccaccaaataccctcatctgttcttaaattttattttacattgtctaaatctcagtaagctaccttcagccccctttaaagccatcctttcaaactatctttctctctcgatacaaagatttaatttctgcctagagacaatcagtaaagaaattgtgtaggcgagtgccgtggactgaattgtattgcctcaaaattcctatgttcaagccttagctttccgttccccaagtgctatagtatttggaggtggagcctttggaaggcagttaggtttagatgagatcctgagggtggggctcctcatgatgtgattagtgtccttataagaagaggaagagagaccagagatgaccagtgctcactctgacatgtaaggacacagccccagaaggtggccatttgcaagctaggaagagagccctcattgagaaagtgaatctgctggcaccttgatcttggacttctgagactccgaaactgcaagcgataaatttttgctgtttaagccacccagtctgtggtattctgttatggcggactaatacagagcataaattttatacctgcagaagatgatcagtatgttactacagagactgagctttttgagaacgaaatgaggattatacttctcttggcagaagactttagacctactg

SEQ ID NO: 51361 - DNA, 1052 bp, Homo sapiens
aaccccatcaacgtatcagtaaggctcagtgaattgcctgtgtgtgatgcagactagcttttcattttaactagtgcaactgtgtacagctgttaggtcagaatgcattggctgctcctacagggtagttttatcttacactgaaggttttatggacttgactggttgtgtttcttaatccctctcccatgccaccgtgcttgcttttaagcaagtgatagaacaagacaagcttttgtttacttatttaatagttgacttgtgagagatttatttttgattttgaggaaattggtaaaccatgtaacttattagtaggtattatatttaccatgcttttccaaggccaaagggttttgcttgctattgtgtaggctgagaagccgatggagccatccattttataatgacataggaagccaatattttgtgtaaaaatcaacaatgaaaaatgggttctttgttaactagtctaggattagtttgtaaaactcaagcagaaataaatgttggcatcattggagataaggtggctagaatgtttcccccttgtctcttacctctcgttacattgtacaaaaggacttgagcaacccattgaccaacagcagtttggccatgggctgggtggcacatagaagcttttagacgtgtctgctcaggggcatgtgtggccaacttgatattttatagtgttattgtttcaagttattagaaagtatttatgagtagatttgagtcttttcaggcttttcaggctgtaacatagattgtaatgtgactgacatgggttctcagtggtctggtctctttactgtctgctttcctgttgagtagatactactgtccagagctgttattatctactgcatttatttttatttttattttttttgagttggagtctcactctgtcacccaggctggagtgcaatggcatggtctcggctcactgcagcctccgtctcccgggttcaagtgattctccagcctcagcctcctgagtagctgggactacaagcgtgtgccaccacgcctggctaatttttgta

SEQ ID NO: 51362 - DNA, 1063 bp, Homo sapiens
atctcagttaattaaatcgaacagaaaacatttttttgaggggggagagaaaacactatttaaaaatacatgtatatgtatatatttttatttttttcttctgaaaggaaagtgcttttgaagccgagtataatgcagaagtcgctctttgatcagaaacttcattgctttactgtggaataaacaagtttaaaaataaaatgaatttgatggacttgatttgaggctacttaagtgacaaatgaaattttcttcttggaccgaactactgttattttgccagagtagctaaaatgcggaggtactcttgacgattgttttacgtttaaattgttaaaagaattttttagtgtgggatgctgtcttccttgtttctcctctcttgtttactcaactcttgttttctgaaactgtagggagacctgcttgaccactttttgtttgctgagaaggaaactcctgtaataggttactttgttttacttgcagcccttaagcgtccctggcgcacatgtgccccgcgctctgtgggcattgtttggctggaggcctctcagccacacggaaaatctaaaaaatggtctgtgaatgaacacgggtgtctacagagaaattccattttccctttgtgcctctgtgttttaagattgagacactgagtaaaagttgagaacagatttaacaaagtcctcacaattctgtgccaaaattactgttttgagttctggcttttttttttttttcctctttctggaaactccaaatttaaagtagacatgatttgaaaccttacagatgggaacaatatcccatgtaagcacgttgatctgtgggcaattatttccagaagcacaaccaactctacatttttatgcatgtgttagacttgggctctgagaggcagttgcctttctgaatatttacattgcctagtaaattacacaaggcagatttttagatgcttaacagcagcttcacaatagtgtgggggcagcagagttgagcttgtattttttttttctaactctgtaatttagtagtgtttaaactattttataaagat

SEQ ID NO: 51363 - DNA, 1279 bp, Homo sapiens
ttatgaagctatttgagagttccatgaaacttgcctggaaggggaaaggtgtaatagtgaagataccagaagtaatcatttaaattttcagcttgtacctttctaatttgggttgacactgagtgaacttaatagttagaatttgtattttataggaatacatttaaaaaattcctatacaatgtctttgggaggacaaaatgatcttggctatcaccactagagaatacatgctttaaatgtactttaattttaataaaatttagcaagttgatatatatattttttaccagaattaattgtgggtgggtaagaaattagtttgaaattaacagttggtaatctgttaagattcacataaaaattgaattaatgagggagtttggaatctggtagctggtaggttatatgtttatttaaagccacatggtaaggaatgtgcacttattttgcttccttattagatgaatttcaatcatgcacaatttaagctatgtcttgtctaacagatggatctttatttacttgtggaaaagggattggtgagatttttaaacaaatggcttgcagagaattcttaatgtgtaaggaaaactggggtcagaagtgttctttgacacgaaacaatgctgctttctcccggtgcatctttgaaataaatgtttagcttgtctgtgattgttggttgtttcatctgcatttattagacgtcagaggtggttggcattaatattcctggcagaagcagaggcagctctaggatgtgtgaaatgctgatcactcacagggatgcgctgcctctttaatatcttgcttgcagatgcattttctagctgaccacgctattaagagctgccatcaatcacgcaggctcccagttccggctgtcggaggggagggaggattggagcgggtggaggctggccaagcaacgaaggagataaaattgcagctggcattgtgtgtgcgcgcgcccgcggcggcggccagcaggggtgcgcgcggagcgggctgggctccagcccgggttttgccggccgccgccgtcgcggggagtctgctctttctctcccggcgtctgggtcaccggcatgtggcagtgctggcccggcctcccgggctgaaggagtgcgagctgagtgccgcggccgtgggcagcaggctcgggccagggcggccgcctccctagccgcgggcggggccccgcgcggccaccgcctcccggagccgccaagccgccgggacctgcgcccgcgccgcggtgccctgcggccgctca

SEQ ID NO: 51364 - DNA, 1551 bp, Homo sapiens
tagctaactggtactaatacaatcctggattcagtcactgtttgctggatgacgttggggtgtacttttgacattttgacatgggtgagctaaattacttggtctgaatggttgtactggataatgctataggaaagaatgttgattgtctcaggtaacttgatagttagaattttgacacttattagtgttattaaatgagtgctactgtttaaactttcatgtaaaaatgcagtttccttgctgcctcggtggtcttggaaagtggcccaaagttgccatcttcagaagatatggttatgattcttcctttgctgtgacagagcggagtggtggagagagtccatgcagggtggttgctccaggttaagggtctggaataatgtgggtcctgttcagctattgctaaggttccccttcacatttcccctgtgtgatgtttctggtcatagctttaatgttagtttaactagactttcgatttaattataactgttaggataaagtcagatgtcagctcacttggctgcatgctgaggcctgtagaatatagagtgctttgcttccagccacatctgttgtctcctctcattatctgttaatggtactcaacttgacagggttgttttgataaatgacgggtgttatggaaacggagagctggaatttgtgtggaatggagcttaggacaaaaagaagcaatggtgcagaccaggccagggagataacatgggaaccaaggaatcccttgtggaatgctgacagtcataatgagtattaatttgggagggatgtggtatatctaatatttttcatttatcttacataattattcttcctattactttttcatgtggtcatgtgcaaaacacctgaaaaattatagtttttgttgtaataactttgatttttcctcttcacaaagtaatttacaaactcatactaatgagggttaaaacaaatgtttcactttgaggagtacacccaccattgagttcctaggtggaaagagctctttcgaaggcttccatgtcaggtctgttacttagagaaaaaaacctgaaaataaagtaagttcagtgtaaaagggaggtaagaatgaactcccctcattcacagcagaatttggtagtgcttttgcattctgagaagctttgaagacaaactagtgtacaaagtactttctaagttttatattctgtttatattgctctgtgtgtatacaagatttagtcctctgtccagtttacctgtggctgtttgcatatcccttaagggctgggtaataggaagaacttggcttgaataaactagcgatggcttctatacttcattaactcttaaaaagtgtagcttggaaataggacactagttaggatctctgtgtttttgagtaaccccaggcacaattattttatatcttcataaaatggggataaaaatcctcctttttactagactttttatttttctaaatttttttttagagactgagtcttgttatgttgctggactcaaactcctaggctcaaaggatcctcctgtctcagc

SEQ ID NO: 51365 - DNA, 1075 bp, Homo sapiens
cttttcactgatgtgagatggccgaatgtgataaaaggaggcttgacagggactacttgtatttaggaggagtcatggaaagaaagagagaatcgccagaaaggtaggagatccaagagagtgcctaatccaaaaccaaaccaacaaaaaccagaataagagtatgggaacaggaccaggacccactgctggtaagagtataagttgtacagcttttggatggctgtttgactctctctgaaagagtgtatattcattgaactagggattccttcagtgtagaaatacatgtatgcacaaagaagtttgttgtagcactgtttataagagtaaaaaatgtgaaaaagactcaataaggggcttgttatataataattatgggactcccacactgttcagttctttgcagtaataaacaagaatgggatgttaatggtcttctgtaaagtgagagaagtgacttgctgtataacataaatagtgggatttcatctttgtgacaaaaaatcaacaagtgaaccctcagacaaatgaatacatatgtttttatgtatatgtgcatgcttttgtacctatgttctagagaagagcctggtaaaccttcagcctgttaagtggaattgcttggattttccgtaggaccatatactctaaaaaaaatctacaagggagctgggtgccgtggctcacccgtaatcttagcactttgggaggccgaggtgggtggattgcttgagctcaggagttcatgaccaacgtgggcaacatactgagaccctgtctcaatataagaaaaaaaaaaattaaaaaatctaaaagagcttcaagaattttatatttttcttttttcttttaaaaactctagagttgccgggcacggtggctcacgcctgtaatcccagcactttgggaagccaaggcgggcagatcatgaggtcaggagatcgagaccatcctggctaacacggtgaaacgccgtctctactaaaaaaatacaaaaaaaataaattagctgggtgtggtggcgggcacctgtagttccagctactcgggaggctgaggcagaagaatggcg

SEQ ID NO: 51366 - DNA, 1133 bp, Homo sapiens
tttaggaacttatatgaaagtcctaatgttttctaaggtaaattgactgcttactttctttcatacattgtgcttgctcttgttcttactctcacattctgctttagtaaagaaatggaggacataacagggatactattggtaaaacagatgtttctgacttgaaattgcatgcacttatggtcttgtgtgttaaccactcttaacaactgtgtttactattgaaactggaaatacagactttgattatagtttttccagcttgcctggtactattctcctgtaactggattatttttagttgaaatttttgctccaagccctttccccctacttagttgactcttcaatcaccacttggagtgcacatgtcagcattcccatggacattaaatacacacagtatagacagcacaatggcatcttctatgtgaattattggactcttttgatcacttttaatgctgaaaatgggatctatcctggttaccttccagtcctctgatgaaatttagggaatgtatgtctatctcctttcgaagtttatcctgatagctattggtggtcattgtaaaattatctgtctgaaacttaacagattgcaaatgaaataggaatcttagtatttattttgctactgcctaatgatgcctctgtttgagtcattgaatactttcaaagcataacctttaaggtatgtttctacatcttaatttgccacttggtgcatttagttctaacaaaccagaactaaagcaaattttgtttcatgagaaactgcttgccaagctttaatttaggtcttcttagaggattattaatgaactcgtgaagtgtacataagcactttttattgacaaaacaatggcattaaaattcagtattctcaatcgatgacaaggcgttattgtgtttgagaaatactgaaaactaccactgttgacctaatgattaacttgcaatttagaacatgcttgattttcctttcccttatccatcttattcttactctctttttcaaaaaccattagctgactatggaacataattgtgaataaacaaatgggtaaaatgctaaaaatgattttaaaaattcattaagttttttgaagctggatgatctatttgtactt

SEQ ID NO: 51367 - DNA, 1029 bp, Homo sapiens
acctccgcctcctgggttcaagcagttctcttgcctcagcctcctgagtaactgggattgcaggtgtgcatcaccatgtctggctaatttttgtaattttagtagagacggggttgcaccgtgttggtcaggctggtctcaaactcctgacctcaagtaatccgccctcttcagcctcccaaagtgttgggattacaggcgtgagccactgtgcccggctagatttttaattttaatggagcctggatgtttcatgtacaagtaacgtattttgggatgtgtgcttcttgtctactcttggggttatacaattataagaactcccctacagtggcctatgaggcctaccctgaccttggactcgactcgtccgttgccggcaccctccaccctcagttgtgttctagtcctgccggctcgcttgctctctcttgctcgttcttgttctctctctctctcttgctctctctctgactctgtctgtctgtctctcttctctctccagctggtacctaccctctgcatatgtttaatccttcttgctctacttttttttcttagcacttactgcctttgaatattgtgtgaaatttatagaatacaaaaaaatctgttggttattgtttgtttctccctgcagaatgtaaaccccttgaggtcaggagtgtctttctactttgttcatagatgtattctaagtgcttgtgctgttttttttttttttgagatggagtcttgctgccgccaggctggagtgctgtggcgcgatctcggctcattgcaacctctgcctcctgggttcaagcgattctcctgcctcagcctcctgagtagctggcactacaggcgtgcaccaccatgcccagctaaatttttttttttttgtatttttagtagaggcagggtttcaccatgttggccaggatggtctcgatctcttgaaatcatgatttgcccgcctcagccgccccaaagcatctggcacatattagggcttgtaagttccattaatgagtgagtaaattattc

SEQ ID NO: 51368 - DNA, 1034 bp, Homo sapiens
tgacaaaatgctggaacacacagagactatatagattcatttgatataagagcttcatttaagggaaggaattcaaggctctttcagcttgtgatttctattttggtgtattctgtccccacctaatgatttatacaatgtgatgatggtaattcagagctagaaagtaggttgtttctggtttcagtccttctttttatctgaaatactgaaagagccgaactgtattctgtacaggtagtggttacttttcttctgcttagacttaaaaacacagcctgtttgttagcttttgttggcaccaaatagtacttggacagtatatatttcacagcgacatattttttctacctaacattaagcacttgcttaatttgaagaactgttctgttgagcctgcctaagacaaaatttcagtgtacatagcacagtctgaattaatagaactcaaacttactaggccatgaaaatggcttaatcaacagtgaaccctttaaagaccttgtcaggtagtgttctaatagtgattttagaaaaaaaaacaatgattagtgtttaaagatactctttgttttagagtttgttttcttttttaaagccctcttgagtaacttctggggttgtgcctatgttctgtttagagggaaaaaaattgcatttctatactttatattgaaccacagccattcagtctaattactaatctcttcttggtagaagtcctttcagactgaattgtttattcttccttatctctaacctgagggtatattgttgctgagttgttagattttattcttctttgttgtcattctgcagtttcgattcctacctccccctcccattttggtgatggatggctgatctgatgtttgtgaggcattcaggatttgatagctgtgttaagagagactcagcattcctttctggacaccttctcttttctctgttgaaagttctgaatcgtttgtgctgtcagtagtttttgataggtagagggtcaaagacaactctgttgattaattgaatttcca

SEQ ID NO: 51369 - DNA, 1159 bp, Homo sapiens
ccactgcactccagcctgggctacagagcgagactcctttccccccaccccgcgccctccaaaaaaaagactactaatccactgaaaaaaggtcagttggctgggcccagtggctcatgctgtaatcccagcactttgggagccaaaggcgggtggatcacctgaggtcaggagtttgagaccagcctggccaacatggtgaaaacccgtctctactaagagtacaaaaatgagctgggtgtggtggtgcatggctgtgatcccagctactctggaggctgaggtaggggaattgcttgaactcaggaggtggaggttgcagtgagctgaggtcgtgccactgcactccagcctaggcaatagagggagacttcttctcaataaataaataaataaacgtcagtttacaatattagaatactgaaagcttgagtaattagaagagtcttatgattagaattaattatttcaggctaaaaaatattagaaggagactctagagggcagtataagtcaacatgttcatgcttctcctggcaatggaaagttaaattttgctttggaaaaatataccaggtgttctgaactctttccccaccacacggtgtcccggtttggtagaaatgtgagttttggaaagaagtgctctgatttggcttacaaagattagctaatgtatcagaattatatggccctagggaatatctctgcttggtttacaatactgtcttagaaaaactggaattgcctggccgggcgcgttggctcacgcctgtaaccccagcactttgggaggccgaggcgggtggatcacgaggtcaggagttcgagaccagcctgaccaacatggtgatgaaaccccatctctactaaaaatataaaaattaaccgagcgtggtggcgtgtgcttgtaatcccagctactcaggaggctgaggcagaactgcttgaactcgggaggtggagcttgcagtgagccgaaattacgctgctgcactccagcctgggcgatagagcaagactccgtctcaaaaaaaaaaaaaaaaaaaaaaaaagaaaagaaaaaaggaaaactggaattcccttattgactcaactaaattgagttgagtttgcttttcagacatttgtggagcattaagtgaaaggaatatatctt

SEQ ID NO: 51370 - DNA, 1041 bp, Homo sapiens
tctgggtatggagcatagcatcttagttttagtttcttttttgagggatgctttttggtgttatggtataccacaggtgcctagagaaaattccgttttaggtgctgtcctttgaggaaatactgctgatctcaaataactgtgggtaattgaaatatcataccttttaatggtgactactaatcccctaaaaagaatatagactttttcgctctaaacatggtttcaatagggtttttttttttttgatggtctcttatgactctagattgaaacaaacaagaaaataaccctacttctatagttactataacagctgaggcaagctatactaccagtggtgcatggtaaagcctgccttttaataagttcttaaatataaagaatgatagaaagtttcaagttatggtgtgttataggtgcctatggagttattaggttagaggaatgattttaatttacttggattccttagcacattgcttattgcatgcgtgctcagtaaaagtggatactggtgtttgtgctttgcagctaccgcaggtcttggttgtcatggcttctcattagtgcattaagatccctttagagctctggttgcctggcaagagaaaaggcaggaactgccaggagctgaaaggacagatgcttagctgcagaagtagcctctggggagcgttggctgcgttggctgaggttcgtgtgcatgtggtcaaatgtgtgaacttgggttttgctagacaaaactctgggctacatggattaattaatatatgctacaagtggtctttgttttagaagtctttgcagtttgagctatttaaaactttttttaaataagcaaattagaagattctgtttggggtgcattcctgtcctttggggaagtactgctgacctttaagaatagtgggtaattggccgggctcagtggctcacacctgtaatcccagcactttgagaggccgaggctggcggatcacgaggttaagagatcaagaccatcctggccaacatggtgaaacaccgtctctaccaaaa

SEQ ID NO: 51371 - DNA, 1895 bp, Homo sapiens
caagtaaaacagtacctgacacacagcttaccgagatcttgataaatgttagccattattaccatcatcactgtcccccatgcctatgaaataccagaatagagacccacttatttaattagctcctctttttaaaatatgtatgttctgatacctcattatgaacacttaagacctatttgggccttctaggaatggcagttttgattggataagaaaagagtaatttaggaaggtgggactaggtctgatgaggtccttgaaatgcttaaagtccacacctttggggctgggaagaaagacaaaaggagaaattgagcaatcaccaggtttttcgtacttggcgatattaatgagaatcttgaagttgggatgctgccaaaaattgcttggtaagttgctggtgctggaattaatgcatgcatactgatgaagaaagctcttgacacttttggctctgtttccatgatctgtaggtttcctaaccatatacttgcgttggagcacaaagcttgtgtttggaactgaagagagtatctgataatagtatggagaatggatggaaggggagggttatgcaagatacagcaacgtaacctgtgagcctattgtggtaactgagtttagagatgggaagctctgaactaagatagtgatggtgtgagagtgaatgacagagggcatctggcgtggggctgagagaagagtctaagataattcccacgtttctgactgaagtgattgtggatgagttagaatcccacgtttgagtctcagctccactatttaccagcataataacttctggcaagttactgcatttttctgagcttagtttcgttatctgtaaaatggtagaggtaaataagggtgtttctctcccagaattgtcttgaactttagacgaaattatgtgtagttgtatacaactacttaagtaatatagaaagttatggccgggcgtggtggctcacgcttgtaatcccagcactttgggaggctgaggtgggcggatcacttgaggtcaggagttcgagaccaggctagccaacatggtgaaaccccatctctactaaaataaatacaaaaattagctgggtgtggtggcatgcacctgtaatcctagctactcgggaggctgaggcaggagaattacttgaacccgggaggcggagttctcggcagtgagctgagattgtgccattgtactccagcgcgggcgacagagcaaagctctgtctcaaatatacctactctcttattatctttagtaacaactaggctaggaaataatattaatgagataatgagattagagagtaaaggaggattaggttttgggggtaaaatgtgtatgggatatttagttagagaattccagttcaccgtttgcatatgggctttgagtttaggaagatagttctgtaactagataaggtaatatttagagtgtcttaaatatagtagatactcagtaaatcaagtatgaatatcatgtgttgatttatctgtctttccaaagttgtaattggtagcaaaaaaaattagggtgtttaaaaaaaaaaattggacaaaactttctttgagccttcatcacctctggcctggttaccctagcaggttcttaacaggtcttgttctccctgcccacctcccacttccatgcccacccccatgccatttgttttcacaacacagcaagcctaaggatccttttaaaagttaagtcagggctgggcgcggtggctcatgcctgtaatcccagcactttgggaggccgaggtggtcagatcacgaggtcaggagatcgagaccatccaggttaacatggtgaaaccctgtctctactaaaaatacaaaaaattagctgggtgtggtggtgggcccctgtagtc

SEQ ID NO: 51372 - DNA, 1371 bp, Homo sapiens
caggtacacagaagttgccagcttttcttgccatccttgccattcgaatttcagttctgtacatctgcctatattccttgtgatagtgctttgctttttcataaataagcttcttccttgcctttcaaagcatgttttgggcagacttctttctcaggagcttgatcttcagctctgtgaaattcctttgctttttcttaagggtttctggcacagcaggaaccaccttcttctcttcaacaccctccatggttccagccggaaaaagaggctactggtttttaaaagactactgggtttgtgacactcacagatgttgaatgaggcagaatggtttctacatgtagcactttaccacccaagtcttagccctcatcttccgttaccttgatattgaagcattcatttattgaacacattgactactgactacgtgccaggcatggttctagaagtaacagtctcctaattcctctccagtcttccactttcatcactctataatccattctttttttttttttttttttgagacagaggcttgttctgtcacccaggctggagtacagtggcataatcttggctcactgtaacctcggcctctgcattcaagcgattctcatgtcttagcctcccgggtagctgagattacaggtgcccgccaccacgcctggttaatttttgtatttttagtagagatgaggtttcgctgtgtgggccagcttggtctcgaactcttggcctcaagttacccactcgccttggcctcccaaagtgctggaattactggtgtgagccactgcgcctggcctgtagttcattctttacacagagttggaggagtggaattgctttttcagaaacatagatcacctcgttctcttccttaaaaccctccagattctcattctgctgggagtaaaatacagattttttttcctccatggctgtgtgccagcatagttgatacttctgagtctctgatataactctgaccactctccacttgctcccttagcatcagtcacaatggcctcctgtcctttctgttgttttaggaactaacaaactaactcttacctaggtgtattgcattcatcataattgcctcagtgcggttccatcaggtttttttctttgcttcatcttataatttagatcgcatttcaatattattccttagggaggccctccctggcttccagtctaaagtagcgcattactctacatcaccttatccttttttttttttccagagcaaaattgtgttgttttcatttttacttatgtattttttggtgcctttcttgtgagttccataaaagcattatctacaattaaattcccagtggcaggaataattctcagaat

SEQ ID NO: 51373 - DNA, 1863 bp, Homo sapiens
ccttcctcatttaggcctattaaaataacatgctatacatttctttctaatagctcaggacagattattattattgttttaaaacaatacacaatttaataatgtctaatcaaaagtttctttaaatagaactttgattaaaatatttctggaaaatttttctttgtaatgtaatatctatgaaaacaaaatttaaaaattatgaaatggtttaaagtttggcacttcaaattatttccaacacaaactgtctctggtaagtttcctttaatttcttttgatcatatcagtttcctacaaaggcaatagcttcatttcttgaaacatctgctgtagcataggaaaagaaactcacaaggttttaagaaaccttgtttttatctacagccttacgatgagtacaagttacgttatctctcagtttgtcagtgttcttacttttaaaatatgtccctcaatgagataaagattaagatgaaacttaaacatgaacttttctgaattaccacttcactattgtttatcattttgatagtctcttctctgaacctgaatttctcttgtaaggattataggaataatgtagtttaatgccttccgtatctcttataactactagatgatactgggagtattttttttctttttttaaatgaaaatgttcctgagctatgctttagtacaagaatatgaaactgcaaaggaagtgtttcttttatgatgaaggattagaaataaaaagcaaagtcaaaattcatcatcgtatgatcgccttctgggtgatagtgaatttttttttttccatttgaagagtagcagcatgtggtgtataagaacacagacacgcaaggcaaatcctgtccctaccacttcactggcaagttacttagcctctgtgtctttttgctgtctgtaaaatggggataataatagtggcccttgaatggccgttatgaaggttaaatgggttattctagattagtgcctgccacataaagagctgtgttaagttttaactattattatattgaattgatcttttttttttttttttgcaatcttaaaacagttatttggggacagttcccgtactacagtcaagtgctgaaaattctattatgacttcttagaatcaagtctttttccatatttactttgttgttgttgtttctttggtgccttgcatatataactagatgataatgtaagttcttttttttttttttttaaagtgaaagggattctgagctaaaggtttggtataattataaagaacataaaactgcaaaggaagggcttctctgaggacgtctgtatgaagttaacactgggtctctgtttagcctccgagttgctataggaataagcgcagtattttggacttttcagaataataagccatgcatgttctgcatgtgctttcacctgtcagtgcagagaggatcatcagagcaaaactaactgggtagcataagtttgacttcggtgtagtttagtcactctggaagaaatggaatttgctcccttccacccttctcttaaattcttccatcagagaggttttcccataggtgccaggtattaaaaacatgattcttataagaatattgcctttgttactatagattgctatttatttggagatattagactcatagagtgtagtaaggagcaaatgagagactagatgcaaagtgcttggcataatccctggcatgtcctaagtgttttttccagtagcagggctggcagaggtagggttggtggatgtttgtaaatgggggctgcttgaataagtatgtttcagagttattgagagattgtcatgatgggcaacagaacactacctgttttgggaagtgt

SEQ ID NO: 51374 - DNA, 1053 bp, Homo sapiens
tgactgtatttagcttcatattaaattaagcatagccagtggcctacaaagtccatctgtactgctgccaaaggtagcactgaagacagtcagccgccttttatgtctgttaccactgctagctgctgtttccctcttgccatggtatttaagctttggaattgctcatgcaaaggtgagcctttgtattgaattggaatttgtattctgtaaatcgactgtactgaatgacaaggcttgcctttcagtagatagtctattcttatttttgcttacctataaaccagtggaaataaatacataagattagttaggggtttattgaggcttgaattctagaaagaggggaattactatattatacacaagtgccagttaaacatgtaccaatctgaagaagatctttctatacctgctactaatcatggaaaacaattaacttactggtttttgttatataaatacatattaagatctgaaaatctcagcagttagttttatttataatcagaaagacagatgttaacagtcactgaaaatctttatgttttaaatgaacgcaccttcacttttacttgacttctacttcatcagcataattggagaaccatagattctttccccatgagtgagggcaaaacatacatctgcagtgttcttagcatgaggatcattaagatggcagaccttgtagatcaaacaatttcctcccatacaccctcattctttcctagaaaagcattgagacagctctgaaattagacctggaaagcatgtgctaaggcaagaacaaatatcttgaaaattttatcataatgttgctttttaaagtcctaaatgtcctctaaaatgaaattcttttgtattaaccttctttcatatgctggctttcaccagactgcagaattgcctgatttgactttctaatgtaactgtaatgaatcttctgggaagctgaaacgattgaacacacatactctgcaactccattgtaaaatattcagtcagtactgtcgatgctgctgattaaaaaaggagaaaaaaaaaaaaagg

SEQ ID NO: 51375 - DNA, 1141 bp, Homo sapiens
agagttgtgttttaggatagctatttctagtatgtcatgaaaggaagagagtgaagactgggtggaaagtaatgagaatctaacctttcttttttcttttccttttttttgagacagagtttcactcttgttgcccagtctggagtgcaatggcgtgatcttggctcactgcaacctccgcctcttgggtttaagtgagtctcctgcctcagccttccgagtagctgggattacaggcatgcaccaccacgcccgactatttttttgtatttttagtagagacgggggagtttctccatgttggtcaggctggtcttgaactcctgaccttaggtgatctgcctgcctcgacctcccaaaatgctgggattacaggcatgagccaccatgcccggccgagaatctaacctttctaactgtaggggaaatgaagaggtatgacagatgggagacgttgtagaggtagaattagttggatttggcaactgttagaacaaggcatatagtcttacatgtgggggaggtgtgaagcataggtaatttgcattacacctgtgccattaaaaaattgggaacacaggaggacaaactgatttgaggaagaagatgctaataaatacagctttttattgagatgagtgatttttgtcattaggcagatggaaatatttaatatcttgagaagtcatcaaggttaagatggagatactgagaatggggtagttgaagccccgaggtggaataaaattgccaaaggatttagtgtcagatgtatcttttccaagtttgtcacattgcaaaacctgaaaatcctccagttttaggacaggattgctctggtgttgtttaaagaactcagattcttcctttgagtttttatttctctttgaggttctttcattttgattctcattttggtaagacggtaaagcataatggttccgagtctgagcttgagaacagaaggattgggtttgaatccttgttctgccacctctctgtcctgtaatcctgttagagttatggaacgtctttgtgcctccatttccttgtctatataatggagctgataatagctaaatgatagggttgtttatacattagtgggataatgtatgaaaataatttagcctggcacatg

SEQ ID NO: 51376 - DNA, 1704 bp, Homo sapiens
cggaggttggggtgagccgagatcgcgccattgcactccagcctgggcaacaagagcgaaactctgtagcaaaaaaaaaaaaaaaaaaaaaaatagtttgccaaaatgaaggagataatattaaattcctacaagcagtgagtataaaccagagaaagtagaagtgaaatctgaaagatgctgaaatgaagaaaactgaggaccaaagaaagacaggtacagttgaggctggagaacaaatgcatctcgaatattcaggattgctagtgattatggctagagaatgggatgcctcgaatgaatggctttagaggtagagcaagtttggctgcgtgtgtggattcgtggagagaggacacctaggaacaaggtacctggttagatgagtacatttttgttgccatcaccctggattatgataggatcctgttgagaaggaaggctatgagctgatgtcaaagacttgagtaaatgagtgggaaagatcattagagatcattctgttaaaattctatggcagttcttttgtgacatttccccttctcattgtctttgactgtcattgatgtcaaatgtatgtacagcattgtaacttactttagatgtaacttttttctgagatggagtctcgctctgtcgcccaggctggagtgcagtggcgcgatctcagctccctgcagtctctgcctcccaggttcaagcgattctcctgcctcagcctcccaagtagctggtattatagatgcgcaccaccacgcccggctaatttttgtgtttttagtagagacagggtttcaccgtgttggtcaggctggtctcgaactcctcaccttgtgattcgcccaccctggcctcccaaagtgctgggattacaggcgtgagctaccgtgcccagctaatttttgtatttttttacatggggttttgccatgttgtgcaggctggtcttgaacttcagagctcaagtgattggcgcaccttggcctcccaaagcactgggatttcaggtgtgagccaccgtacccggccagcaaccttctttcagcatctgctttctttggttgagagttgttatgaagacatatcatctggttatgatttaatataatttcatattattgctatagcatttcaaagcatgaaatatttcttgaacatctctatttagacagatgttttgacttttagatctttaagttaagatgacaaataatagtaacatttttggaccttaaaattctcaaaaactttctttggtaattcaatcaacaaaattctttttcttttaagtttagttgatattgtattaaaggtacagaccagatattcacttatttttttatttttattttttaaagaagtaaatttcttagttgcccaggctggaatacaatggcatgatctctgttcactgcaaccttcacctcctgggttcaagcgattcttgcgcctcagcttcccaagtagctgggattacatgcatgtgccaccaagcctggctaatttttgtacttttagtagatggggtttcactatgttggccaggctggccttgaactcctggcctcaagtgatccacctgcctcagccttccaaagtgctgggattacaggcatgagccactgtgcccagcccataaatttctttttcttttctttttttgagaccgagtcttgctctgttgcccaggctggagtgcagtgg

SEQ ID NO: 51377 - DNA, 1010 bp, Homo sapiens
cctatgttgcccaggctggtctcaaccctctgggctcaagtgattcttctaccttggcctcccagagtgctgcgattacagacatgagctaccgcgcctggcctcatggttctttaattgtggatgctaataaagtttgtgagtgtggggcagagaagtgaggtgtaggtaggtgttgaagggcaagtggtgcttgggaattctttgagattttcagttggaagattctctgaaagaggaagcattgtcctcatggattgctctcagatgacataaaatagatatagtaagattacaatagtttttattctaaggacttgagaatagcttcttttcctccagcagagaggtaagcatcctgttccattgtgtgatagttgttggctgacacacagatctactttttctatttccagcgggtgaaatcacttcctctccacctgtactttattttctggtccttttgacagtagggcttgatattttggtataccctggatggcattgttctcttgactcagatgacctaaattacttgctgtttattgtaaagtggttcaaggatgctttgaggtcctagagttaaaaatggatgattctgagtcagtgtggcttgaagagcatgtcactgaggatctcctagtccactgggatgcagcatttgatctgctccaggttgcatcccctttttctctgctgtttgtgttagtctttgctttctgaggtaactcaggcatgtactcgctgtaatgtctacccaaagccagtctcattaagaccagccaaggccaggaaatggggaggaaataatacatacgagggtgctggagcccaaataggttgtcctttaccccaaggtacaggtcaaattagtgacagagttggcattagaacccagtcttcttaatgcctaagttagtgacttagtcattttttttgagacagaatcttgccacctgagtagctgggattacaggtgcacaacaccatgcctgactaatttttgtatt

SEQ ID NO: 51378 - DNA, 1390 bp, Homo sapiens
ggtggctgctggcaatctttggtggcagtccccaggaactggggattaggacttggacatatctttctggggaccacccattcagtctacgatgtctgttgtgacttctgaggtagatgttcaccggtaaggggctgggggaatgtaaaggtgcttcttggggccttttcaggactttggcttaaattgaaatggggaaggcactggatggttttgagcaaagaagtgacatgatgtgatttgcattttctcttctttttttaaaaaatttaatttctgtttagtagagacagctctccttaggttgcccatgctggtctcaaactcctgagttcaaacagtcctcccacttcggcctcccatagtgcattatttgcattttaaaaggacagaagactcctttgtggacagcagactgggacaacaggctagaaataatgagataggtgggaggctatcatgataataattcatgtgagaaatggtggtgcttcatccatttgctagtagacttgtgaaaagtatatgacttctggatgtattttgaagatagagcgacagtattttctgatgagtttttaaatttttttagtcagaatctcactctgttgcccaggctgcagtgcagtggtgtgaacacggctcactgcagccttgacctccctggctcaggtgatccttctacctcagcctcccaagtagatgggaatataggcatgtgccaccatgctcagctaattttaaaaactttctgtagaaatggggtctcactatgttgcccaggctggtcttgaactcctgggctcacatgatcctcttgtctcgccctccccaagtgttggaattataggcatgaaccaccatgcctggtctctgatgaatttcactgtagggtaggggttgaaagaaaggagtcaaggatgattccaaggtttgggactgtgcagctcaaaggatggggttgtcaggagctgacatgggaaggctgtgtttagagcagattatttgtttgttttttaagatggagtctcactgtgtctcccaggctggagtgtagtggcgcagtcttggctcacttcaccctccacctcccgggttcaagtgattctcctgcctcggcctcctgagtagctgagactacaggtgcctgctaccacatccagctaatttttgtgtttttagtagagacaggatttcaccattttggccaggctggtctcgaattcctgacctcaagtgatctgcccacctcggcctcccaaagtgctgggattacaggtgtgagccaccgcgcctggcctcttgagcttactttggacacaccaaggttaaagtagtattagatactcaagtggagatgccaagtagacagttttaagatggtgtaaga

SEQ ID NO: 51379 - DNA, 1045 bp, Homo sapiens
ttcctctgttggagaatggaaccaggaaaggtaaggactaggacttggttgcattgtgaatccacttgctgatggaacaagaaagatggaacagcagatgtgcatattttcctctgtaatggtcattgatttaatataaaagatatgtctgaagaatgtatgcttggataagtaatatgctgaattctggtgtttggtgtgattgtattagcctagacctgtttagtagtaactttgaaatatgttgcagcaataataaggaatgtagtgggtgcctttctgctgttatcaaaatccattaacaggttttcctatgcttgactgcctttcattgttacgctttatggttcatactgagggggcatgtaaatgacatctcttctatggtttctcaaggtctttaaaacagtgttgtattttgagtaaatatctgtttattccatagtaaggatagatgctagacaggttatgatttgctttggttctactcccctactttggataggattttacctaggtggagcattggatcatgttcttgagctgtgtggaactttgatttgcttatgtgaatgcttcacactgctggccaccctttgttgcttaagcagtagagacataagctcatcctgggtacaccttttagtgtgcaaggttctgtgaaaagtgggtgaaggtgcttctcaagccattaaattgtagtggactgtctttttttctttagcaaaatttggttttgggagtatgaaatttaaacttgtgtctgccatttgtaagatacgaagtcatagtatgagtgtttttggggttttgtttgctttttttagagttggggtcttttaggatagaattcccttttccttaaccacttaaagcttgagaacaaagatttggaaaccttttttgggtagcagatcacttcattaatctgataaaaactgtgaattctgtttccagaaaaagacatatacatatacacgttcgttcaacagatttattcagcgtgtgtttattgaacagctactatctgccaggcatagtttat

SEQ ID NO: 51380 - DNA, 1419 bp, Homo sapiens
tgtttttcctcatgtttaattttttttgggggggtgtcctttaactatctcgcgtttcagtacatatgccatttcctgtcccaaaggagcacataagtctagtcctaatcttggtgcttgaacccgcagttccagagaaaagcaactggcactgaatgctctctggctcatctttccatccaggatctgtcagctagccaacaggtgtgggaggtgtgttttccaagtttaatgttgctgttagtgggatacaaaagaaataaaagttactatctttggcctcagaatttaggagggaagccttgcaagaatacaacatttagagatttctagaacaaaagcggaatttaaccaagtacttactgtttagcataacaaatttagttcagtttcaggttagagattggtgtggattaaataagttgaccaaagatccattgaaaagctgagtgggccatcgaagaatgggtgctgtttgaatagcagactgggagagcaggttaggacagtccaggcaggggtcggcctgaggcaggaatgcatatggtatgcgcagcgttcagtaaagagaacctggttgaagtacagaatttgtggggaggaatagtgccagataagttaggtagaccaaagaagacaggcttggaatgctaggcacggagtgtctgttggcacctgaagggaattggggcgaggtaataaggtagcacgtcagccagagactggagagtacatctctgtctgagtaattttggccccaaatttgtaatgtggggatgggaagtgtattggtcagtcctgataaagagttatgtgtgcatctgtgtgacgtgttaaaattgcttcctgccactgctcgtgtttggtcagatagtaggttaggctgaaggaaagagaggtagtagccacaggacagataagctttgagaagccagagtggttggtaaagtatttggctttcatttagtatctctcatatatatatatatatatatatattttttttttttttttttttggtagagaggaggtcttgctgtgttgcccaggctggtttcgaactcctgggatcaagcaaccctcccccatcggcttccccaaatgctgggattacaggtgtgagccactgtgcccagcctagtatcatattttatacaagataaattttaccaaaaattctaccatcaaatatagaagttactttagttttttaaaaaataatagttcacatattctgtttcatgtcttctcttgcctctcaccctgagcacccactgattcatacctgtttatctccccctcctttgcttcttagctcctgtttattcttcaggtctgagttttgggatcatttcatttggaaagcctcagggctgtgcccagggtgctctgcctggcccctgtactcccccgagccat

SEQ ID NO: 51381 - DNA, 1001 bp, Homo sapiens
gttggccaggctggtctggactcctggcctcaagtgatccacctgtcttggcctcccaaagtgctgggatgacaggtgttatagtacctgccctcaaattgtttattccagtctaatcatcaaggaaataagatctgaagagtcaaagagtaacttgtaattagaacagttaatatgggtcctttctttccgccctctgaacggtcctgactcagagttatctggttaagtgcctcttctcatgagaagttaatataatttaggttttctcacttttggtttggttatttggcatagtttcttcctgtaggaagcggccatatttttaccacttcttaggagaatacaggtgctgacaaattccttgcatccccaagtccattttgcttgggtcttaacctctttgcagttttctgggatgctgattgccagccttgttgttgtgggactggctttgaaatccaagacatcttttgaggatatcaaagtactgtaaaggatggaaatgttaaggttgcaaaatgcttggagagtatcacatgctgttgataggcttattgtagtgatttctgagccttagaaatttaggcctttgatacagctgtcatgaaggtgagcctcagccccatctgtgaatttctccagaatcattcagtttaggctcccagtatcaaaatagagccttctttctttctttctttcttttttttttttttttttttggagatggagtctcattctgtctcccaggctggagtgcagtggcgcgatctcagctcactgcaacctctgcctcctgggttctagcaattctcctgcctcggcctccaaagtagctgagattacaggcgcccgccaccatgcccagctaatttttgtatttgtagtagaaacggggtttcaccgtgttggccaggctggtctcgaactcctgacctcaagtgatccgcccacctcggcctcccaaagtgctgggattacaagcgtgagccactgcaccc

SEQ ID NO: 51382 - DNA, 1073 bp, Homo sapiens
ctgatctcaggtgatccacctgtctcggcctcccaaagtgctaggattacaggcgtgagccactgcatccggcctaagttttaaattttttatagaaatggggtcttgctatgtttcccaggttggtttcaaactcctggcctcaatcgatcctcccaccttggccttccaaagtgttgggattacaggaatgagccactgcgcctggcctagtcatttattttaaaattgagtgccaaccattgtcatattatttgtagtaaatgcctattaggctgaacttgaagttctctctttcttcattcagcatagtaggccccaaatttgaaatgagaaagtacaacttttcctgttacttttccagttagaggcttctcttactagagactgcagtcaggtacttggattctgaaatggagttaatgtgacaactgctttggaatctcagtgctttggtactggatttaaagtaacttacagttgaaactgatttccaactgcaagaggtgacacaaaccctgacttttttggaaaatgttttaaatataaaacctgaagtgaaaaaggcttctaaggtaaaaaagattttaaaatatggtaagtgctttaaattagtaagtcggttttttaggtgggtgattcaactgctttctagttagtctggtcattttttattccagagatttcttaatatgtctactaaagcatatgtgtgtttacgctaagatgactaaattgcttcaccttaagaacaataatgatctggcgtgtatctttcttttgtgattcatgctgattttttttttttttaggcggagtcttactctgtcacctaggctggtgtgcagtggtgtgatcttagctcactgcagcctccgcctcctgggttcaagtaattcttctgtcacacagttatttttaaagcataccagtaatttgtttgactgatttgttttcaattaaaacaacttttaatttttttctagggtctccctgtgttgcccaggctggtcttgaactcctggcctcaagtgatcctcctgcctcaggctcccaaagtgctgggatgacag

SEQ ID NO: 51383 - DNA, 1135 bp, Homo sapiens
aacttataaattctttttgtcaacttagttccaatgtcctgaatgtgttaagaagttgcagtgtccaaggacttcttagaacccatagttattgccttttcaggaggcataccagggccctgggcagctggatggagagggaaggatcttacctttcgtacttttcttacatagcgtttgttgcaggtaaacaagacctaattcaaatgaatgcatactaaaagcctgtttttttttaacttttagattcttgcccctttctttttattatatgctttagtgaaatacaagtttaattaatgtagcaaaatagggcatacaaaatgaccaagacagagattgtgcccatgatgattttctcattaatgggaaagatgagacatgtacacaactgagtactaggtagaagaaagtgcctcaaaaggtgttgatactgtggtttaagaaagagaatcagctctggatgggggcattagggaagatttggtgtaggagttggtgtgtcacctgtgttttgaaggattggcaggatttggacatgtgataagtagctaagaggatttgaggcaggaaattgcatgaagcaaaggcacagagcctggaaaacttgggaaatggtgagtacttttgctgcttctatgatggggattattaaattgtgtttcaattttctttttaaaaaagatctcttttaaaatgttttatagcagatgcaggcaggcgtagttttttcaactcaggtaatttgtatttgaagctgtagcgggtagctgttcagaccacatagtaagagcattttggagagggagtccttgggactggtttctcaaagaaggaacagactggtttggccagaaccatagagcactggaaagataggttgggatcatagcataggctgatttaacaccagggttaaatgactttatttgatagcttcatgtgttcaaatgaaatacaaattataattataaaattaatatatactcattgtaatcactttcacacaattcagtattcctccagacattttctctgcatatataagcatactatagatagtatcttgaatttaaaaaaattccaaacatatttttcaattcaatacttataactcaggtttgtttttgaaaac

SEQ ID NO: 51384 - DNA, 1092 bp, Homo sapiens
gtcacccaggctggagtgcgatggcacgatctcggctcactgcaactttgcttcccaggttcaagcgattttcctgcctcagtctcccgagtagctgggattacagacatgtgccaccacacctggctaatttttgtatttttagaagagacagggttttaccatgttggccaggctggtcttgaactcctaacctcaagtgatccacctgccttggcttcctaaagggccgggattacaggcgtgagccactgcacacggcatatttttaactggtaaaatttgccagtatgtcagcaagtgtgagcaatatatttaactgtgaaaattttccttatatggttagttataaaatgatgtggcctctaattcataaaccactcggtatttgaggaatcctcataccctatttgtcttgggtatttgcatcagaagtcgaagccatgggttttatcttaattttaaagtagttatatacatgacttttaaggactttggttaggctgtttttcattgcaaggaacagaaagtcttccgagtcatctcaagttggggaaaagtagaacagaaatttaagccgtacgagccaggcctcacctaagaacaaaaaccccaggtctgcagtgcctcatacatactggaatactgtcagggatatgggtcccacccagctttagcgaccagataccttgttgcctcctcagcaggaggagtttgtggcgccttaccctagtgccatggccctgtatatgaatgtccaggctgtgtgttgcaataaatataccaccccaaaggggacaatattaatgtggttggcctggactaaccttaaaagagagcttgtgaggaagcatggctgtgcagcatcttcagacagtcctgcagcagcagggcagagctcctcctacaaaaacccattctagctcacgcagccatgcacacacttagcagagcatgcacggacacattcattggcacctgtatatgttccctaggctcccagaagtctgattcttttttgagagagggtctcgctctgttgttcaggctggagtgcagtggcatgagcatagctcactgcagccttgaact

SEQ ID NO: 51385 - DNA, 4352 bp, Homo sapiens
gagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggtaagtgtccaacttgcccgcgccgggtcgtgtgctttcttttttggcccctcgtcctggtggtcagagagggtcggccgtgaaagcagtcactcgcccggggggaggcaggaagaaaaggctggggtcgaagccgaagtcgaggggagtcgggcgagggcagggcacttctttggtcctgtccgggccaggtgaccgttcctgcgtgccttctgacccctgctctctcttggcctcttattcatgctcttgttctacttgtttgaggttaaactatttcatgtgactacattattggctgaaactggaagggaaggaagtcaaggactgaaactgtaaatttcttgaatgtttgtggatttcggggtgctggggggaggactttattattaaagtatcattttctcattgggggaagatttcctctttgtgctcccaatctctagttctcagctgtatgtgattagaaaattatgaaacccaaagtcacttgcagcagaatagaattcttactatcctgttttagttctgctctctgaaggagggtggcttctatttattactaatttttaagatgatggaaagattcgtagttttacatacacgtgtgtatgtgtgtctgctaggaggggggaaaagtgttgcaggcttcctttgaaactggttgcttgagaagttgttgaaaggaaaacagaatgattcattgttgaattgtcattttcctctgtctcttttccaaggtttgcttacaatttttctggattacagacttcaaacattgatttaagtaaaatgggtccttgagaaactgggtgctttaaatgtttcagtatctgttgcttttttaaggtacatttagaaagtagttttgtatgaatcgtgaaatagccttcttcacagcgaatttttaaacgcaaaaaaagataactagtaagagggtgaacttggtgaattacaaaatagacattttaatatagcaggaattgatgcatctaagatttgaaacagttttcataattgctttccatttaaagagagacctttttgtctagtgtacactggtctttttagtctcagtctgttgggggaggggagagaagctggatctgtacaataataaaatcatctttgggttgatattttgttccatggatttgcttgctgagttaatactactgtaaattatcaaccagttttgattttgatggcctgggatgggtggaaagctggcttccagctctccctgttgttgttgaggtcgaagggaaaagaggcagaggcagacagacacacatatacacacacacacacacacatacacacacacacaataccaagctgagggctcattgttcttccatacacacattcattctctctctcccatatttgggactaggtttgcacagacaaacacagctctttttgggagagaagagagaagatgggggaagggagggtgcttttctgttacagctttcttccacccatctcatgcctggccgtttttgcaaccttgtgaggcagaagagtgcattggaaactaaaggacactcaaaaacatgttcagagacttctcttctctctgcctccctttattccttttgcagccgtggtttctgctgctctttcttttttgtatatgtaaagataaaatccctctttatatgttgtggccttacgttcagctctcattgcttttgtatttctcattgaccctgattttgttggggacagtgatttgttcacttgagtcttagtagtgaatgtgagcagagtctttctagatagaaatagattttattgattaatattataaaggttgtattgaggttaatatttagcaagatgatgtttgcatgtttttagtggtgtgatggtttgatggtcaggtttgctggcaattgagctgtcaatgttgtttttgtaaataagggttataagaaaagatctggttttctgtttagggggctcctttgaatactggacagggaataggctagtccacctgggataaacccagctgtggcccaaggatggaggttggtgtgaatacatgtgggttgcagaatagcaccttctactggttaattgtttggaaagatccagacgaagaggatgggggaggggattaatggctgaggcttaatgattttcttttaagcgcagttgttgtgcctttctgcaaatgccacttccccgagctgctaatacagatgtcctttgacaggcacggttgcattgaggcattattatgttactggttgtgcttcgacattaatttgttctgttaccagaagtatttacactttgtgacttcccaggactcctttgaatgataccttctcatcttttatgagataatttctcttgaaatattaaaccagagggtttatttctgttcccagtattggaaactatatacaccagcagtcttttaaaaaagtttttagtatcattaataaaaaatcaaataaacctactctatggaaagtaaaattgtagcactggacagaggtttttcttgggatttaaaccaggtagaggggtagaggaggagttgaaggagggaaatctcactaaaatcggcaattttgcaaatgtagtggccttgcattgcagtagtgttgttttcagtagtcttataaagtctgatagggtgacttattgtatggattagataaagaatttaaaattggaagccagagaaaatgtgaaatgagtgtgtacacaaattatcatagaagagggtcaaattgttgcccaaaggcttgtaaactaaggtgcagtttcagagataatctgcttaataaatgtctcaaaggatttttattttcacaaatcctggcccatctcagttgttctaatgtaatgaactattagagaggtttgcagtggtaaaggggactgggtgtgtaggataaacatctgttccagactgactgcttctaggaatgtgacttctgattcactttactttcaaaacttcaagagtaatctctaaagttgtgtatcttttacaatgaaatgtgaacagttcaaatgtattattttctcagtgggaatggattcaggggatttcagttcaatatattctccatcagtgttttgtcacaaggaaactagaactgagaaccaattcacaacaaaaaggtaatccaaatcaagaaataaaatgtaccagttaccttttcaactttgatttactggtcagtcgaaaaagcttttaaaaaataggacagtaaggcctagtgcggtggctcacgcctgtaatcccagcactttgggaggccaaggcgagtggaccacttgaggtcaggagttcgagaccagcctggccaacatggtgaaacctcgtctctactaaaaatacaaaaattagcctggcactttggcgcgtggctgtaatcccagctacttggggggctgaggcacgataattgcttgaactcagaggcagaggttgcagggagctgagattggcaccactgtactccatcctgggtgacacagcgagactctgtctaaaaaaaaaaaaaaaaaaaggaaaaaataggatagtaaacactgtcaggtcctgcaataattatgtgtaatactgaacagatactgaacagaaatgttccaggtgctgtaaaaacacacatataagaatataatctgtgcccttctaaaaacctgtatatgctgaatattatcatggatttagtaagcattcattacttaaaaattagtttcaaatatcagtgatcaaaaaaaatttaagtagtaaaataagttggacataccaagttcttttgagagtagtatgctttcctactaagctacttttggcagctacttttgcagtcgatttaaaggttaagatagcagaaaattcaaatgtttaagtgagtcattagtgtaacctagctgtgaacttcgttacacacacatacacacatcctgaaagaaaagctattgttttacataatcagtttctgataatgctgtgctctagttaattacgggatttctttttttactaccaggaattcctcttgaatgatatttaagtgattgttgaatcatatttgtgtgattggtatcctgataattattctgaagttgaagctctccttgtcctatttaagtgtgattttgccgagc

SEQ ID NO: 51386 - DNA, 1014 bp, Homo sapiens
cccaaaaggttcagaaatcaaagtgggaggccgggcgcagtggctcatgcctgtaatcccagcactttgggaggccaaggcgagtggatcacctgaagtcaggagttcgagaccagcctggccaacatggtgaaaccccgtctctactaaaaatacaaaaattagctgggcatgatggcaggcacctgtaatcccagctactcgggaggctgaggcaggagaatcacttgaatccaggatgtaaaggttgcagtgtgctgagatcacgccactgcactccagcctgggcgacaaagctagactctgtctcaacgacgacaacaaaaaagaaatcaaaatgggccaaggaagaagtctcgctttgaccaggtcccatggcctctgctgtgcctcgtcccagcatctgcggtgacacaggagagagtgttgacaaggatgtgctgtccgggaatctccctttatccagtgacagctccattcatctcaccgagctttgcccagagctctgggctggcttcactctggctctgagtccctgtgagccacagggtacagtccacttgcaacagtaaacctgcgccagccagctggggctggagagaaggaagggctgggatggcagccagcccagccaggcagcgtgcagagccagcagctaggggaggccacggaggcccagggtcttggggcagccccactgcgccccctggcggctgaaggaagctcctgggcgcgtctggacctggaccaccagctgaccttctgcacagttaaagagtagctgtgacctggctttcatatgcagaaataaataaataaataaataaataaatagagtagccaggaggagtagccaggatgagggccctgaccagggctccttacatattgtgtctcaccgcacccctagcaggcggatgcaggggcgccctgctctcatggcagggaaagctgagctgcacctgcagaaggttgggggaaggattaaccccctccaaccccccccggtacaga

SEQ ID NO: 51387 - DNA, 1952 bp, Homo sapiens
atcaaaatagacctggcgtgaactggttgcagtagcgcacacctgtagtcccagctaatcaagaggctgaggcaggaggatcacttaaacccaagagtttgagaccagcctctaggcaagaccagtatagtgaaaccctgtctctaaaaacatgagtcagagacctggtgagcatttcacagcaccctggcccctctggtgctcctcaagaagcaagtcttgggctcatctgtgagctagattgggatggtaggaccagaggggcttactgccctgtggggctctctggacccagtgccatgcttctctgctctgctctccccaggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggtaaaggcgctagggaaccgcccccccacccagccctgcagcgccagctccctctgttggggggtcgtccacacctgccactgtggaaatctattctttccacctgtagtttgtaaagatcaagacccttcaaacggttttaaggaggaaaaggggagcttcattttattttacttatttttttctttttttttttttttttgagatggagtctctgtcgcccaggctggagtgcagtggcgcaatctcggctcactacaacttccgcctcctgggctcaagtgatacctactagtttggggagccaagtgtctgtccgtctgtcctgctggcagggcagcttagccatggacagcagaccctgagcctgagctctcaacggcacagcctggcgggaggatcctgccatcccgggctgcctccactgggctttctcttggaccccgcttctgctctatttaaggcctgtgccttgggacagctgatctcagctgcttactgtaactgtatcttggccaggacagctgttcctgggcactaaatttgggagcatttgtcagtgagaagggctgctttcttggaaagagagctgaatttcccattttgtatgcaccaagaactctgacccatggtttcttgccccaaagcagaaaaaaagtaactgatgtcagaactactggttggggcctgaacacctgttgatctttgtgttacagtccctgtgtagcagctgttgaagggaagttttctctgtacctacctgttttccaaacctgttgtcaccatctcttcccaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccaggtgagtgttccccgagtgccatctccctttcctgccactgacctgcagcagggcagctggagcatctggctggctggtgatggctgcaaggaggggatggggagggagtgtctgaacttccagctcccgtaggggattcaccactgggtttgcccccagttgtgcatacacagggcttcacagaggttcttgtgtagctaaggagctcgggtgccagcagcgacattgcataataagttgttcacagtcaggagcagaggcagtctgtgctccattagacaggtgagggaaccaagccttcagaatcagaacagccacttggtactgagatgtatcatgcttcctgtgagctgggaatattcattttaggctgtgtgtgtgcacaggatagagactgtgaccacctttct

SEQ ID NO: 51388 - DNA, 4694 bp, Homo sapiens
gcaggagaatcgcttgaacccaggaggtggagattgcagtgagccaagatcacgccatacactctagcctgggggatagagcgagattctgtctcaaaagaaaaaaaaagtaccagaacgtcttcaatgccctgtgtggctcgcattggatttctcttgggcagtgctgctggagtaatccacagggcaccaatgcgagcttgtgagggatgcatatttgcctgggtcagaatctacattttaacaagacctccaggtggcatgtaggctctgctgtagaacactttctttctgctagaggaattagtcatctttgcagtaagttctgcagtacaggatcataaacatgtgaaaggcatgaagaacagcccagagcgtttaattcacacagctggtaggaggaagaaacagctccctaatgacaaatgcatctgtgggcgggaggggacttgggattgtgctggaactggatttctgaattgctactacatcttttttcctctcatccaggtctcttcagagctgctgtgcccagtggtgcttcaactggtatctatgaggccctagagctccgggacaatgataagactcgctatatggggaagggtaagccttagaacccacagcccatggcctccctgcttccagccccattcctggccttgcccagtcctgtcctctctgggtggcacttgcacttgcaggtttatggcaggtaaacctgctgtgacccatgatgttgatggaagcagtgcaccaccttgtggacaggaaagttggtgtgtggattccggggttcccgagcctgcatgctctgggtcgagagttccaatgcttgcttctattgcagtttgttcccaatctgcgaaatactccttcacggttaggacaggaacccaagcatgagaacagggcctgttaactaaagaaaagtttccccatctcccaggagggttctgtgggccctccagagatcatcagcctcttcacgggctagaaaggatccagggaaggtctaaccaatgacctgccctgaatggtgagctgcaggtgtgtcatttagtgtgattttcctgttgactgactcataggagccctgctctgtggcagagctagcctctggctgtattcaaattgacttagtgtgtgtgcaacattgacctttctagagatagaacatgtggccaaattacagaaaagcacatagggctagatcacgcattctcagtggggcacccggaaaactccaaaaaggctgcagggaggggacaatgatgaaatcaggttgtgaaacactgggctggtgtcgcagtggtggtgctgggtgttcagtcccgctttaatgctgtaagaagcactctacacacacgaacatgttaccatttgaccgttgtttaatggcgtacgtggggacttagccggagcaggatgatgctgtgccttgatggtaatgagtgctcagtaagtaagcatttgtggaagattgaacgcatggcccctgaaatgctctcctctgctttcctgccccctcactgtctctcactcgcagtccttaatcaccggttctcttctgagtctctctcatttttccttcttcatcctctgctgggcaggcgtctccagacccattaagtatattaatgagttcctggcaccagccctgtgcactcaggtaactgattgaacagcctttagtctgcagttggcgtttccagtgcatggtcttgcaaactaacctccagtcagatcgttctgagccagctgctgttttgtgtggctctaaccctctggggtcctaggtaggagcactcagactgggccggaaagtcctccgattctggggggaaaggggagagggggaagaggtcccacagaaggtcccttggtgggcttccgcgtcggcctcaacagtggttctctctaacaatgctgctcaagcctgttttaaagttaatgtcagtaatttgatttgattgttccttccaggtgtctcaaaggctgttgagcacatcaataaaactattgcgcctgccctggttagcaaggtaggacctgcctcctgataactaatgtgtctaatgccaccagagcgtctcccaggcccaggggctttcctgtttatggaagagcttattctgagagctgtagaagcctattggattccctgtcacgcacgagaacaatccatgcatgacataattctaacctgcccgctgcctcaccccacttttgggagcagatggaattgcatcagaagaatgagacacttcgagccctgaggtttcttcccccctgcaactctctggacctttgaagaaattaagatccagattttaagagtggctctcaggggtgtttgtggtagtgtccatggtgactaatttctcatgaactttggaattatttactataattctactgactttaacagtggagttcctgttaagtaaaatctggaaatctcagtatgtcaaacataaaagagctgctggaggtgaagtagggctggggacccagcaacccacccgactctgcaggttttatctcatttaccctcccttcggcccgtccctccgtaattcctgtggcgctcatcagatgggactggtttgaaaacccctgtctaaaaacactccgggccaggtgcagtggctcacacctgtaatcccagcactttgggaagctgaggtgtgtggatcacttgaggtcaggagttggagaccagtctagccaacatggtgaaaccctatctctactaaaagtacaaaaattggccgggcatggtggtgcacgcctgtagtcccagctacttgggagtctgagacatgagaatcgcttgaagctgggaggcagaggttgcagtgagcagagattgtgccactgcactccagcctgggcaacagagtgagactctgtctcaaaaaataaaaataacaaagctctctaggcccagtccaagcccagccacagcctccgtctattcttgaatctagtccctctcctccatgaattcattctgtacacgagggaaaaggaggagttcctttgttgtctctgtccctgactcgttggtttaggcctggcttttgtggcactctgtaattactccctgcccgaccagcccccagacaaaatgtcttgttaccgttctgtctgcaccaccccctgccagtctcccggacacctccacacataccttgttctctgtcccttcatacccctgcatagtgtgactcacacgatgagcaggatcccctgacttttttttaaccccctagagaaacataccaaactgttagtgagaattgacctctgaagctgtgtgcttgggtaactgcctgcctgttgcagtgatgccttgacaaagctgtgaaagacaccaaattgctcatacagcatgatgggatcagagttgattttctttgcatatttttttatatcaagcacatcatagataaaaataatgccttgttattaatatattagtttaaaatggaatgctgatttttggctgggtgcagtggctaacgcctgtaattccaacactttaggaggactttaggaggctgaggtgggcagatcccttgaggccaggagtttgagaccagcctgggcaacatggcaaagcccatctctataaaaaaaaaatataaaaattagccaggcatgatggtgcatgcctatagtcccagctgagtttggaggatcatttgagcccacgaggtggaggttgcagtgagctgagatcgtgacactgcattcctgccttggcaacagaatgagactctgtcttaaaaaataaaaattaaaaaattaaaaagtaatactgatttttattggattactttgagccagttctcagtacgtcagttttgttactttatagtctcatcaaaaattcattttgatccatcattagacgctttgctaaatgatttcggactacctgcagaaatcatgcctcccatcagaggatgaagatttgccatctttgcagttagccaagagtgagcagcagagcctgcctttcaagggctcagcctgcttgagtgaacagtgagctttgcttatttattgcctatgaaagccatgttcctgggtagcagtggtctacatagcacatacctgacagttctcttgggtgtaaagtcactttgggctccctgggtagactattaaccttttgttacaaaagcattgtctgagagtgccatctctgttgcattgttgggtgaatgcctgataaccatcaaagcaagcagaaggcagttttttgtctccccactgatttttgtcctccactttttttgcttataaaacaaacatcacagaattgattttgatattacacagttccaaagtcagattccatggtaggggagcaaaggctatgcagataagagtggccccaacccctcattctcccctctccctcgtagaaactgaacgtcacagaacaagagaagattgacaaactgatgatcgagatggatggaacagaaaataaatgtgagtggcctgaggtggcgtctttactggggaagatcatgaagtctcctgaagattttaaaacctttcaggaagaggcccatgatcttagtgatgagctacatgagcctgtggtctcttcccatttctttgctttactcttaagaaatcacacttttggccaggtgcggtggctcacgcctgta

SEQ ID NO: 51389 - DNA, 1058 bp, Homo sapiens
ccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctaggtaatgattggggaagggctgagcaacgggcaggcggcgcagggcttttctgggcttgtggggctcttttccctccgagggaggcggcgcgcccgcaggcccagcgtggcggggtcgggggcacgtgcaagccgcctccctgggtgggaactggcgcccccgctcaccccgaggcccggggcgggggcgcaatgccaggcgcacgtgctgggcccccgatttctttggaggggaaagtgcagatcaacacgtgattaccgactgcggggccgagtcactgtcagggaaggtcgggagctgcacacgcgagctgcttagcacagcgggagttgggagtggaagttgcttttccatcgtagccaagtgtaaggtttttgggatagacgcagacttagcggcggtggccactcaggccaggcccttcctaaaatggaggagggcggcgatagtggagatggccacgaggctgcggccccctcccccaccggtagcccccgcctctcgcccgcgctcgcggcccgcgcttctgcctagtaagcggtgactcatttaactccgagaaggcacctcttgaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttca

SEQ ID NO: 51390 - DNA, 1050 bp, Homo sapiens
atgagcccaaaccaaggcattttggtctttcttcaagggcacttacccagaagtctccaggggccatatttatttctttcattgatcataaaatgtgtcctctgcctagccatgataatggtgaccgcagcagttacacttaggagtacttccctatgtagtggttcaatgccagctgctttccagacgttattccttcttaccctcacaacaatcctgctgattattccctttctacagatgagaaaatggccgcagggtgagcacccggccaagagcactcagccaggagcaggtgtctgagtgcgtctatccccaaagtctctcctctcaatcccttccaggaagaagtaaactgggaaattgtttcttaatcatcagcttctatgttctgctgaactcaagagattggaacctggcgaggcctgggcctgagctgtcctcccgaggggcagcgctggtccctgacattctgttaccttctgtcttcttggtcaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtaatgtatggtatcactttgccgaagtcttcccattcgattgcctggttaacaagggttctccccagcatctcaacgaacgtcaacaactaaggggtcctacagtattttctgtgtgcagggctactgtgcctcgtctagccaaccttttttttttttttttttttgtgagacagagtctcgctctgtcacctgggctggagtgcagtggcacgatctcagctcactgcaacctccgcctcccaggttcaagcaattctcctgcctcagcctcccgagtagctgggactccaggagtgtgccaccacgcccggctagtttttatttttagtagggacagggttttattatgttgcccaggcaggtctcaaactcccaggttcaagcagtctgc

SEQ ID NO: 51391 - DNA, 1076 bp, Homo sapiens
ggagcgtggagggacaggtgctgggacctgggggtgccctgaggtagggcttagggacctaggggcttaggggcgtggtgtgagggcgtgggcggggctcaggagcctcgggcaccgggtggagcttggaagcctcaggggcgtggcgggggcggggctcagggcccggggcaacgggacgaggaagggcacctgagccagggtcagggcccggaacacaggggtgtggcggggtgcgtgggcggagcggggcgcgtgggttaggctctaggcccaggtctctgggccctgtggacaggggatcggggcgcgtgggcggagctctaagtcccagtctcaacgcgggggcacacgggcggggggggggcgtgtgggcgggaagggcatgtgggccgggggacgtgtgtccggggctcggattgtgggcggggctcagggcctgggacggcgggacggggctgggagtgtaggcggggcttaaaggccggggtaccggggtggggcgcggcgcgtgggcggggctcagggcccgggatataggggcggggcgcagggcgtggacggggttcagggcccggggcccagatgggcgggggagcggccggacgcgggcggggcgggcgcctggacgcgagcctagggcgcctcggtgcccagacggcggcggcgtggccgcacgcgcggcccggcttctgtcctcgcggcgctccggctcctggccccccacgccatgcagccgtccccgccgcccaccgagctggtgccgtcggagcgcgccgtggtgctgctgtcgtgcgcactctccgcgctcggctcgggcctgctggtggccacgcacgccctgtggcccgacctgcgcagccgggcacggcgcctgctgctcttcctgtcgctggccgacctgctctcggccgcctcctacttctacggagtgctgcagaacttcgcgggcccgtcgtgggactgcgtgctgcagggcgcgctgtccaccttcgccaacaccagctccttcttctggaccgtggccattgcgctctacttgtacctcagcatcgtccgcgccgcgcgcgggcctc

SEQ ID NO: 51392 - DNA, 1048 bp, Homo sapiens
acagcacctgctgcgacccccacccccagcctctgctgcttctcccgttgcccttccagccactgccctgggcacctcccctgctcccgcctccctgcctgggcccatctttctttgcacctcaccaattgcggggcttcctagtgctggaggggaagggagcctgcttccattctcaccactctgaaagaagaccctgcagagaggttttctggaatttggagcctaaccttggccttgacacagtccagatgagaaggccgtcccccagttaagccagccctccctccctctcaatgctggagaggaaaccaggcagctggttgcttcagcaaaccccctccctatgggaattgtccttttcttcctcaaatagactggagtgcagaggacttgcttcagagagagcccctttgtaacgcacattgcacgggccgtgccccatgcccactctgccacaaactcccctcagctgcccagccccgtggagccaggcgtgggctgaagtggggccaatgaaatgcctggaatgccagccgcagtgacaggccagcactcagatgcctctcgggagttctgaccgaagcagcactgaggactgcttcagagcagaagtctacgccattttccccagttctaggcagaagtaaagaatgtctctaccttctcccaaccagcaattgattcagagtcctgagcttttaaattaaagggacccctctgttgctttatgcagtagccagcttattcatttgagttcaggtgaaatcattttcaagtaacctcttcctatccagctttacttttagttatgctgacataaaaacaataaaaattgtcctcctcagagttcacctgtaaaagttcctggataattagtaaggaaacagaaagagcagatagttgttgcttcagataaaagtgatgtctgggttgggcacggtggcgcatgcctgtaatcccagcacttggggaggcccaggtggatggatcccttgagctcaggagtttcagaccagcctgggcaacatctctacaaaaaatacaa

SEQ ID NO: 51393 - DNA, 1036 bp, Homo sapiens
ggattacaggtgtgaaccaccgtgcccagcctatttatttttttagagacaaggtctcgctctatcacccaggctggagtgcagtggtgtgatcacggctcactgcagcctccgcctcccaggctcaggtgatcctcctgcctcacaggcgtgcaccaccatgcccagctcactttttaattttttgtagagatagcaccttgcaatgttgcccagacaggtcttgaactcctgtcctcaagcagtcctccctcctcaggccctcaaagtgttggggattatatgcgtgagccaccagaccaggccaggatatacttctaaatgaaaagctaccggcccagccttagccgatttcggtcatgaaagtggcttttctttctgaatccatcacctgtggcccctactttagctgtgttggcctttaacctgttagaggacattaaagcaatctctttgctctcatatagtcatattgtgtttggatcagagggacgtctgaggtttcatctgcttatgcagacggtgccagctaagccgtgccttttgggtccaggtgacctccaaagcaggcctctccaacacataaagatcattgggacatagtcacgtgtgaagggtctgcccgtgtccgctgtgcattaggtgctgttggggaaatgggagcagaggatgaggtcatgaccccacacacccgcaacctgatgtttgctgtcatggtggaagcatgcccgtggtggggggtaagggtatggggcttcgttttgtttggtttggttttcagtatatttaccagtccccgccaccaggcttctagaacagttctggcaagagatccctccacctctaaacatgctgtgtcttcccattgctcctaaaacaaaggcgggttcttcgtggaggcctgcgaggtcgcccacttctgcctcacttgtccccgccttcttggttgcttcaacaccgtggcctccttggcaacttcagccaccacacgaccctcccaggctgctggtcctccctccccgagccctacttcacc

SEQ ID NO: 51394 - DNA, 2969 bp, Homo sapiens
ccaaatgtcccctgggtgacaaaatcatcccccaaactgctggattagaggctttggaaatggattttctgtgaccactgcttcaccattgtaagctgcctctcatttgggtgcagttttctttgttccttttccaaaaagctgacctcatcgggcccatttgtttgtttcgttgactcacccagtctaaccgcaagcagccttcctcctctgggggatcccaaatgacttatcatgggactttgtatgtaaatttcaaagattattttctactaaatcagaggcagaaatcctcaacttcttttttagcagccttggtaaatacttccttagagtgtttaaggggcgtgccgcactcctgctggtggtctgattgtgaacacctttgctgttcagttccctgaaatcgccaaatatttccctctcctttgggtctcagcccagtgactagcggatgatctaagggccagggcggtctgagttggctagtgcaccggggattttcttaaggcctttgacccggggactggtgtgggaggaaggcaaaggcctggttgtttatgagcaaggaggagtcaggtccgaggatggagcccttcggggtcactgccctgggccctgcccctctcctgcacatcaggccccttggacaaggcccgtgtgtttgcaggaccctcttggggcagcagagcaagggctggctttgagagagagcctcacttttttgtttttttttttttttttttttttaagtagagacggggtttctccatgttggtcaggccagtcttgaactcctcacctcaggtgatctgccctcctcggcctcccaaagtgctgggattacaggcgtgagcgaccgcgctcggccagggcttcactttcaagctcagtgctgctctgaggggtggacacagccctgatgtcagtagctgaagacctgcctggccacactcagcagcagttagccttctcctcccgcgccccgtgaacaaggctgtaccctgggaggttgggctctgtctgaattccatcacaggtcctctcctgggccttgccctgctttgttgcctccttaggaggatgtcttctggtttcctaggaagggctttatatcttaacatccaccctgcattcaaaacccaagttatcaagaccacagggcaccacaaccctcctcttggccttgcggtttctattcttcagtgactcccagaggtttggcttgattggcagcttagaagcacatgattgaacttgagcagtggttgaaactcagagtcagatgcctgacccgccccaatcccaggcacagagtctgacctcacacccaggctgtgctgtgtactcagttgttcagtatcgacttgagcttgacgggcatcaggggccagggagtgaaagggaagagaagccaaatctggctgctaagggctctcagtcctggagggcaggaaaatagtggccttgccgctagacctgatgccacctgcccctccagctgtaccccctcaacaccttgggtaatacctcaagccccacgtcctcttccaagccagataggaccccaagtgctgggtgatccttattgaagggtagggacaggagggacccgtgggattgtgtgtgctcagagcggagttcaggggcacctgagggcaaactgtctctttgctcccagggctgtcctccgtgcctttacctgtgctgggccctggcagagctctgagtcttctggattccagcgtccatagtagctagtctgtccactgctggagaaaagctgctttcccaaaatagccacccagggggaaagagcagccctggaatttgaccctgacgatcaccgtgacggggctgctggccccacctggcctgacctccacgacatcacggaaggactgttggttagttgtgggggccaggatttttcctctgtccccctcccctcttcttcttccctttcttctttctctctgccagcttcaggtttgaaattccagtgacaccgagggagatgctccagtgcctgtccggctggggggcaggtcacatggtgggagcagagaggggagggcacttgtgcgcctgcacctcttggcaggtgaatgcacacctatggaggggcctgggtgctggcagcgagccccgctccctgcggctgtgccaggcccagaggcggcagcgagcccaacaggtcagacaggtggagccaggctggggaagctgcaggaccagagctgacatccgatcaatccaaggtccttctttggcccacagagcaggtaacccacccttttctttcttttttttttttctttctttctttttttttctggtttaattcactgacaactttagggaacatttacaacccgagaaaaaggccattgagattggggggcaatcgcgaattgtttggagagggatttgtggtgttttgtgtggaggaaatttggcctcggcattagaaaagcatttctaattttcaggtctttgattctgaaagcagatttcttatggagcctgggtgctgggtggcatattggggaggcaaagcccagaagccatgagggttttcctgtgactgctgatggaacaccgtgggaggctgtagtttggtggcctgtttgcctccataaggaggggttggggcagagacagggtggtcgggggactgctccgcgacaggacttggctgtatgggggaagctctcccagttcctatcagagaaacacgtggagggctggactccctccaaaattcaaatttatgctacaggcccttactggggctggattttacttggagattgtttggagttttgaaatcacctctcctggtaagaagactcggtctcctgtgttcttgccccctctgtatcttggccagtgatggttcccttagacaaattgatgggggatttctggcctgaggacaggaagaaaaggagcccaggtctgtttca

SEQ ID NO: 51395 - DNA, 2280 bp, Homo sapiens
aatatgatgttatgcccacattgcatttattttattttatttttagagacagggtcttgctctgttgctcaggctggagtacagtggtgtgatcatagcctactgcagcctcaaaatcctgggttcaagcgatcctccctcctcagcctcttgagtaactgggactacaggtgcacacctggatgattttaaaatatttttttagagatggcctctccctgtgttgcccaagctggtctcaaactcctgggctcaagagatcctcccacctcagcttcccaaagcattaggattacaggtgtgagccaccgtgcctggtctgaatttcttgctttacatgttagctgggaagtagatgccctcaagaatggtggagcatatgagctgtccctctaggtcagtcccatggccacccagctccagccctgtctctaggtgtgtgaatcccttttgcacaacagagagcctggggaggtggaaggtcttggtgacaccttgtgagttattcacactggctgtgggtgacagagccagaggtgggagcacagagctctcacagcacagaggagtaaggagttgaagctgcagaaacaatgctgaggcctgaggtggaggaacagttgtaaatggaaaattagacggcagttctgcaggttggaaagtgggtgataaagtgggcgtgcaggcaccattccaggaggctgtgccttgtgtgcattgagagcaggtcaggtggccaggaggctccaagcttaaagctgccaggtgagccaagcattttttttttttttttttttttgagacagagtctccttctgtcacccaggctggagtgcagtagcgcgatcttggctcactgcaacttctgcctcccaggttcaagtgattctcctgcctcagcctcctgaatagctgggattacaggcgtgcgtcacacgcccagctaatttttgtatttttagtagagatggggtttcaccatgttggtcaggctggtcaggctggtcttgaactcctaacctcgtgatctgcctgccttgtcctcccaaagtgctgggattacagggtgagccactgcgcctggcctttctttcttttttctttttctttttctttttttttttttttgagacagtctcactctgtcacccaggctggagtgcagtggtgccatctcggctcactgcaacttccacctctggggttcatgcgattctcctgcctcagcctaccgagtagctgagattacaggtgtgtgccaccacgcctggctaatttttgtatttttggagacaccagtttcaccatgttggccaggctgatcttgaactgctgacctcaggtgattccgcctgcctcggcctcccaaagtgctgggatgacaggcatgagccaccacgcccggcctgggccaagcatttttgcagtgactttcctccttgtgagcagcctcagaggcaggcactggatccagaacctcgtcttgatcctaacagcctctgtgtgccagctgcaatagcatccaagctacagggaagcagtttctattttcgcattggagtcagcggctcctgcctgcctggtgggtcgcatcctcccattctttgctcaaacttcaaaagggccttccaggatccgccttcccagggtacattgaagagctggtgtttccccacatccaccctctctcccgaggaaaggccgtggtctgaggggaacggcagtggcaggggccacctactcagggggagtgcaggcaggaggtctaggggtgtaagatgggcagcctccctgctgcagggggctcccagctggagcgtggacttgtttctctcatttcctgaggtttgctggagacaggcgtttgcttagcgccgggagctgtctcctgtggtctctgtcctttgacttattcagagtctcacttggcgtcggttttccagggtctggtaaccaggatgaatgacgcatggagttgcaacccagactgcagttcaggagtttcccaagcaggcaaggctctgtatcccgtgaaagggggtgtggatacgagatattctgcccttattcttattttttcctaatgttcttttagatttataaaataagtaataatactcataaaaactcaaacgggccagacgcggtggctcatgcttgtaatcccagcactttgggaggctgaggctggagaaacacttgagcccagaggtttgagaccagcttgagcaacatagtaagaccctgtctctaaaagaattgttttaaacattagccggg

SEQ ID NO: 51396 - DNA, 1656 bp, Homo sapiens
tggtgaaaccctgtctctattaaaaatataaaaattagccaggcacggtggtgtgcatctgtgatcccagctactcagtgggctgaggtaggagaatcacttgaacccaggaggcagaggttgcagtgaaccgagaccacaccattgcactccagcctgggtgaaagagtgagacttcatctcaaaaaaaaaaaaaaaaaattttaaaggtggtatctcactctgtcacccaggctagtctcaaattcctggcctcaagcagtcctcccgcctcagctcaacctgttttcttatcctaaaataaatcattcctgtcctgcctacctcccagagtctctaggaggatcacacaagatgggtccttattcccaaatcctccctgatacacctcatgttcaaagctctgtcctccaggtacaatagctagacagctcattgccaccctgatggtctttacagtctggtcaggacaacagaaggtaaataactaatgcacaaatagccaacattgactgaatactcgcagtatgctcagcccttactgtaaagtgctaagcagtttacaaatattaccttatttcatccctatactagtcctctgaggtggctgctattgttcccatgtttacacataggaaactgaggcttagaggggttatgttgatgggcacatgcgtgatcatggtagagcctggcttgaacatgtgtagtatgacccagtgtctgtggacatgatcatggtgcttctgtcaaggtgcagggtgacaggcacgagaaccataaaccgcacacttgtccgggactgttgtcatggccacatcttcattatcatcatcagattagttttctattgctgcgtaacagaggactacaaagtagcttaggaaacacacatttattatcgcacagtttctgtgggtcaggagtctgggcacagtttagctgggtcctgtgtaaggctgccattaaggtctaagccagggctggggtctcatctggtgactcagctggggaaagatcctcttccaagctcactcaggttgttggtggaatttatctcgttgcggttggacgactggagtccttggcttcttgctggctgttgattggcactgctctcagctcctagagtccgcccgcaggcctttgccttgtagccccctccctaggctctcccacagcatggcagcttgtttctttaaagccagtgagggagagtgtcttcagcacgagcctgctagcaggagagggaatcttatataacgcagcgcaatccttgagtgacactctgccgtccatgccatattctgttggctagaagccagttacgggtcttgcccatactaaaggagggggtcacacaaaggcatgaacaccatgaggcagtggccataggggccaccttatcatttgtcgcccacaatttctaccttcatttgtgcttgtccttaaatatgtgtcaaatgaactttgttagaaattgtatgtaagtcagtggagaaatagaaaaaacattgggagtgacagtgttcctgatggtttcttgtcgtgtcaacaacttacaagaacatttaggatgccagcagcgtgtctgacatgttttttattccctcctggattccatggacctgccctctggggagttaatacagtcag

SEQ ID NO: 51397 - DNA, 2846 bp, Homo sapiens
gcacggtggtcctgggggcagcttgtcccggaagggcgcggggcgcactggctgggatctataatggttggggcaggagggtgggtggggagccccttctccatggcggcgggaggtcttcggcgctgcccctgcccgcgcctccctgcccaccccaagggcgcccgaccgtgcgcgcagggcagcgtggaaagggtgggaaatgcagggagcgcgccttgggggctgccccatgctcccccctgtagctccgcgctcaggacccgcgtccgactttgcgtctctgggaacctttaaggccggtgaggggggctgagccgcggcccctcggctgagccaagccctgccccacgcaaggtccccagcctggcgcacccggctccccagcgccgcgcgccggccatgtcccttcccaccccagccccccgggacccgagagccgtgcggggccgagcctcgtgccccgaggcacgccgagccaagtcacccctgcagcccgcggcgccggaacttgggggcgcagtgagtgggggcagggcgccgggccggcgggcggtggccgtggctgggtgccggttcctggctttagaagtcctttcgcatcttgttgaatccggggctgcattggccctccgagctctccggactggcaacgtcgcagagacaacaggtcctgacccgggacagaccccacacccgcgtccaggacgtgggtttcttccctcttccaggcgagaggccctcggactgggcgtcgcggcgagccccccgtggtttctgtttgcttttgtacggtcccccttccccccaccaccctgtcccggccccacccgggccttggtcccaccgcgaaggggcgaggagtccccggaagggtcgcgatggccggggagtccgggacctcggctctgggtaggcgcgccccgcgacccagcggcggcgtgggcgaggggcgctgcgcaaactacgcgctctcgctggggaaacgccagcccaggcgggcggcggcggtgaaggggatgaggaccaggaccccgtgcccggcgggactggccccgcaccccacgccgcccccctgcggtgcgcaccgcatctgcgccctaggccgaggccaggctccgacccctcccccgcaccgacgtgattcggatcgcgcggtgctggcgccgccttcatgcgccctgcctggcccccacctggtcctctttccttttcaggtggaggagatgccgctgtcccgtcggtctggggacagcccagctccccggatcccgggctggagagacgcgtcgcggccccggggcctggtggcacgagcaggaaggaggacccggcggcgggctctgcctgggcttgcctgggcttgttccgagccgggctgcttctcggtgaccacgcagatcgggggcatttggagattttgcgggagtcctgcagccaagctccggggcaggagaggcctggaagcctgcactacctgctcgccccgtcccagcatgcacccaggtaaacgcttgtgtttctcagtccgtgcgaaagtttgcaaagaaggaggcgggaactagaccaacaactttaataatcatagtcataataatgaaaaccctgttcaattgtgtagcctccgtaaggggaagaatttccaagaagcaacaaaatgttctttgatttcataatctctggggagaaaggattccttttttggggttttgctcggctagttctttcttccctcctctatctccagcgtggggcgaggaaggccgactggttcatgggtggcaaatggggaccctggctctcttgcgctgctggccacggtgatattgcagcaaatgctcaacctccccagttcctctcctcaccttgaaagtggaggcattgatactagccacccatggttgcaaaaaactcgcatgaaagggaaaggaaaagtgcttcggtcactaaagtagcgttgtctaagaggtcaaggctttggaagacttttgctctagaagaggggaacgggagaggggctttcagccaacctggccccgaggtgaacgcgcgcgccccctgctggctggagccctgtccagcctgtgagccgccagtggggaaggagactgaggggaggtggtccctggagttccttgctcctggcctggagcagcaggtgccagtgctcctgaggccccctctctcaggttacgtggatggggcctgtagcacagacagggcacatgcttcagcacctccctgtttctgcgtcaggtgggggacatgagctaggctctgcagaaggttccagagcctgggccttcctgttgcatccacactaggctcctggagcccagaggtggctgggatctctgcatacatgcatgtgaaactctagcagataccaagtcatgttaagggggctaaacggcccactgcagttatgttagccagttctgcctctgcccagttctgagatatctttgggacaaatggccactcctctgagcccctgtgtcttcctgcatgagccacaaatgctgtgtagtcatggctgaggaagagggaaggtacctgtgcttgcaaacattcctcttgaaggactatccaggagcagagggagcagctgggggcagcatcagttggtacctgagcccattggcacctactgccacatggggtagtggcctgtctcctgagcttccccaagctggccaaaactggccaggactgccctgctctcccctcccaatccagctttctcttgggcctccaggatcccttggctagctggtgtggtggccatgaggactgcacttttgcaccccacccctgcccttggcacacatcgcaaatcaataatg

SEQ ID NO: 51398 - DNA, 1073 bp, Homo sapiens
ctcttccttctgcatcagaatgtccttttaaaaagatccccaggaaattcaaatgctcattaaagtttgagaaacactgtaaaggttaaaaaaacataaaaaaaaaaatacccacacatactacccccacccatttaggaaagagttgttttttagttgttttgcaaccacagagtaagcaatcatgttgtaatacccaatatcttggatttgtttaaaggagtgctggcaacataacagataagggaggccaacctcagaaccggggacccacaacaggactggtcagggaggactgtggcaaacctcagagtcagaacaggattaaagagagggccaggagtcagttcaggccaggtggccatccgtcacagctgtctgcagtcttctggggtgggggcagaggtgctggcccttggggctcccccacctgcccatgccaggactctggaggcttagctcctccctttgtaccaggcacgtccagagccctggctaccaggatccgatcagcagctctgaagcgcagcctgccagctggcggctcctccttctccaggctgttctctgggcttcagatttcttgctgcctctctcctgcactgaccttgcagcttctccttctctccagacgagcgattgccggttgaggaaaaaacgcttgaagggccaaggacagggactggaaagcaggaggaaaaagcagaatggtcctgtggtccgtgtgtgtatttaggggtgagggcagatacagggagagtgggagaggaaggctggggagccacccgtgtggccctgatcctctagttaaagctccagtgatggacgcgtcgtgtgtcctgtagacactggctcagacactgtggttgggtcctcaccttgggttggtccctcactaggaccctcttggagatggatcttgagagagatgaggaagaggcagagggggtggtgggaggagggggtctgacgtcagggtcaagaggcagattggtgccctctgtatagggatggtggagaggtcattgggctggttctgtggggacttttgtaagttatctctttaaacctca

SEQ ID NO: 51399 - DNA, 1078 bp, Homo sapiens
gcagagctgtctgcaaggtgagcccagggcagctgccggatctcctgtccagagagagcaccagcaagcacactgtgctctccttggccctcacctctttttatttttagtaatcccagaaggtgttgatggggattgcagctggctcttagttgtcttttttttttttttttaatctatttttgttgagaaaacctggatttcccacaatgtggaagcaacgaggaaggggtttctggtcccggttctgaaggctgtgaccttcagcgcacatctatacaatgctgatagccccggcacctctctctctcgggtagttctaaggattaaatcagataatgcacacggaaatacgttacaaatggaagtgttgttgttcttccaagtttgcaaggagaggcagcggcagtgttcttgcagtgtgtctgagttccacgtgacttatattggattattatataaatcctgtaattgatctgtcatacttttatgtccattctttatgtcatatttctctctcacatatacatacacagttgtatacatacttaaatctctatgtattagcagtctgcacaacatataccttttaatatttatatttctgttcagttctgttcataccacagaatatgtgttataaactcttttattaagctttttggttgtttctagttttttgctattttattattattatcttggagtcttgttatgttacccaggctggtcttgaacgcctggtctcaagtgatcctctcttgctttaacctcccaaatagctgagactacaggagtgccccacctccccggcttctatcttagatggtactttgtgagctttttttaaaattgagatacaatgcacataccacaaaatttacgcttttaaaatataaaattaagtggtttttagtatatttacaaagttatgcaactactatctaattcgagaacatttatgagcattttaaaaaacatattccctttaagtatatacttcggcagtagaatgacggggccaaaggggagaagtgctttctagctgttactctctgttatgagtctgagcagcaca

SEQ ID NO: 51400 - DNA, 1218 bp, Homo sapiens
ctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgag

SEQ ID NO: 51401 - DNA, 1298 bp, Homo sapiens
ctccctctgggtaagtgcttgtcgactgagtcaacgactgaatcagccgcggttgtcagggctcagctggactgagcgctgctgcctgtgggcgtttcctcctcatgtgttttttatcagcagcagcggctgcagggtccccgtgctcaggggttgcctctgtcgtgctcactctgccccgcgctctgtccacacccctgctccatccaactcgcagatggagcggtttcctttgagccccagtcctgtccaaacacacatgggtgctgggctttccctgtggcacattttctaccctctgtaggcaggaaagagcaagcacatggaggcagccctgttgtccttggcctttccaggacacctgggaggagacagcaccctgtgaggctaagagctggactctggagtcagaaaggtctgagttcaaatcccacccctgctgctgagagagtggcacagggcagtttcaccactgtgagcttgttcctcctctgtgaactgaataataaaccctgctttccagaaaagaggcgcacagagaggactttatcatagggcccacgatgagctcccggggtccgagcgagagacccgcagcaccacttggtgggggcagggccgtgtgtctgcatgtgcacctgttcatctgcccaccgcaggctctcacataccagggctttgtcttctgcaaggatgaccaagacatggccctgcactcaggaaatgacaggcaaggagcgttctcaggggtggcagatgtagcgagagcacttgggtcggagccacagggctctgggcagagactgcggttccgtgttgggggaaggaggttagggagtcaggaaagatctccatcatgtgggggccttgaattagaagttcagcaagtgccacagactgatttcacatcccaccacaagtatttattgagcacctattgtgtaataggcactgtgcctggtgctgggatacacggggtggtagcacaaaggaagacactgcccagggctcctggcctggcggggacacagacaagggcccaagggatggcagccccaaggggcagggccaagctgggccatgcggagggtgccgtgggactgcctggcaggagcatctgtccaccctggggatcagtgcagaacgtgattccatcctgatggaaaagacgtttcggctgggagcagaaagatgaggaaagcgctgctgtgtggcatggggccagctgcttcccctccctgagcctcggtctcctcacccacaagcggagggacttggagctctgctctctcaggttc

SEQ ID NO: 51402 - DNA, 1050 bp, Homo sapiens
gtgaggagggcaaggctgagaagctcagcggggctgggacaagagctgcacctgccggcacccagcctggccctctgcctgcctccccatgccgcatcacggacaaagcagtagggctgggaaccagctcagcagattccactgcgacaaaagaccccgtactggctccaagggacacagccccgtgccagtgttgcccacccacgttagctctcccacaggaaggcatcgcagcagcagtcaggactttgtggctgccttttgggtaccaggcacaaagcttcttgtgtcgttgtctcacgcaagtctttacaatacaacacacacaccttgtggtttctgctctccccgttttacagatgaggaaaccaagacctggagaggctcgagtcacatgacggggtgggagctgaatgtgaatgtgactcctgagctgcagcttctaaccatcgagtgatgcacactctgaggcccacagtgacatgtgcatggcacccttggcctgatgccagtgaccttgccctccacctgtgggatgcagcctggtttcgaccctctactagggcatcacgtgcagcaaagaacactgagtggggagttggtggggggcctcaggagcacaggcagccccacctacggagggaccgcactgctcacaaggttgctgactaattctctttgcaaacggttcagtttcacatgcttgagtttccagtaactatgtgggtggatttgtttcatttaaggggaaaacaaaacaaaacaaaacaaaacatggagttttctttcccaagaagagggctcgccagttacgggtttcacgcgtgcggctccgggcatcctggtgcagttctgcagccagcggggcctcttggcagacgggttcagaggtggaaattgcttagtcatttgcaaactgggaccaggtgcccaaggtcagggaggtggtgggtccgcagcggcacagtggtctccgggtcctgctgagggcaccacggtggtcctgtgttcttcctgactcagccttgccctgggctggcagggggtggg

SEQ ID NO: 51403 - DNA, 1450 bp, Homo sapiens
ctagactgtgctagggcagaggtgagagacagcccctggggcacaagggaggggcatgtgtgcacgtgtatttatgtgtgtgcatatgtgcttgtgtgtgtgtccccacacgggctcaaccaggtgatactggtactcagcaagcagagcagactttgatgggcacgtagggcagggtcctagggggctgctgctgggccaggcatcacgccttgaggtgctggatggcgaggaggggggggctgatcgaagcgggttcaggggctgccatttacgaaaggctgggagcgttttgctaccttagagcccacccgttcccgccatcttggggcacaggcgcaggtggtcagccgtgactcccggattcctgtggcgcggcacgggccttcgtcaggaccacggctgcttctccaggggagaccgccccggaagcggcattgggtctgggtctgggggccgcagcagcttcgagcccagcttgggaggtggctggctttccacctcggttctccctgctcctatgacctggccggaccttgtgacctctctgagcctcagtttccatctgtgaaatgcgggtataagagtgcccccgggtagagggagctgcctggtgctctccttctgatcgcagagatcccaggccccgtagcagggccaggcctcaccttggatgcaccttcctgcttccaagtggaaacacacggtggaatttagaatccttaacctggcctgtgagggtttgcttccggtgctctcgcgaaggaaagagagaactcacaaataatatattatactaggcagagggtgagaaaggtgcttagaggccagcaaggttctggccttggggatcagggtttactctcagcaggtgaatctgggaaggcttcctggaggaggtgatgctgaaactgggccttgggatgtgtaagcactggagagggaggaggaagggaagaagggaataaatgtcactggcggaaggtggcatgtgtgtgcaaaaccactgggagctttgatgatacccggtatatagtaagtgcttgataaaagtcatcaccgaaatcaatctgactccaggatttggtttaggtatctgggagaaggggtgtgggggcgtgtggtagagattttcagaccaccaggtgagaacagacaggttttttgtcgtttgtttttgagacagagtcttgctttgtcacccaggctggggacaaagctcactgcggcttctgcctcccaggctcggggatcctcacacctcagcctcttgagtagctgggacctcaggtatgcactaccacgcccagatatatatatatttttgtattttgtattttttgtagagttggggtttcaccctattgccaggctggtctcaaactcctgagctgaagcagtccaccctccttggcctcccagagtgttgggattacaggcgtgagtcacc

SEQ ID NO: 51404 - DNA, 1170 bp, Homo sapiens
agcattgttctaggcagggggttgcagctcgaccaagacagactgcagggcggtcatcagccattattgcctcttgggccgggactgtcctctgtgtctgtgtcgcctcctccatcccagccagatggctgaaagctcccggggactttgcctcctttcacctttcctccccctgccctgccccacgtgtgtgcagatatggggtggccccatctccgccatttgattgggaggcctctcgagggctgggagaagccgtttcccttggcgttccatagcacgctgctactgagatgttttgtgtatagtggcctcgctccgtgcatctaagttgttccttgatacacagaggaagcacgcagccctctcttccattttgcaagtatttggagcaatggagcaggagaaactgacttgccccaaatctctgatcattttctagacattgccctaccctggtgacttagggtcgtgactgcaccccgggctcgcctctctcggctctggctggccacgaccttccttttgaaggtgcctggagggtgactccgtgtttcttgtttcctcgtgggggattttaaatttatgtcactggtggtttggaagctacaacgtcctgcgccgggtttagcaggatggagttagagtgagctctggccacgaaaggctggcctgatggggaggggccaaacccctccccctgccaggctccagtggaaggtccccctcccctgcttaaaatctccttcccgagtccctggctgccactctccaggccaaggcagtgggagttgctgtgcgggggattctggctggaaaaggcagccgtgtaattacaggtactggaaatagtcctgtttccctttcagccttttccttctacccctcccccgaaaagaaaacaacaaccaaaaaatccccccaaaacacaaagctggaaaaagctcttaaaccttcttagtttagtctgcagaggcgtctcaggcggtgggccttaaacatttacattcttggggcttagctgactccttcgagcgtcgagtttctgggttgatggcacatccagggtgaaggaagaactccttacagagaaagcccgtgtgtgtggtggagctctagacagcccgatggcagggggtgggctccgagctccagggcccattcttggga

SEQ ID NO: 51405 - DNA, 1017 bp, Homo sapiens
gcggggaccctaaccccttctttcctgcttgctgcccttttccagacttccagattggagaggcacctggatcccgagaaccccagcctccttgcacctgggggtcttggcttaggggcaggtgctcagggcagggcactgggatggttcctcattcttagatgcatctgccgtcgtttcgtggggaagagactagcacaacccccagtgcccacttgcagcgcttccgggggtcccaggatggccctctaagcccacggcctccacagtggccactcatacgatgatccccctgagtatgggcagaaattggtagctatttttatctcatccagtttcatttctatttttgggatgtgtgtttcataatgtatgtaatctatcgatacagaagcatgtgagtagcacgtatgcatggatatgtatgtctttggcagatacatgcttaaaagtcgatcgccaggcaagcgcataactaaaacaggatagtagctgctggaaatgaggttctggggtgtaaagggaagggggtgtcatcgggggtccaggaaaggctgtgccatggggaatgcaccttacgaggcagagcaggcagactgggagtgtagggttgggcacgagctgggcagacagcaggatctgagcacttgtctgtgcttggggagcagctggccactccagtgcaccaggatgcaagcacctgagccagtaggacagagtcttgggggagtgtgggggagaaatttgacccctgtttcttcaccatttcctaaggtctcaaccaagggtcagcaaactttaagagcctgatggtaatgatttaggctttgtagaccatatggtgtctgccgcaactactcgactctgtagcgtgaaagcagccacagacaacatgtaaactggtgagcctggctgtgtgccaatcaagcttcacttccagaagtagatagtgggccatatttggcccctgggcatagtttgcccaactctggtctagatttaagaggacgggcccta

SEQ ID NO: 51406 - DNA, 1120 bp, Homo sapiens
ggattcagcaactatgggggcagcaatttacaatgtttggcgctaatgtgggaagccaagaagaggaggaattgagggagatgaggggtttgaatctgggtgaactagaggttgatgatagaaattggcagcattgtagaggccaggagggggccatttgagtctacaagggatgtatgagtgggagcagggtcactgctggggagatgatatttggtggacacgtcaggttcacaggcagacactccctggagccatgagagcaaaggatcccacggagggaggtcctgtggagggagagaccctcaaaaacatctgtgtgtaaggagcaggaagaacaggcggaggagctgagacagaaccttagagagtgagtcagatactgtcacaaaactaggagcgtttcaggtcaagggcatggtggtattttcagatacagttgagaggtagagagaggatgcttgttttttgggcccgttcaatttatcgattaggaggtcatgatcttggaagagcattttccctgcagggtctaggcctgaggtcagcttgctgcttctgcagcctgagtgcgtagagggtgacggagaccacaggaagtgtggtggcagcaggagagggcatcggctgtgggtggttctggcctgggccccatcctgggctccgtggctgagacttggtttcagtgctctccaccagcaagtgctcactgagcttctgccctcgtgggctgcgtcaggcacccagcaaacccccagggtccaagaatcagcctcccaggtgcacactccatgggaaaatggccagaaacatggaacccaccttcttcggtgagaaccttggtctgccctgttcagtgtctgctcccagagggaccagcacagccatctgtcacttcctggacagcagcctgtccctaattcttagccatttagggcctggtcttatatgcatttatctcctttttcaagtccacttctacttcctgtcagttctgtcttcttgtcagcttcttttttttttttttttttttaaggcagagtctcactctgttgcccaggctggagtgcaatggtgtgatctcggctcactgcaacctccgcctcccaggttcaggcga

SEQ ID NO: 51407 - DNA, 1621 bp, Homo sapiens
acaagagttggccctgaagtccctctaagaggccaaggacgggggctcagtgggggaaagaggagagggctcctgacactcaggggaggagtgtggccagggcaggcacctcacacctggccagccacctgcccacctagccagtgagattgttcactcgttttaactttaaggcctccatggtttggggacaggaagccctctttggggggatgggagaacagggtgaggctgggggtaggggaggggtgcaccctaacctcgcaccccagccctctgcgggcttttctccccttcagctgtgagtgcagcgcctccagccttgctgaggtggggtccccagttaggtgcctctctgggggtggcatccgctcagagcctcaggccaccctcctgatggggactccctggccaccggggccctgagccaatatccgtggaggctgcagagccgctggtaaggatgaacctccctgctccctgcctccgttcgttctcttgctccctcactctgtctctgtctctcctgggacgccccatgaagccagggcagctgctctagccgaagatcagcatggggaaaaacagacccaagagcacctttaggggcgggaggggtaacttaagagagtgacctggtggctcttccggtgaggaagggacgtgggtctgctgccaacgctctggccaaggtcagcagcctgtctctgaaaaaaggcagggatggagatgtccccacctcctcagctggggtgcagggaagagggagcaggtttgaattggttcctggaagacattgagtgctcagatgggggaggggccaacatctctccctgcaggtcccctgtcccctcgctcctccccccagacctggagacatggaggttggcggttggggggtgccactcagctctcccctaccccgtttcttcaggcttctgctcatggagacctgggagacagccaaggccctggccgtgggctccccaggacccctttgtggggtgcccctgcccaggggagaccctgtccccagggaggaggttcgtgactgtatgggggctctgggtgtgctgtgacaggaggcagttggggatccatgcctaggctatcctggctgcgcctaaggcccctccaggacagcacttgtgggggtcagtgtacctaaggccacccaggacagcacttgctggggaggacagggggcacagccagatgctgccctggccactctcttgccagctccggcctcgcccaggaggaagtatactttcttctttgctggtgagtttctgttcatttcaggacaagttgcctgggaaccagagagttggtcacagctggaaaagggtctgggaagggaatcgtgctggcttcacctttgagtctggccttgcaggcagggctggggtcttcagtgccgccttttgaggtctgagggggcgtcacctcccccatatgacttcgtggctgtgaaacgtgggtggcgtgggccacgattctgccttcgccccagcttcctgggggcgctcccgccttgctctgctgtgctttcctgaatgggatgagggggtctttgggtcttggggagggtgcagcagccacagaacaggagcgtgga

SEQ ID NO: 51408 - DNA, 1100 bp, Homo sapiens
gatggatgatgaatgaatagatggatgaatgattggttggatggatggatgatgaatagatggatagatgagtgaataatggatggatgcgtgtataatgaattgatggatgaatgtttggattgatagataagtggttgaacaaacagatggatggatgtgggtggatgggtgggtagggggtggatgagtgtttagattgatggatggatgagtggatgaacaagtggatggatgaatgagtggatggataaatgaacggatggatgggtgggtggatggatggatggatggatgagtggatggatggatggatgagtggatggatggatgggtggatggatgggtggatggatgggtggatggatgagtggatggatggatgggtggatggatcagtgaatgaatggatggatggatggatggataaatgaacaggtggatgagtgggtagatggatggatggatggatgagtgggtggatggatcagtgaatggatggatgagtggatggataagcagatagactaatgaattgatggataaatggatagatggatgaattaataagtaggtggtctttgtttctctgggtgacctgcctccaggtttgatcctcagttgaccaaattctagcccagttgccagcatatcatcgagctggggtttgtaaccttggggatactagggcctctccggtaaatgaatgctagtgacctctctcactcattagacaggcttagagtctttctcttctgccagaggcttctgagtgggctctgagatacagtcctgagggacttcttcagtcatgaagttggggaggagcatgcagatcagaaacagactgagtcaacagcgaactccacctgtccctttgggaaggggagtggcctttctcagactgtgaatgcagcccatgtgtaggggcaccgtgctggtgtgggaggtgaaggctccatggctgcccagctgggagtccgtggtagcaggagggcctggcgttgcagaacggctcaccccgtgtacggccctctctcagagttccttgcctgcatgagtcccttctaccgcctgcaagtcccacgttgggaagcaag

SEQ ID NO: 51409 - DNA, 1041 bp, Homo sapiens
tgtgcctggctttttttttttttaagagctagggtctgtcgcccaggctgggtgcagtggctcttcacaggagcagtcatagttcactgcagcctcgaactcctgggctcaagtgatgcccccaccttagcctgtagctgggactacaggcatgcgtcaccacacccagcttatgactgtacgttttgatggtttcatgcaacaaaggctgctctttgtcttggaagaaaccaagacaagcattttatcccaatggctaaaaaactctgactgtcctcctccacacccttgacagagggccatctgccagtgattgggaatgcactagacagcccatcctaattttggacggaattaattgttagaatctgctttgtaacactaggccaaatctatctcttgtaagtcctggtctggccttcaggagctacacagacccagttcctcctctttacggcgttaaatatttgacgatggccgatggccctgggctctgggccacccttatgaggcctccaagtcttctgttcacaaattgaacaccttcccccaacaaaaaaggtgttttttttcttttcttaacgatgcttttatgaatattcttgtacataaatctcttcatatttgcctttggatacatttctataaatgaaacttctgggacaaatggtgcattttatagtttgtgctatatatttccagattaccctccagaatggatgattttttgcttgtacgcccaccagcaatttacaagagagcctgtttccccacagcttacccaccaacatggggaattttcattctttttaatcattgccaatctgataaggggaaatgattatttcatggttgccttaattttcatttctttgattatgagtgagattggacatgttttccaaccacatcctatacttttgcaatcgagttttggagctcaatgcaggacctaacatgtattccagttaaattttatcttgttggattcaaccaatcattccttcctgttgagataattttggacctgactctgcagtc

SEQ ID NO: 51410 - DNA, 1023 bp, Homo sapiens
gcacaatcggctcactgcagcctctgcctcctgggttcacgccattctcctgcctcagcctcccgagtagctgggactacaggcgcctgccaccacgcccagctaatttttttctttttttgtatttttagtagagacagggtttcactgtgttagccaggatggtctcgatctgctgacctcgtgatccacccacctcagcctcccaaagtgctgggattacaggcgtgagccaccgcgcccggcacgttctagttttaaagagagaaaagctaagcttagcattccattgtgtagggaatagtatagcttctctgatctgctttggtttcccttacaggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtaagttcagtcttgtctgctcctgccacctgcacaccctgtaccgccactgtcaacagagaatgttcatcaagcttatcaaatgtgatgttctgtttgcatagccttggtcctaacttaagaattagatttctttaccaatacctttgagctctgaccttgctcccctggcagcggggggtcccagtgtacatgtgaccatcatccagggcagttaaagtaaacctagcaaagcaaaccaaaaatccacgtgtaaattgttgcatcacatcattgctcttgctcaaagcttttgagggaaatgaagataagaggtgatagagtaaaattttaaaaattgcacaacagaagagttgtgaatattttattttattttatttatttactttttttgagacagaagaatctcgctctgtcacccaagctggagtgcaatggtgcgatcttggctcgctgcaggtgatctgcccaccttggcctcccaaagtgctggtattacaggc

SEQ ID NO: 51411 - DNA, 1224 bp, Homo sapiens
tgcagtgagccgagatcacgccattgcactccagcctgggcaacaagagtgaaactccgtctaaataataataataaataaataaaaatacaaaattagctgggtgtggtggtgagtgcctgtaatcccagctacttgggaggctgaggcaggagaattgctagaacccaggaggcagaggttccagtgagccgagatcatgttactgcactccagcctgggcaacagagcgagactccatctcaaaaagaaaaaaaaaagggagagaaagaaaatatgtctaactgatgctttttgaggcatgttttttcactgtgctaatgatagcagtattctacagccttccgattctgtattgtaaccaaatcagataagagtcgagcttgacatctctcaaacattttattctctcaaggaactaatgagaaggttgactctttatcatttttaataggccttgcctgaggggttttaaaggtttgtcttttcttattattcaggtcgatcttggagaaagagggaccaaagtcactttttagaggcttgggtccaaatttggttggagttgcaccatcaaggtaagcattaaactttccagctagctcatgctaagcagtatggaattctgggtcctttcttaccaaagggtgatgctgctgaatgaccagtgtctttttctatgttggatttgcctaaatatagcggacatagcaaatagtcattgagaatgctaggcgtgtcttcagtgtgtgaaagaaaggattctacttactgtattctttatattcttaagtgtgaaaattaatctgctatcattactgtaatgtactttaagtgtttgctactctaagtatggcatgtggccagcagcattagtattgtatgagagcttgttataaacacacaatcccagggcacatcccagacctacatcagaatctgcattttaacagaacccccaggtgactccaacgcagttagaaacactgatccagaggaattgtaaaggcttttaacttcactttctgtaaaatgacatcctcatatctttgcagggcttctcctgaaagcctgtttgaaatatacagaactgtactgtcccagtacataagggtagtcactggccacatggagcagtttaaatgtaaattaatcagaattaaaggttcagttgctcagtcttcatgtttcaagcactcaatctccacatgcagctaatggcta

SEQ ID NO: 51412 - DNA, 1557 bp, Homo sapiens
gtgggaaatagacacagttgtaaccttgacaattttattttatttatttattttttgagacagagtcttgcttgctccgtggcccaggctggagtgtagtggcacgatcccgactcattgcgaccttcacctcccaggttcaagcgatcctcattcctcagccactctagtagtaggcgtgcaccaccttgcctggctaatttttgtttttcagtagagacggggtttcaccatgttggccaggctggtctccaactcctggcctcaagtgatccacccgcctcggcctcccaaagttctgggattacaggtgtgagccaccgcacccggcctaaccttgacagttttaaagttgtgtgctgtggattcgttccccatttaatatgtggcgtaaagtaggtctttctctctctgcagaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatacatttggcttgtgtcctcttttatgctcactatactatgaaggacttaagtaattcagataaacctgccctagaactgcagagaaaaatgataaagtgagaatacaacttgttttataatctgactttaagatcttgcactgctagacagggaagaagtgtcgcattttggctgggcactgtggctcacgcccgtaatcccagcactttgggaggccgaggcagatggatcacgtgaagtcaggagttccagaccagcctggccaacatggcgaaaccctgtctctactaaaaatacaaaaattagccggacgtgtgcctgtaatcccagctacttgggaggctgaggcaggagaatcacttgaaacccagggggcagaggttgcagcgagctgagatcacgtcacttcactccagcctggtcgacagagtgagactccatctcaaaaaaaaaaaaattgtgtcacattttggtggtggtgtgtggaccaggacaaacttcccagcaatttttcttctttgtacatttccaattacttgcagattgatcatctaagcgttcagactgctgagatgaatatatataactttctgagactcaatattttaagctataaaaaacttcctgaagttatccttttctccctactttgaaccaaaggcaag

SEQ ID NO: 51413 - DNA, 1284 bp, Homo sapiens
cgcctgcccgcctgcccgcctacccgcctacccgcctacccgcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggtgagtgcatggttcggccccacgcggccctctgcgccgcccgccaggcccgcccccgcgccgccccggcccgctgcccccctcggccgggacccgggctgcccgcgggcgcgcggagacccccggcgcgcgccgccgccccccgagaccgggttgagactgcagtcgggaagcggctgcggagtcgagtggagcggcggggactccgggaacgtggggcgcgggcgagagcgccgcgcgggggccacaaacttcctccgggagccgcggggggctggagccggtgcgcacgggccgcccctgccctcagccccgtgctgggccccggtgcacggcgatgctggcgatcgcggctggcggttgctgctcggcatgtgacgtcccgggcgtttttctacacgcctcgcatccgcgcgtttcagagccacagcccctgcttacgctagagcagctgagggacagggaggctcagtaacttgctgttaatgagaggaatcatggtttgagccgatggaatctgcagggcagaccccgaggctgggctgcctcccagaggtgggcaaggcctgagatgcctccaaacagttcaagacgggccggggccaccctcctccctgcccggctcacgggccatgcgggcccccgggttcagatccggcctctttcatcggcctccatcgccaggcataaaagcttagtggcctgttgcttcagcagagcctcgcaggtagcttactgtttctccacttgatccacctttccagagggcaggggggaaagtggggttgtgagaacatcctagaaagagtggatgggtttgcagcttcggcaagggatgcaatgagctcacacccttaggaaaaaggggagaagggacttgcccactcagcagcaagtggcagagctggggtttgaaccctgatcgtctggctggtctgtttgttcttccttaacacataccggtgctgcttctctcctccaggggggaaacggggaaaaagaagtacaggtggttgagtcacagaggcttcccagaggaggaaggcatgggagggacatcagctgtgtctggaggatgggccagatg

SEQ ID NO: 51414 - DNA, 1049 bp, Homo sapiens
gcctgctacaaccactgagctccccagggcagggaccaagccccatccagtgccccctctagcaggttccccctacctggtgctttcctaggctgaggacccagcgctgggctcgcacctagaacagagcccctcccacctgcagggaatagtgaggcatcccgcaggagctttgtttcaatacatgtccgtgctcagggctctggagtggtgtcatcattaaggacacgtgcccgtcttgttttccctcagtgtgtatgttgggcttgtggacggggcaggtacagagcatgcagctgccctagctttttcttagggacccatctccctccgggcttcctcaggcttcccaggggctcggcatcgagctagcaggagccgagatagtggcctccaggccctcgtgtccacccatcaaatgggacccatagggccagctgctgtccccccagagctggaaccgttgtgggcaggggcagcccctccaggcccgagctcctctcttgcttgtgttgcagggacattctgtcacgttacctcaaaccttgcccaccaactgtggtttgtcccagagtcaagttaaggacggaggttgttggcttgcagaagagaagtgggctgaggggtttatcagggaaacttgggggcttctcccagagcaaaaacagggtccagcctaggctggctcagaagagattgacccagatgctgcctcaacaggccgggcagaggcaagcataggctaggggccaggacttcccccacctgcgtggggacctcgtccgagctgtggacagtgtttcacatgtggtcatgtgtctgacgccgccgtgctggtgcctgggggacctgcaattcatgcccagctccccatcgacccctggcctacctgcctcttgggacctttcagggctcacccccaaaggcactgtgggagaggaccccctggcaggtagggcccgcctggccaaagtgggtggcagctgctctggccaccagagagcccacccccaactctagcagggattacccagggctgagagtgacag

SEQ ID NO: 51415 - DNA, 1050 bp, Homo sapiens
cggggttgtccatctgccccactccaggcagtgtcagcccgcagccaccttcccccatgttcacccaccttcttggagctctgcatctggggagcagaccctgagctcctggcctgcgggtgcgtccctggagcaacagaaccttgttagtgtccccatcacttgtgggccctgccctggattggctctaactcccggtagtccacatggctctacacagtgggcatttgtcctgttgggcagaggggaagcaggttcaaagtggggttgacttgcccccggtcatcccctagtaagtggcaggtcaggatctgattccacgtctgacctgtaagatggaggcagctcatccacccctgcagatgccgagcctgttcccccaaccccacagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacaggtgagaggcggcatccacagggcgggggtgggggtgttgagtttgttcaggaaaccctcccaggaggctgggcactagtgaccagagggtagctcttcagagctgagcccctttatttttattttattttattttatttttgagataaagttttgctgggattacaggcacacgccaccacgcctggctaattttgtatttttggtagaaacggggtttctccgtgttgttcaggctggtctcgaactcccgatctctggtgatccgcctgccttggcctcccaaagttctgggattacagatgtgagccactgcacccgtccttttttttttttaaacagagtcttgctctgtcacccaggctggagtgcagtggcacgatctcggctcactataaccttgcctcccaggttcaagcgattctcccgtctcagcctcccgagtagctgggattacaggcacccgccatcatgcccagttaa

SEQ ID NO: 51416 - DNA, 1400 bp, Homo sapiens
agtcgagagtggcccgaggccgtccctcaccgggcatgttccctctggctgcccactccctcagggcccacatgtcctgccactcgccactctgagcacgagttcaccttccagatgtggccagggtgtgccagctcctctctcctgtgcgttggaaccccgggggaggcaagagcagatcacaggtgcatgagggttacacccgtcacctgggtctgccgggatgggttgggggggcaggtgccaggcctcactgctgtgaatctgccacgcctgggggtcctagaggctgccccaccccagtgattgggtagcagctcacatcccacccagcttcacaagtgaggaacccaggtgcatcgggagaccctcgggggcttctgtggcctctgtgcccgatgacctgcgtggcttcagacaaggccccagcgttactgggctcagcttgttgttctgtgtggagcgtgaggtgagaaaacccctctgaaaagatgtggtcggggccacgcttcccactggttctgcagtgaggagttggggcgggtgagccaaagcggccccccatggtgtctacctgaggggcagggaaccgcctgcctgtgcactcacgccaccccccagcccacaaagagcccatctgagagaaggacgtggtggagccaggacgggaaagcgtcctgtcggctggccatgctgttgcttgcgtctcgaatcttcggttctcgaggaagtgttgacagtgtgatgctaatgtctgcttttcttggcgttgggtagaagcaggacatctgtgtgtatgtgcgtatttaaattagattatttataataaccagagccagccctcgcgctggccaggatcctcctgccgagctgatgtcgctcctgccctctgccggggtccggaagcgacatctcaggaggtagctctcagcagagtgaggattcctgcctttcgtagagttttgtgtgactttttaaattattcatgtgtcccttaaaagtttcactacgtggagaaaattccagcaccaagtgttgtggcaacagctgagagagtgcaggcaccactgtgttgtggcttgttgaccgggaatgtgtcacccctgccagggaactcttctcctcgcgggggacttgggatggccatcagaccttctagggtctggctggggtcatcctaggtatgggtgaccgtccctgagacataagcgaggtagattcagccatcctcaccctcagacttgaggtccccacccaggccaagccggccccccgtaccccttgcctgggagcaaaccgccaggacgcagcctccacgccgcacctgccacattcagccctgcccaggaaggaacacatgacccttctgtctgtgactgttgctgagtctctgtctcatg

SEQ ID NO: 51417 - DNA, 1741 bp, Homo sapiens
acatcccccaacggtactctcaggtcactgggggacctggtcacccttggctgactcttggctatgtctgtgctgccgggcagggtgggcacaggaagcctagcgcagagccctgccccacaaactccctcccatggagggtcatgccccaaggtcccagcaacaccttcactgcccctgcctaaaggtgccctcagggtcattccctgaagtcgctgcgctgtcccgccaaatggaatcagaattctaacatgacgacacaaaacctcatcttctgtgtagaggtggagccttccctggagtcttgggggcaagcagcgggcgctgggcctgggaatcacaggtcagcaggcggaacaaggatgtgtccagtccggctgaccggggccttccccagggtccccagctcagctcctgccttgatgcccacattcgccaaacatggcctcgcctttggttctgaagtccaggtggtctcctggcaccttggaaggcattagaaaggttacatgattctccgggaagtcaagagctggccccacactttccttataaaacttttttagagggaaagtagcagggaggttggtggcgcgcggcttggctagcgatccccgagcatgcagtcatgctgggcgcaggtcccttaagcagcccccggctcctgcagggcgtgggccagcctgcccgctcaccagcacgttgtccactgggctcatttgtcccttggcaccgaggtaaggctggacccccggagctccgtccagacggtggactaatgtattaactgcctctgtccctctcttccctctgtaattgggtgccttaatcagaagcatggttgacgttctggcgtggggccatcaggtcctgttgtgtgatttgtaccatctcgagttaaagagacactgtcaccttccgtctttcgggcagccttgcggtcgtggatgggtctcttctaagttcggttttggcgttgtcctgtgagagcctcttccagggggttccaaggcctggctgccccccagttctgctctaccaggaacttcagaggagtttccagagtgcaaggccagagagcaggaggcagccttctaagggcagagctgtgggaggacttccaggaatcacacctgggaacagagggtgcccagagccgtgctggggcctgacttcctatgatccaggcccatctgggagatgagccaggatgtccctgagcccggccgctctgtgggaaggctcggcacagaacaagaagtggcaaggagtccaagtccattaaccttcattgagtgcctggcacggggctgggcatttttgcttcaaggcgaaagggttggcatgaggttggcaaaggcgacagtgtcactttaataccgagactcgtagtggagatagtttgctgtgagccgagggggtaggagggggcatgtggggagggccgggtcttgctggcacctcccagccacccgctcctaatggcgtgaatgtggtcggattgcttttctgctttaactaacgcacgcctcctctgggaccccagctgaggcccccaccttgcactgtgggagaggggtgggacccactgcaaggctgcctccaggacctcccgctgaccctcttcttgtcccgtgcctgacgggcccttgcaggttcttcccaggagactctgccggccttttccccaccagccccagcttggccatccctcacccgagtgtcggaggctctccagcgt

SEQ ID NO: 51418 - DNA, 1142 bp, Homo sapiens
tctgtaaagtggccattgtggtcactgcctcatcacccaggccccagctcatgacagcccagcccatggccttcctggcggctcagggttaggaaaagctgtgccttcagggaggcagggagtgggggtctttcctgctagggaagcctttggccaagagaagaattgggggtgagcctcaccagtctcagagagtaccctgggcagagccttgagctccccacaaactgcatgctctagggggctgctcagctgcacagcgaacccacccacccaaacaatgttctgaccaggtctctgctttgcaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccccatgtgccctgctttgtgacctctgttgaccttcctggaagcagccccattaccctgagaatgcggagcgccctggcccacctcgccctgtgtttcca

SEQ ID NO: 51419 - DNA, 1067 bp, Homo sapiens
tccatttccctggctcaagccatcctcccacctcagcctcccgagtagctgggactacaaggtgtgcaccaccacgactggctaatttttaatttttttgtagagacgggggtttccctatgttgcccaggctggcttgaattcctgggctcaagtgatcctcccgcctcggcctcccaaattgctgggattgcaggagtgagccacagtgccaggcctggagattttctttatagatagaaatcattttacaaaaggacagcttttcagatctactcctgtgcctgcagtttctaagaataatcccttcaaaatatggcgaagaagtatattttggggtggcacacgctggtctcccatagtcacattttgggtgtgtgtcctgagccccaacactggtcacctcgcaatggcgcttggggtccctgggtgcctagagctgcaggttaccccctcttcttctcctgctctcagcctttctcccgctcctgctgaaattctttcctgcgtgaaggcggagcgcttaaaggcgcctaggacctttatttcgttgttttcctttgcataaaaagaaaacttgttttgtagaagggcaagcaaggtgcagcttccagaggcacctgggatgatgcccctctagcggtaggcgaactggggagtgtgggcggcgggggaaggcgaggccctggaggacctgttgtttttcctgttgcaagtgaaaaggaaacaaagtgggaagtggagtgtgcgggttggcggcaggcggggcgccccggcgcgccccgcctccctccctcgaggctcactcgcgcccagcgcagtcgctccgagcggccgcgagcagagccgcccagccctgccagctgcgccgggacggtaagcgatcgccgctggctgcgtcaggggaggtgggaagaggaccgcggccaggggctttgggagctgcggctgcgctcgggggcgcggggctggctggcgggcgtctctccggcacacacagcccgtgcgccctggccctgggcgcctccccgagtctagcgagccgggtcctgggagccccgggggcc

SEQ ID NO: 51420 - DNA, 1016 bp, Homo sapiens
tgaatccccatctctactgaaaatacaaaaaattagccaggtgtggtggtagatgcctgtaatcccagctactcgggaggctgaggccgaagaattgcttgaacctgggaggtggaggttgcagtgaactgagatgtgggccattgcattccagcctgggcgacaagagcgaaactctgtctcaaaaaaaaatcagcctgtgtggtggcatgtgcctgtgatcctagctactcaggaagctgaggcaggaggatcacttgagcctgggagtttgaggctgcagtgagccatgatttgccactgcactccagcctgggtgacagagtgaaaccccgtctgtaaaataaacaagcaaacaaacagacaaaaacaaacacaaaaaataaatgtaggaaaagtagaaaaaggaaaaaaattacctctgatccagccatatgagaaaaccacagtgaatactttggctattgcctgttttctcctctatgtacagtgttttttttgtaataattctgattatgacctttcatatctttttttctgagttaacggtataacattttattcatgttattaactttatatagataccattgtattttattttgcttgagaatggtctcactttgttgcacaggctggaatgcagtggcataatcctagctctctgcagccttgacatcctgggcccaagcgatcttcccatcttagcctactgagtagctgggactacaggcatgcaccaccatgcctggctaattttattttttattattattattattatttttgtaacggtggaccttgccatgttgcccaagctatagatagcattttagttttttatttttatactttttttttttttttttgagacagggtcttgctctgtcatccaggctgtagtgcagtggcatgatcacagctcatggcagcctcaacctcctgggctcaaatgattcccccatctcagcctcctgagtagctgggactacaggtgcatgccaccataaccaact

SEQ ID NO: 51421 - DNA, 1049 bp, Homo sapiens
gcatggaagaggggctgggtccagctgggctgggggctgtggtgctccctggaggcaccagggcggtgcctgcagcctgtgagggctgcacctgcctcaacctctaggggctgagcccacctccctgttgtctcttaacactttcacacgctccatcgcaacagcctgcagtcatgggctttattgtcctgtttgctggacatgatacctgagtcctcagaggttggccctcctgcctggagtgtgtttcactggggaaatcgtataagcagggcaggtctgggttccactggcaggaatcgagggggactggatcagagggacttccagggtggtggtgtcaggtggaattggaaggggccggacatcaggtggcaggaaaagtccttccccacccacatgggctcataggaatctgagaagtccagggagccctaggatgttagagcaagggtccctgaagttcttgatccctgatggggaaactgaggcctggagtggggaatggacatgccccgaggtccccagagttggggtagctgagacagggcacccatgcacagcccgtggtaccctccctcaccccagggccgctcatgcccctcaggccttccctgtgctgcaccaccttccttcgtgtgggaagtagagttcagacccacctgaggacattcaagggggagactgacaccttaagggggaggggagaggggctgggcctctgcctcctcacccatcatcccggcaccttctacagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggtgggtcccagggccggctgggaggggtgcagaccccggagagccagtacagccccttgctgggccactc

SEQ ID NO: 51422 - DNA, 2358 bp, Homo sapiens
ccaacccccacccgttcgcaggtaggacatggggagggagaccaagcggagatgctccatgccgtccgccctgcccccaccccaccgtgggcacagcctcctgctcagcatgaccgccggtctttccctgtcccaattattccccatcacacacaaggaaactaaagccctcgaagagggcagatgatgtcacccgcagccatggagcaggacgtggccgagccaggttggaggcccatggcgagcttttcctggtatttcctcctggcctgtgggttcagctgaagcgtgctgtccagcccgttttgaccaggcacagccgaggaggtcaagggcacagtggccttctgggccgagtgacctcgcatcccgccccctcattctcccacagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggaggtaggagtgggcgggcgacctccaggactgagaggcagcacaggccagggcctccgagaagccggtacggcgcggctccttcaggttcacatgctttccatcgcgtcatctgctcagcaagcctggggcttaggtgtcttcgtgggtaaaccgaggctgagagagaccttattcaaggccgttctgccttaagtgtagagaagagccatgccagggcttggcgctcttgggtcatggtaatcctgagagagttctctggtggggcagctgaggtgctgtcccaagctgctttgtatgtgggtgactccgtgggtgctgactggagctttgttttcccttcacttctaatataacttccggtgccgtcctggctgctctgtcgctggggagggagacgctggggcaagttctccttcctctgtggctgtcgagaggagaatgccaggtgacggggctgtgggcagggccggactcatgtggccgtcacttctccttgccagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcac

SEQ ID NO: 51423 - DNA, 1079 bp, Homo sapiens
aggcacaatgtccccacaattcttgctcaggacacatgaaactccccccctttttttttttttttgagatggagtctcactctgtcgcccaggctggagtgcaatggtgtcatcttggctaactgcagcatccacctcctgagttcaagcgattctcctgcctcagcctcccgaatagctgggattacagggacctgccacaacgcccggttaatttttgtatttttagtagagacgggctttcaccctgttggccaggctggtctcaaactcctgacctcaggtgatccacccgtcttggcctcccaaagtgctgggattacaggcgtgagccactgcgcccagccgtttcttgaaagcaactctcgcttgcttctgtcgttggtccttacgagagccatgtaggtttggggtgagccggcagggcatccagtgtgccccgccacgctgggccccactgcccctacttaatatttctggttgggcctcttttgcagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggtaaggggagcgctgcagccacgcaggtgggccaggctgcaagaggggactttgagagctcttggctggctgctgcctgccatctgagaatgttgagttatcttagagggagatggggaaggagcacgttcgctgggatcattgttggctgcacgcatactcctgtctcctggacaggtaccggatgtgtagccactactctctaaagggggagggttgaggcgtgggatgacacgtcccccacagagggaagaatgcccctgtgcacattgcatttattcccatggctagaaagccaacttgtgtgaccccttggcctagctaacctgggtgtctaattgagcctgcctgtgctgacggctgcagccctgcccatgctcctgccctaagccacccggcaatcttccccct

SEQ ID NO: 51424 - DNA, 1050 bp, Homo sapiens
tgtgtgggttcattccccagggcgtgccaggtagagaaaacagccatgtggaacccagccagctgagaaggcagtggctggagaggctggtggcgtaggaagtgtcaccatgcaccctggtgatgagaacagggtaggccaccttaccaggtagtggccagaggtgtggggaccctcaggggacctcttggcttcaggtgagacacccccaactctccctttctccaggccatgtgcatgatcataaacggtttaatttcttcattgcgcttccatgtagattgcaaggctaacaggacttggtatgaactaacccgcatgtccatccactgagctgccagcaccggtaacaccgtgttgagtgagaagtgagttgggcgatgctgggttgcacgcctgacttcgccttttctcccctgacccaaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcaggtaacaccgagcgctcgactgcacaccactcatgggccccttagactacagccccggaggctggtgggatgagggagtgagtaatctgtgattgatacgtttactgttgggtaaaagagttgtgttcactggacttaaacgagcttttctttttcaagtcagcaattcaaatcgaacccaggccagtcccctttgtggaggcatctgtggtttcagctcctgcggttactggcttattcttctcctctctgtggctggtgtgatttcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtacgtcctgatttttaacagccggcctgttttgcccaatgacactt

SEQ ID NO: 51425 - DNA, 1108 bp, Homo sapiens
tgggaggcaggagaatcacttgaacccaggaggctgaggttgcagtgagccaagatcacaccactgcactccagcctgggcaacagagtgagactctatctcaaaacaaacaaacaaaaaaaccccacagattgtttaaaattcagttaacaggagagaggatctccttttcttttttgtggttgattctgccacttttgctacacgttggccgtggagagcttgggctgtgggcagcagcttcattcccttctaccagcgtgttgtgggggagtcttggtgtgtgtggaggtagcacaggcccgtggctcacatgggcttcacctggatacacctctagccttgccccttgatgcagccccgcacagccgcagcccaaaaggggccctagcacaccatagaggggagggctgcagggctgcagggcttgaggagtggcctttcccctcagcatgacctggagagtgttggttctgtgcttagccgctgtgtgtgtgcctttctggtaggttgtattactctgtacactggatccaggagctagaggagctgaaggtggtgagggtccccaggtccaccgtaggctatgcttccctaggtgggttccttagcctctgcatctccctctcattcagaaaaagtgattgagaatgtcttctttcctctgtcgcccaaaggttaatggctagacagatgtaaacttgtttggagcttccaaaatatacagacttccgcatgcttactgtgtaccaggcttgggacacgtgtgtgctatgcctttttgtctgcgcagtgtcttccctattaggagaagaggtgctgttggtccggaacttggtggtgtttatatcgggagcagcattgcagcccaggctcagcctctgtggagtgtcctacttcatagcacggattggggaggggaacgaattccatgtgtgtgctttcattcatcttattttgaatctaacatatgttttggcaaggaggatgtgggaaggtggaacaaaagaagcctggggttgggggtggtaaagtcacttctgggaaaaggtgattaaatacaagcttgcgtccagatgggtacatcccagagcgggatcacgaggga

SEQ ID NO: 51426 - DNA, 1428 bp, Homo sapiens
gccactgcgcccggcctaaaggcactttttatttttattcagaaaaggaatggccagtggtaaactaactcaaccctttcgagggtgggtatccagcttgcccatacaggaacttcctggtgccacactgttggcagagcagaattgggcagctccctacttgggctgtgtcctctggttagtgagcaatgcagcccccgtagtttggaaatgccctagagatgcttggcttcttttggtgagatgtatttgcagatattttgtggttagatttttttcatccttttcctcctaggaagacccttgtgttgggtgacttggtttccatgggcattgatgagaaggaaagtggacatctcacacctccccgcttccctttgcctctgtaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtacctgtcattaccccccgccctcgactcgagaattaagttgtacctctttactaggttggtggcagcaggctgtgatcggtatcctacagccttaccctcgtgtcctggatcttttccttccatttcctgtgtacagcctttttggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggcaacagcaagagtcaggcacagaaataaaggacgcagaagtagaagtgcgccttggacctggaggactcttccagagtgtttatcacttggtgacctggtaggagggctgcgagggctctgttcaccctcagcaagggccacgtgtggggaggattccatggaagtctctgctgagaggggatatgataaccaccagagcaccagtgcttcttacctgtacttaccaagtggcaggctgtgtgccaactcctttatacacgttgtctcacctaaaccttagaatcccttttttatagctgaagaaactcaggcccacagaagcagcaagccaggtgtcacccagctgatgaatcaggagccagggttttgaatttttttactttgagaagcctgtgggccaggcgcggtgtctcacacctataatcccagcactttgggaggctgaggcgggcagatcacttgaggtcaggagttcgagaccagcctggccaacgtggtgaaaccccatctctactaaatatacaaaaattagccatg

SEQ ID NO: 51427 - DNA, 1572 bp, Homo sapiens
tcacgaggtcaggagttccaggccagcctggccaacatggtgaaactccggctctcctgaaaatgcaaaaattagccagttttaatggggcgcgcctgtaatcccagctactcgggaggctgaggcaggagaacagcttgaacccgggaggtggaggttgcaatgaaccgagatcgcgccactgtactccagcctggggacaaagcaagactctgtctcgaaagaaaaaaaaaaagtaaactggagccagcagattgcctaagtgtaagacaagcacgtgcctgggggcttgaggtgcgcgggacctctggctcctcacatgagtttcaccgagcactgtggcttcaggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacaggtagggtaatagctctgcaagcgatgccaggccccagtgtccagtagggtgggtgccagcggcaggctccctctcctttcccagggtcccctgccagcctggtgctcgtaggccatgtgccatgctgtgtgcctggggcacttggttccctagagccacggcctgggcatttgggtattagctgttgttgctcagtggggtccacggtgatcacaggctccgcctctcaggaaagcccaagtgtatttgtttctaagccctgccttggcttagccgaagagttcatttatgcagatgaaattgtgtcttcaaaatccattcaagaaacagctttaatttctcctttggatctttagttggcaatttacccatagaaactgcctttgcagatatgaatcggcaccactactccctctatgtccacgggtgccggctgatcttcctcttccgtcaggatccttctgaggagaagaaatacagacctgcagagttccactggaagttgaatcaggtgagtgaattgaaaacgcactaatagggccgggcaaggtgctcacacctataatcccagcactttgggaggctggggcacgaggattgcttgagcccaggggttcgagaccagcctgggcaacattactaagatcctgtccctacaaaaaaaaaaaaacccacgaaaattagctgggcatggtggcacatgcctgtagtcctggctacttggggagctgaggtgggatgattgatggagcccaggaggtcaaggctgtaatgagctgcgattgtgccacttcactccagcctggatgacagagtgagaccccgtctccaaagaaaaagaaaaacactgtcatcttctaagagagagtaagcaggtactgcaaccttgcacatggatggctgtgtatagtcagtgtatatttataattttatgagtagctgggactacagacacatgccaccacacccagctaa

SEQ ID NO: 51428 - DNA, 1055 bp, Homo sapiens
gcgttttagcttctctctggtccaaatcaaactggctgccagccctcccaggagctggggcagcgctggtgttctcaggcctggctgtgtgctaatgagactccttttaccctcgagctatctaagtgctcctgtggaatgcctgtctatattttcttctctctctcttttgtattcctgcatgaatggatgcaaagtaaacaagttgcttggaaagccagaatctgcttcatcttactaaagcccgagaacttccccatgtttaaaacacagtgcccctgctttgtccacggaccctccaaacccctggctgccaaattgttgtcatttattttctttgggggtggagatggggggaggagggcaaggtgcagaagatctatgtggtaggaattcttacctgttctgctttgactccctaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataagtaagtaagctggacaaagagtgaacataacccaccgagtaaacgtgtgtgcgcagaacgaaaatagtagtgactattgcctgctccccaagactgtttttgaaataggcagaagatagttctcaagtgtctacaattagattgtaaacacttggagggcaggaatcatgtctctctacccttgtatacagtttctagcaagagccttgctcacattaggcatattaggttttttggggttgtttttgtttgttttttgagatggagttttgctcttgttgcccaggctggagtgcaatggcatgatcttggctcgccgcaacctccgcctcctgggttcaagcgattctcctgcctcaacctcccacatagctgggattacaggcatgcgccaccacgctcagctaattttgtatttttagtagagatggggattc

SEQ ID NO: 51429 - DNA, 1056 bp, Homo sapiens
atttaggttggaaatgaacatctgaaaactgcaaaataacaaatagatgtacttattcatggtttgtcactagagtgttcattaaaagaaaaatcctgccgggcacgggggctcactcctgtaatcccagcactttgggaggccgaggtgggcggatcacgaggtcaggagatcgagaccatcctggctaacatggtgataccctgtctctactaaaaatacaaaaaattatccgggcgtggtggcgggcgcctgtagtcccagctactcgggaggctgaggcaggagaatggtgaacccaggaggcggagcttgcagtgagccgagatagcaccactgcattccagcctgggtgacagagcgagactctgtctcaaaaaaaagaaaaatcctaatgacccctgagggtgttaggacacttcatgtaggagtatttcatccctaaattaataacttcagaattatgcagtagttcatggtaagttggattcaaagtgacattttgttcctgaagattaggttttgctgtagcaatcgtagaagccggtcgctgagcttggtgtggaaatgtgtaatatgtgcacctttgacttttttccttagtgtattccatcttcattctttcctgtattactgacatgggcttatcttttctccctttagagagttttgaggtgacagtcaccaaagaaggtgataaagggttctttcttcccctcttatgaatattaacccactaactttgtttataaaattgggaatcagcccttaaacaggagaaactgtcatgctcttttatccttatttattctcctactttgtttctattttaaagtatattgatggaaattgtatgtaaccagacccttggttagaaatatctggaaatcagacatccatttgaactgtatggataacactgtacatttttgtttaatagaacttcagagatttgctttataacaattttctattagttggaattgtggaaggagtgcagtcttattttcatgtgaaatacattttgtggagtttcacatcgacatcaaaacattt

SEQ ID NO: 51430 - DNA, 1226 bp, Homo sapiens
ctgcagcctccacctcctggactcaagcaatcctcctgcctcagcctcccacagtgctgagattacaggcatgtcactgtgcccagccgtgcaggagaagatctgatctggaaaaatatgcgaaaacaactcttaaaaattaactttacaatgtcaactccaactctgaggcagaaaaaaggtggcgcagcccattctctaccagttaaggacccaacgtgaagccagaacagctctgacttggaaaatgctattaagtgttagcaatgtacacggttattacagtatgaaaatctccaaagcaatgctacaggtttgtctctataaagactgaggctacaatctcatgtctttaaaattcactgaaggtaaaatctatgccaaaagcattcctctataaagaccgctcaacttcttcaagtaagtcttctcaggtcattgaaatctaggtaatgcaaggaacccctggcgctgtgattctccggctccatgccacttgaggaccagcaacaccagcagtacctaggagcaggtgagaaaggcagaatctcaggtcctcccagacccgctgtctctacattcctcaggtactccgtgtgcaccctagagccagggatgcactggtctaggagttatctggctacattaagataaagaaaaaaattatgcaattaaattaaacagtttgtttttcaactataagaacaggcctttttgtcagctaccccaactattaaaaggaaaaaaaaacatgctacaaaggacgctacaaataaccctcagctatggagacattttcagaaacgctcagcattacccaaatgggatgtgcagaatgcttcctgaccaggcccgattcatcaagagtcaatgaaagccccgttcctacctgcaaatcgcagaggcgcatctttatccagcgcgatcagtggggggtcgaggagcacggtgttgtcgttctctgtgactatgccgtggtaggtgggctccagccagggcttgtgcttgttaactgtgtttaaaacaagagaaaaaaatagacaaggttagaaatattattttcaactccactacttttgaagacacacacctgctattaaaataataaaactctcattaggcttgaagacagtgctcacagttctgtcgcaaaatttggtatcaagacccaaatgagatgaaattctaaattccagaataagtaatgttgaaattatctgaatcca

SEQ ID NO: 51431 - DNA, 1058 bp, Homo sapiens
tggtgcacacacatagtcccagctacctgggaggctgagtgggaggatcacctgaacctgggaggttgaggctgcagtgagtcatgattacaccattgtgctccagcctgggtgacagagcaagactctgtctcaaaaaatcataaagaagtgaaaatacctttctttgtaacttttcagtgataggctgaaaacagagatagtcttcccgtagccatcagtctttttttttcccttgatttctagagcaatttatttcttatttctggttgcttcatggattcagataatttcaacattacttattctggaatttagaatttcatctcatttgggtcttgataccaaattttgcgacagaactgtgagcactgtcttcaagcctaatgagagttttattattttaatagcaggtgtgtgtcttcaaaagtagtggagttgaaaataatatttctaaccttgtctatttttttctcttgttttaaacacagttaacaagcacaagccctggctggagcccacctaccacggcatagtcacagagaacgacaacaccgtgctcctcgaccccccactgatcgcgctggataaagatgcgcctctgcgatttgcaggtaggaacggggctttcattgactcttgatgaatcgggcctggtcaggaagcattctgcacatcccatttgggtaatgctgagcgtttctgaaaatgtctccatagctgagggttatttgtagcgtcctttgtagcatgtttttttttccttttaatagttggggtagctgacaaaaaggcctgttcttatagttgaaaaacaaactgtttaatttaattgcataatttttttctttatcttaatgtagccagataactcctagaccagtgcatccctggctctagggtgcacacggagtacctgaggaatgtagagacagcgggtctgggaggacctgagattctgcctttctcacctgctcctaggtactgctggtgttgctggtcctcaagtggcatggagccggagaatcacagcgccaggggttccttgcattacctag

SEQ ID NO: 51432 - DNA, 1080 bp, Homo sapiens
tggaaaaggttaagttatggaaggttagattacagagggacttaatatgaaatcaaacccagaccataaagaccaaaaataaaagtgtctttgaaatccgtcttctccccccgtccataggctgctctgaaacaagagactggctaagaagagaataaggggccggatgcggtggctcacgcctgtaatcttagcactttgggaggccaaggcgggtggatcacctgaggtcaggagttcgagaccagcctggccaacatggtaaaaccccgtctgtactaaaaaaaaaaaattacaaaaattagccgggcgtggtggcaggcaactgtaataccagctactcaggaggctgaggcaggagaatcgcttgaacccaggaggcagaggttgcagtgtgccaagaccgtgccattgcactccagcctgggagagaagcgagagacttcgtctcaaaaaaaaaaaaaaagaagaagaagaagaagaaggctggctatggtacggcacctttctcctgcgagcctccctggagcagcagggggtctgccggcaggaggtatgtgtgaggctgtctgtgggagctttacgcacagactgcaccagcatcaggtctgaaacggctctctgagagaataacttgactttgcaatcaggttgaacactttatctaaccactgaaactcaacatcctctccagattatctttttaaaaaaatttttaggacgggtgcagtggctcatgcctgtaatcccagcaccttgggaggtcaaggcaggccaattacctaaggtgaggagctcaagaccagcctggccaacatagtgaaactccgtctctaccaaaaatacaaaaattagccaggcgtaatcccagctactcaggaggctgaggcaggagaatcgcttgaacccgggaggtggaggttgcagtgagccaagatcgcaccactccaacatggagaaaccatggagtttgactccagcctgggcgacaagagtgaaactctgtctcaaaaaacaaaaaaaaaagtttttttagttgagatgaagtcttgctatgttgcccacgctggtgtcaaactc

SEQ ID NO: 51433 - DNA, 1064 bp, Homo sapiens
acacatttcacagttttctagtttgttagaattttaagttgaatttttcctagtctaggtgcaaaccggcatttcatccaaccaattccttcctttgccattgtctctcatataatttctactctggactttagactttgagttgaaaggaactttgaaagttctttcctctatactttaaatagccttccctgtaaaacagacatttcctcatatgttcttgtgtgttgatcattcagcctctgtttgaactctgctgctgtggggctcttggtagctcacagagcaacccttttcttaaaaacattgagcctttggtcagctttcctgaggactaaattttatcacgcctttgtatttttgcaggcatccaagcctacagtctgttgtttttaccacctcacacattaagagagactgagagcactgaggcctaggccttgatttctgtagatttcttaggaaatctgagcctagcacagggctacacatgcagtgtttgggggacagccacccagacacatgcagagtcaatatcctggttccaggagcagggcttaacttaatgaaagggactggaaaaaacacgagaattttcaaactacaactagtttagaaaagtgacatttttctttttttttttttgagacaggatcttgctctgttgcccaggctggagtgcagtggcacaatcacagctcactgcagcctcaacctcccttggcttaaactatccttccacctcagcctcctgagtaggtgtgcacaccgccatgcctggctaattttaaaatttttgtagagacgggatcttcctatgttgcccaggctggtctcgaacttttgggctcaagcattctgccctttttggccctccaaagtgctgcgattataggcgtgagccaccatgtccagctgacatttcttcattcattacatttttgttatgctagttggctaaaaatgtgctttgttaaaaagtaaattattttttctagtcctttgattttatttaactattcctcaattacccaatcttcaaacatataaaatgcttagaaata

SEQ ID NO: 51434 - DNA, 1142 bp, Homo sapiens
ttccaagatcccgattctgtgttgctgcaccgcggacaccacgacttcgcccctttccgcctcctcccagagtccttcagacgttgtctgtttccagtggagccgaggctgaaacttagtgcttccctcccaccttttcacccaaaggtgaaatcgcgatgagatttgcgaccgcgggctcacccagtgttagaaatctccgtctctgctacccctggtgccttggtgctgtttttctgacggtcatttagaccgtggagggttagatgttctctacaaaaacgagaaacctctctggttttttaggattgtaggaccgaaattattttatggctcggtgggaagtagtatttcttggctaatttattattagcttttaaccttcatccacttaaccttttaaaccttgcatgcctctgctattgactggtcttgccaacgaaaagcttacgcattgcagatacagtatttgcttctgagtggatcttgaaatcgtaaacattttccttggccttagagcagagtaatctaggtgtagtctgtagaatctactgtaggcttaaatctgttgttctgatttttttttaatcaaaagaaattttggggaggaggattgatagaaatctagatgaaatggtcatatttgaatttagcaagctttttaaaaattcttattttcccttccctggcgtgacataaggagagaagtatggtgttcacgaattaaagggcagaggcggcaaatgcatcttttgttccatgttcctttctaaacatcgaggatgataaactttgaatacttcttttatttcatttctaacattctgttgactctgtcaaattcagatcttagtcactaagtatctcattgctggccatttgatttttaaaagtaacatcaagctaagtttgaaatgttctttccagatgtgggttggaggtctgaaactctaatatatccaagagaaatgtcaaaagttttgcttctcttggggaaaacccacacattttaaaaatatgtgcttggattgggtattttgggaacagtttaagtatatttagtcagtgataccatttcttgttaaaattggtgctttcttaaatagcacctacatttgttagtcattatttaattgccttgg

SEQ ID NO: 51435 - DNA, 1069 bp, Homo sapiens
agttcaagaccagcctggccaacatggcaacatcctgtctctattaaaaatacaaaaattagctgagcatggtggcaggtgccagtagtcccagctacccagctacttgggagattaaggcaggagaaccgcttgaatctgggaggcggagcttgcgatgagccaagatcacaccactttactccagcctgggcaacagagctagactctgtctcaaaaaataataataataataattgttaggggataggactatataagaaactttaactttccaagtcacacatttttgtaaaactaatattttaacattgtacatttgtttctttgtcataagggaaagttaaaaaaaatatttttaggagaactcttgcctagccgaacccacagttaagaataaaaatgagctctgccaagttgttgaggaaggtcagtgaccccacttagctgttgaccttgccctgaaactgctgagcagtaggagcaagctggcagctgtgaccaactgtgtgggccgtggagtccaggcccttctgggtgggtggtgtctgtccacagctacttctttctccggggaggggtcttctggagctgaagctggagccagggaagaccccagggaatcgttgcggaataggtggtgggagtcactccctgctgctggggcgccctgtggactgcccctacctccataaagatacctctaacctggctgccggggcctgagccacacagacctgagctgcaggaggttctgagaattctgtggactgggagtggagaggggaggggtcagccatgtctggaagagtttcataagcatatttattttctttgcgagcctaacgacaccacaaacaaacacaacaacaataacagcagaactgcaatcagcccagtcccatactgggcttacccatgtgagggcaggaccctgcatctgcctgtgccatgtgggcaaatggatctctgttaaaatctcacctgcccaccttctccatcgcagagccaatctcagctgatgctgcaggatcctgctgtcagaggctcagacactgcttaggtggaa

SEQ ID NO: 51436 - DNA, 1073 bp, Homo sapiens
gagccacggctgtagagggaatatgagggtaagcttggatctgaccgcctgcctcagtgcgtgggagggacagaaggagccctttctttttgcttcctgtccagcgtgcaggtcctggggaagctgtctccaggcaggtttgtgcctgtgctggagcactttggtgtgtgtggcatgcctgctggtggcctgcagagcttgctctgaacaggagccccttcatagaaaggaggatgccccagtggttccaggcgcctccctcccagcctggttgccgtgtcagtacctttcctgcagtaggtaggcggctcagctgggtgcagcattgcattctggccattgcggggctgtattgaatgaggtcaggtggatttgatttaaatgctcccagaaccttccgaaagggccttcatcagagagctctggacctggaacagcgtgcacggcactgctgtgaaggggacaggcgggctactctgatctcggagtgtgcatagggcaaactgttgagaattccagaatcactcccacggcagcagacctgtagccagagaggaaagggtcctcctgcatttgggcttcatggctgcccccactggaggagggctagctgtggctaacatggggtggtctgggatgcgatgcagatggcactgtgtgtagacagatgcagggcctctccccatcgccttacattaccatttcttaattttttttttttttgaggcagtcttgctctgtcacccaggctggagtgcagtggcgcgatctcggctcactgcagtctctgcctcctgggctcaagcgattctcctgcctcagcctcacacccagctaatttttggtattttttagtagagacggggtttcaccatgtttgccaggctggtcttgaactcctgacctcaggtgatccgcgcacctcagcctcccaaagtgctgggattacaggcatgagccaccgcgcccggccaccatgcccagcttttaaatttttttttttattttttgtagagatggggtttcaccttgttgcccaggctcaaactcctggcctcaagtgatactcccac

SEQ ID NO: 51437 - DNA, 1973 bp, Homo sapiens
ttcaaagaccaaggtcagggaggtctagcaagcagttcatgtgaaagcacacagtgttcctctctccctccagccagggctgggtagagagggcaaagggctggcagaggcagccactcacatttggagtgagaggagggtgccaggacagcgaggcatatccttgtgcgatgttattttcaccagcccttgtcatgtcactgtatgtggcactcccggtgctaatcagctggcccttcaagctgaggggcggggcagcagcatccagcatctgattaggaaggcaaggcctgcacagcgaggaggccaggtcactcagtgcacctggacatcttcaagtgtgattggagcccgcagtgacgctgtttcagctagaagattgtgacccacttccatatcctctcccacatggagagctggggaggaggctttgagagccagctccaattaaggtgtttttttcaggcccgagtagcacccaagtgtctaacccacatgttttctgctgctggaatcctgtggtcaatgtccttgacctgaaccgaataaccaccccagggcagatgaagttaccacccctgaagtcctagattccaccagcaaggcttcctgcaaagatcaggatcccttgtggatcaaacacctcacataatatgggccccacccctgttcttcctgatcaatcaccaagcaaaccttggaccagtttccaaggagatacttagccttgacctccctgcccagacaggcctcacagccacctgcctcaggcagccctggcttcccagagacccatcctgaccctgacttgcacccttgccaaatatcctaaatatccttctgctgcaggaatatgaaatgagacctgtttctgaacttctaggtttctgttattctttccaggtagatgacattttaatgcttctctgtaattttacatttcttttttgtgtgttggggaggggcctggggtatgatttaaatacgtgaagctgttagtactggtagcacttaagctggtgaagtggtgggtctgagcccctgaataatcccattttacttaccaagaagggagcaaaagtacctgccaaggtcagctctggctaggccctatgagcctgttcctgagcgtgtgctcacactcggcttctggactgaggcagaaggtccttctccctccgtgtgtgttaatactgttggcactgcccacagcctccaggggcacatagccttcctctggccgatcgctggagttgcaggaagatgaggtgctggtgattttttggaagacatggtggggcttacaggcaagcaagctggcccccagttctgctttcctgcacagagcagtcttccagagtttgtggtgggatgtaagggagctcgggcagccggagcagtgcagagacctggctccttcctccctcctgaggtctgctgctgctggcacaaggggtcacgtgtgcccgtttgccttgtgtttgctttgggtgctggcttcccactctcacttcctaatctctaaagaggagtggcctgttaggtccatgagtggtgacagtggagattgaagtgcttagcgtcaggcaccgcactgcactggcaagagcactcagatgaagggtgttctttcattctcatctgaccgcattccacttcatttaaaaacatcattcgcccaggctggagtgtggtgacacgatcacagctcaccgtgatcacagcctcaacctcccaggctcaagtgatcctcccatctcggcctcccaagtagttgggaccacaagcacatgccaccatgctgtgctaattttttgtatttttagtagagatggggtttcaccttgttagccaggatggtctcaatcttgtgatctgctcgcctcggccttccaaagtgctgggattacaagcgtgagccacagcacccggcctccacctcactcattttaatggcattctattgattgttt

SEQ ID NO: 51438 - DNA, 1061 bp, Homo sapiens
ggtggtgtttgagccaaagtgcttttgaacttcttttatgaaagggaactgagcaccaactactgttatactcagttattaaagacctattatgctctggtcttccatgaagccttgttaaaaagggaaagacaacagtccccagagggaagggtgtccttctgtgggggaatagctggacaaaaacattgttctccccttttgaagtttcttaaggattgagggtcatacctgtggctccatttttcatggttgtgttgtagtgtagaaacttctgtaaacaggtatgtgttctgtgcatcataacatgattgaggacccccaatggcagggccaagagggagttaaagggcttggtttctaatcttggttctgatgttttttataagccaggatcacagagacaccaagaagtggtggttgtcttccattactcctccctccctcccctccttccttctaatgactcattgattcaattaacaaatatttattaaggctttattacaatctggacaccatcataggtactaggaatatcgtggcaagcaggacaaaaatagttattccccagccgggcgtggtggctcacgcctgtaatcccagcactttgggaggccaaggcaggcggatcacgaggtcaggagattgagaccatcttggctaacatggtgaaaccccgtctttactaaaaatacaaaaaattagcctggcgtggtggtacgcacctgtagtcccagctactcgggaggctgaggcaggagaattgcttgaacgctggaggcggaggttgcagtgagctgagattgcaccattgcactccagcctgggcaatagagtgagactctgtctcaaaaaaaaagaaaaaaaaaaaagttcttccccataccaagctcttagtctaggaccaaaaggcttattatatagttgggatcgtgtgaatgaagaaagaatgatttgatgagagtgctttgaactcttaggaggagagtcaggacatgatctccagatgcacactggccccagtggctacctgccctgagtggacattaaggtggggg

SEQ ID NO: 51439 - DNA, 1069 bp, Homo sapiens
tgggagtccctactgtgggaaaaagcctacaattctgttactcctgtcttttcctttcctggaggtgaggtaaattactttttctgttatatttccttctcttaaaagttgtgctaaaaagatcttataatagcccaagacatcctaatgaaagaatgtgattgagttggtgggaatgtatgtgttatagtatagtctgtctcagtagggtgtcattagcagcagaaatggaaggcaaattaaaactagttcctttatccttttcagaccctgcagcccctttagcatgctgcttctatatgtttcctactctgaaaagaaattaaatgggaattgcctactcaaagctgttttaaaatgtcctaagtgtcacctggatgcttgtttgaggcctgcctgcatcctcctctgtgagcctgccttcctctctttcctaagaacgtgcttctgcatattagtgaaataagtgcctctttctgttctgtctatagttagccaccaattaataagatgagcagaaatgctcccatgctgagcactgtgctaggggcagggaagaagctgacactactttatgaggcaagctatgtaagcgcctttttatctcctaggagaggccctcaataggttcggtctaccccctggagcctgtagctatttcaggctactcattaaagtcaatctaggatattgccaaagcctttgaattctttaagtgaattgcctccacttgaagtcagctaaaaatagttcactttcgctccccaggacggcccccaagttacatgaactacctgctagactcacaccccagcaaaaatattgatgtccccagcaagattagcttcctgttaaagatccaggacctgtgaatacatgcgtaactgcaagaatggaagcaaaggatgaacccaagttaaagcccagcacaagaatatgatgtaagcgcttttgggaaatgcagagattttcttttctcttcaaataataaattacatctaaaaattaatgagagtataggccgggtgtggtggcttaatgcctgtaatcccagcactttcggagtctg

SEQ ID NO: 51440 - DNA, 1050 bp, Homo sapiens
gctgggcatggtggcacgtgcctgtaatcccagctactagggaggctgaggcaaggataattgcttgaacccaggaggtggaagttgcagtgagccgagatcgcaccactgcactccagcctgggcgacaagagcgaaactccatctcaaaaaaataaataaataaataaattaaattttacatattatatttcatagctagaataaggatttataactaataagtccccctttgtagctggattgtttgtgcagagggaaggaaattgggatggcaatgggaacgtgtaggggttaatacactgataatggaggctaattatattttctgttttaatatctatatgatagattttttcccactttaccaggaattgcaactgcacttgaaataatctttttgtttattatgtgtcttttttcttaggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactccca

SEQ ID NO: 51441 - DNA, 1832 bp, Homo sapiens
tcggcctcccaaagtgctgggattacaggcctgagccaccggcgcctggccgcagctgcatatttttaattgcactagggactgggtgtggtggcttatgcctataatcccacctctttggtagtccaagatgggagggtcactttaggccagatgttccgagaccagcctgggcaacatagtgagactctgtctctacaaaaaataaaacttaaaaaaattgcactggtatgttaatttcatatggtatgtgggtttattgtttcacatagagattaaaatggcttccagaggaaagacagagacaagcaaattaaagcagaatttagaagaacagttggatagactcatgcaacaattacaagatctggaggaatgcaggtaagagtttaattgtatgttgttatgctggaaactggcgttttttctgcagctagctccgtggatgcaggcccatgtgtgatgattctgcattcccctgtagtgttctttgcagtgctttgtctattagagaagtaaacttattgcaggctttggagtcataaaggctgggaaatgaaagtcattcagttaactactaagtgcatgtgaacttgagcaaaatacttaccttccttgaagtagaaataacacctactttgtctttagtatttaaatcagtcctacctgctgtcaggctaagaaggtactacttgaacttctggcatgtagtttcagccttacctgcacaaaggaccacaacagttcattgcagcttttttttttttttttgagacagagtcttgctgtattgcccaggctggagtgcagtggcgagatctcagcccactgcaacttctgcttcccaagttcaagcgattctcctgcctcagcctcccgagtagctgggattacaggcatgcaccaccatgcccggctaattttgtatttttagtagagacggggttttaccatgttggctaggctggcctcgaactcctgacctcaggtgatctgcccatctcagccttccaaagtgctgggattacaggtgtgagctacggcaccctgctttattatgtggtttcttaagtatcctcattttggtaaaagaaaaatgtttaccaaagtaactatattgcaggaaaatgccctcactactactatgtgaacacattcaccatcagcattttgatatttcccttcagtctttctctaatgtacaagtattaagattgcatttttcacttggaactcttcatttttccatatcatgatgttcacctatttcagagaggaacttgatacagatgaatatgaagaaaccaaaaaggaaactctggagcaactaagtgaatttaatgattcactaaagaaaattatgtctggaaatatgactttggtagatgaactaagtggaatgcagctggtaagtataacatataggcgacagaggacagactttgtttttttgtttgttcttgtttttgtttgagatgcattcttactctgtcgcccaggctggagtgcagtggggcagtcttggctcactgcaacctccgcctcccaggttcaagcgattctccttactcagcctcctgaggagctgggattacaggcatgtgccaccatacccagctaattttgtatttttagtagagacggggtttctccatgttggtcaggctggtcttgaactcccaacctcaggtatctgtctgcctcggcctcccaaagtgctgggattacaagcgtgagccactgtgcctggcctttagttttttttttttagagatggggtcttgctacatttccaaggctggtctcaaactcatgggctcaagcaatcctcc

SEQ ID NO: 51442 - DNA, 1095 bp, Homo sapiens
ttaccgcgccctcactgtccgccggcccgagtgctaccggagatcaccagcggcccggacgccagcgagtggaacatctcggtcgcactctcattggttccagggggccggaagtgcgtgcgtccagcggaagtgctcccccggcgcggtccgccaggccagtgccctcaggtaggcggggcccctggccctaaactctgggactggcgggcggtcaggcggcacagggggaatcccgggggcctaaggaggttgtcccagtttttgtcaggtaggcccggaaggagtttcggggaccatgggtttacggctacctctggtggcaattggggcctgttggagcccggccgccgcgggacctacgtgccggacttcaagttcccgcgtggggtgggatttgctgcggtggccggagctgattcttcacccagtcctgttggttctgggccaaaccctcctcactttcaaggaagaggcgtgctctccgcccttaccttttccaagcctctgggtttgacgccatccctcaaggcgtgtccggatgcgggattttcctcaaagaccctctcggcctcgctaggaagaaactcagaaaggctgcggtaggcgcagtcgagggggaaagtgcccccgcccttgatgtctcaggctgctcaagtggaagttatctggactgccttagggcaagtttatatatagcaaataaaattacttgttaatggtttccttttttccagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacaggtgagcatgaatgaggaccctccgctccagatatagtgtctgagagcggtttctgtagtttcgtaaaagtgaaaagtgcaccacatttagtgactactaggtggtgccaacgagttaatctttcggggataaatctcaactaatgtagtaccaggttaaggcttttaaaatgcacccatttttactgaaatgtattcag

SEQ ID NO: 51443 - DNA, 1092 bp, Homo sapiens
gatttatccccgaaagattaactcgttggcaccacctagtagtcactaaatgtggtgcacttttcacttttacgaaactacagaaaccgctctcagacactatatctggagcggagggtcctcattcatgctcacctgtctcttagtactctgatctctgcacagtgccgaccggtctcaaattgcacaaacctccagttcttgacgttccgagtgtcataaacttgaggaaaatgaaattattcatcaggactacaaaaggctcaaagttcaaaccacctcggggtggagatgctggaaaaaaggaaaccattaacaagtaattttatttgctatatataaacttgccctaaggcagtccagataacttccacttgagcagcctgagacatcaagggcgggggcactttccccctcgactgcgcctaccgcagcctttctgagtttcttcctagcgaggccgagagggtctttgaggaaaatcccgcatccggacacgccttgagggatggcgtcaaacccagaggcttggaaaaggtaagggcggagagcacgcctcttccttgaaagtgaggagggtttggcccagaaccaacaggactgggtgaagaatcagctccggccaccgcagcaaatcccaccccacgcgggaacttgaagtccggcacgtaggtcccgcggcggccgggctccaacaggccccaattgccaccagaggtagccgtaaacccatggtccccgaaactccttccgggcctacctgacaaaaactgggacaacctccttaggcccccgggattccccctgtgccgcctgaccgcccgccagtcccagagtttagggccaggggccccgcctacctgagggcactggcctggcggaccgcgccgggggagcacttccgctggacgcacgcacttccggccccctggaaccaatgagagtgcgaccgagatgttccactcgctggcgtccgggccgctggtgatctccggtagcactcgggccggcggacagtgagggcgcggtaagctccccgcaaggagcccctgagaaactggtcgctttttgtcctagatataggggagtcca

SEQ ID NO: 51444 - DNA, 1051 bp, Homo sapiens
tagtagagacagggtttcaccgtgttagccaggatggtcttgatctcctgacctcgtgatccacccgcctcgaactcccaaagtgctgggattacaggagtgagccaccgcgcctggcctaattttttaattttttgtagaaactgggtcccactgttttgcccatgttggtgttgagctcctgggctcaagtgattctcctgccttggtctcccaaaacactgggataacaggtgtgagccaccacacctggcctcgatttttttgttacataaatgatcatataatatgctgataggtagatggatggatggatgctaaagctcactatttgcctatgacattgagaaatgggcttttgcatacatctaggtggacaatacaaattaaggctttttacaaagtaatttggcaatatcaatagaaatttaactgtataggggaatgaggtgaagtacagagtgtcagttggggaagatgagaaaattctggagatagataggagcgatggttgcacaacagcatgtttgcagttaatatcatagaactgtacgcttgggtatattttaccataatttcagtcagttaattgatcagctaataagctggaatccctaaagaaagagaatctgtgattataaaacaatattggccaggtgtggtgactcatgcctgtagtcccagcactttgggaggctgaggcaggcagatcacttgaggtcaggagttggagaccagcttggctaacatggtaaaaaccccatctctactaaaaatacaaaaattaaccagcatggtggcatgcgcccgtaatcccagctactcaggagtctgactcaggagaattgcttcaacccaggaggcggaggttgcagtgagccgagatcactccagtgcggcctggggaacagagcaagactctgtctcaaaaaacaaaacaaaacaaataatattgatcgtaatatttcctgtgcataaagtctaatttgttatacctagtgtgaaacctaactttttatctaggaaggtacacagttgtcaaaggcatcat

SEQ ID NO: 51445 - DNA, 2556 bp, Homo sapiens
tcgtccctccccttgccagcctacctggctcaggcccgccgcgcccgcagccccagcgcggtcgccgtggcaacgccccgcccagccgccagcctccctttgcccctccccacgtccggcgcggctgcgcgggacggggtgggacggaggcggggagaggacgcaggcgagaggaactcggcggcgcggcgcccgcggcctattggctgccacgtcccggcgccagaagccccgcctccctgacgggggtcacgtgatccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgaggtgaggaggttgggggacaccttgagggattagttggcaactcgttagcgctttggacagggatggtattgcgccagtgctgtctggcctttgggcttggagaaggaacggagatgatattttccaagaataacgtgactccccgatagggtctctggttttgttctcctttattctgttgccttctttcttcattctgaactccatttgcttctttccgagtgttcttttagggtatgaacaagaggagagagcatcttgaggtgtttattcttttcttcagggtatgcgaacaagaagggcgagatttacatgaagttaaagtgtgtgtgtgtctgtgtcttcaggaatttaaagaacaattttggatggaatgagaatgtatggtgggtgaatatttttaaagaaagcatttgaaattccagatatgtgtggttattgcactgtataagcttgattaaacatatatttttgcttgaggggtggtttacagacagattctttgatatttaacaaaatatgtatcttctccacagtttagagaattccagttatattctggtacttaatagaccactaatgacttctggcattcttctgttacattctatcttttcctacttcttgaatctttcaaacttgtgttttgctgtagcagagactgaacgggaagcaagtggaagcaaatgactttctaaactctctcctgttctcatttcttaaaggagttatacagatctacttcttgatgttttaaagattgtttaataaattaggttgttgtaaaaaaaaaaacaaccaaaaagcagtggcaattagggtacaaggaatttcctatgattctactgccttttctcttcctttttgcaaattaggagcttccctttcaggacccctactggccataccctctttagcctacctccacatttcttcactggttcatcatgtaaacttccctacagtattaggaaagcagtcatccatcaagttgattgtactacaagacttccatgctccagttttagctacagagtacttagtgtgtttacttagggactgaaattctcctgggataggacacgcagtggtgtgttaagggtcaggtaggaaaggaagcaaatgattttgttgattgtgatacttggatacttggtttggaaaatcaggactgcccattcggcgttactttgtttttttcgaatacagcagaaatgtaatcttaagtgaagagaatattacacagtttctttcattcggtaggaaatctccttagaatcgctttattttatgtgggtttttttttgtttgtttgtttttttgagacggagtcttgctctgtcgcccaggctgcagtgcagtggcgcgatctcgtctcactgcaagctccgcctcccgggttcacaccattctcctgcctcagccccctgagtagctgggactacaggcgcccgctaccacgcccggctattttttgtatttttagtagagatggggtttcaccatgttggccaggatggtctccatctcttgacctcgtgatgcacccgcctcagcctcc

SEQ ID NO: 51446 - DNA, 1028 bp, Homo sapiens
taggaggccggggctggtatggcagctctgcgctcattaggagcccaggtgccttctgtcttgtacctactttcctaccatatggcttccatcttttggcccttgtatgtctgcattctggccagagaggggaggggaggtcatgtgcctcttcatggcacagcttgaaagttgcacagatcactcctgtttacctctcactggctggaacccaagtcacatggccacagctacttgctgggaaggctgagaaatagtttttcttgggcagccatgtgttcagctatacgttctctcacatcagaaagggagagcagtctatgcctttctttccaaacccttctcccgagggagacaaccccggatcaacttcagagtccagaatccctgggtgatgtacattccaggaatctttagtttaaaacaaagttatcaggggctctgctgtcccccatacagtggtggagaggttaggataatggaagtagaaagtcctgtttggaaaagggaagaatggggagtaatactctgcgctggtccatagccattgtcagctcctgccaggctgagctgtgagcgcttcctcccctggcagtactgtgaggttctgacctcgcctttctggcaaccttgattctggtctcttgaaggagctcccttgtgcctggccctctgtagcctctgactttattttctggagagtttttctgtgtttcttttcctctggggtcagatctgaagtggacattggaggctatcctttttgtagggctaaacagtttctccagcttgcttcttgtggatattgaaggagtaggctttttcaaccctacttagccccaaattaccagactctgaaaactttgattgtagaccgcggacattcctcaggcagactgtattccctttcatctttgcatgcgaattggcaagctttggcttgagtctgcttcatgtttgcaggacttcttagccagtaagcaccaaattttgtattgttcgaccagttcccctagaattacaggcca

SEQ ID NO: 51447 - DNA, 1065 bp, Homo sapiens
ttagtgcttttgtacacactcgtattatttagataaagcagaaccctacacaaaggggaaactgagcctaagaggaagattaaaagagcaaagggatggagaaaactgctaggctgaaattatttttttaaaaaagactatttactgtgtgtcaagtaaacacttttcatttgttcagcaaatatttaccgagtgctctctgggagttaggtactgtcatagttgctgggaatacagcggtgaataaactagaccaaatccctgctctcttggagcttgtattgtactgggtggggataaactataagctgataaatacatactaattctagttgtttgttatattacctttatttctgatgactattttataagataagaaatattttgtcactttcttataaatggggaaatcgaggctcagagagataacccagctggaaacaggtgcagctgggatcctggccagcgctagctacgcgattgctcattgtgtagagggcttgagaagatggggcctggggtagcacttcactcacccattgcacatggtctggtctctgtttcactttcaggtggactgcttcattcatttattcatgagacaaggcctcactctgccacccaggctggagtgcagtggcacattcatggctcactgcagcctcagcctccccagcccacctcagcctcctgagtagctgggactacaggcatgtgccaccacacctggctcatttttgtatttttttttttctgtagagatggggttttgccacactgatcttgaattcctgggctctggtgattggcccgcctcagccttccaaaatgctgggattacaggtgtgagccaccacacctggccccttattattctaatttgaagtaataatattaatattttaagtattatgggtgacttaagaaaacactttaattaggcagttttatgcctttggtccttagttctcaccagctggcagaatggggttaggcgtgtttaacgttcttcatgttatcaattagatgcaaaaaacacaattaacaatttttgttacagtt

SEQ ID NO: 51448 - DNA, 1033 bp, Homo sapiens
cagtgagctatgattgaaatactgcactccagcttgggtgacagagagactctctctaaaatgaagtgtaatatgcttaccgtaaattcgccatgtcagccaaggaggtgtgataaacagagatggtaagggaactaacatacagtatatacgtatttatgtatgtatttatgtatgtatgaattagaggtgggttgtcactgctttgctcaggctggtcttgaactcctaggctcaagcgattacccccacctcaccctcccaagtagctgagactataggcaggcaccgctgaacctggccaaaatacagttgttaaaaactcaagtgatagagcttgtaggaatactggtagagcgagttattctctcagaagagtacttttgctgaaggcatattgagttgttaaactctggtttggttatgaataatgtcattctctggcagaattgtgtttctgctgattagttatagaatgcccttttcccctcatgttgtagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtaagcccaagcttcatacctgggactcttttgtaattcttcttagctttttgttaagctgatggttgtgatgtttccagaacagattaaaatgaagcagacatcagctctttaaaatcctccaagcagtagtttaaatatcattgcaatgtgttgtgttatcgcttttttttttattgcaatctgttaaaccaattgcttttctttccataacttccatctttttttttttcaaacaggtttaggtattatctctgatgacaagatgattaagactgaatttggttctgctgattttatgaatttggttgatggttttaagataaaataatctgaaaatgcaaga

SEQ ID NO: 51449 - DNA, 1208 bp, Homo sapiens
tgcccaggctggagtgcaatggtgcgatctcggcttaccgcaacctctgtgtcctgagttcaagtgattctgctgcatcagcctgccgagtagctgggattacaggcatgtgccaccacgcctgactaattttatatttttagtagagatggggtttctccatgttggtcaggctgatctcgaactcctgacctcaggtgatccacctgccttggcctcccaaagtgctgggattacaggcgtgagccactgcactcggccaatgatatacttttaaaaagtaagcccaagaaaatgacaacttaggaaaaatatttccaacatgtataagagacaaattgtttagatcctaatttatgaagaactcttaaaaattaataagaaaaaagatggaccattatcattttcctttcctgattaactgatattttaaaacattttctcacccagcagctacagtgacattgtgcggatttataaaaggtaaaaggcttgtttgtcttttgtactttaagcatgtcccaggtggatgtggattcaggaattgaaaacatggaggttgatgaaaatgatcgaagagaaaagcggagcctcagtgataaggttggtaagcgatgaagcccttggtacaggtaatagaaataaacacatttcatgtcttgtatctgtagagtctgttagattggggccacccgaaatcaggaagtcctaggcaggtgattatttttattcttttgaggaaaaatgaataacctagattacccttattcatgaaagtgtaactcagtcctttgatctgataatatccatctgtttttggttcagggccatgattttatcagtaaatttaggttgtaataggaactaatttagagcaaattagaattctttctgttggtcttttgcttttttttttttttttttttttttttttgagacagagtctcgctctgtcgcccaggctggagtgcagtggtgcgatctcggctcactgcaagctccgcctcccaggttcacaccattctcctgcctcagcttcccaagtagctgggactacaggcgcccgccaccacgcccagctaattttttgtatttttagtagagatgggttttcaccgtgttagccaggatggtcttgatctattgaccttatgatccacctgccttggcttcccaaagtgtgggattacaggcgtgagccactgcgc

SEQ ID NO: 51450 - DNA, 2008 bp, Homo sapiens
ataaatcttaagattctctgtcttacacatgtaagtggcaaatctgtcttacacatgtaagtggcaattttaaataaccaaatcagataaaatttccatgagttaaaacttttgttaaaacaagtgtcttacacatgttaagtggcaactctgtcttacacatgtaagtggcaattttaaataaccaaatcagataaaatttccatgagttaaaacttttgtttagtggtatttaaaatgtatctaaagaccaacagtaaatcaactgggagctgcaaagaataagaaggaagctagaatgtagcatttgctcctgaaagccacatggtgactagatgttggacccttcataaaatcttttgaaccttggacttaatagttttattactatctataaaacatatctagactaagaaatattaacccagttgcatttgtagtataataaagtaacctctatagttgggagtagcttctttttacaattaatatacatcagcggtaactctcaatgactgtaccccaactttctttttaataaacttttaattttggaatagtttcagttagtgcagggagttcctatatatactttacccagtttcccctgacgttaatatcttatataaccatggtacatttgtcaaaactaagaaattactactaactaaacacaaggctttatttaggttttccactaatatccttttaccattccagaatctaatccaggatactgcatcgaaccatttggggtcagctggcttattcaagggctgtgtaacctgtgttcgaactgtgtgtaacctgttctttgttctgcctttccaacagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctaggtcagtgtggttctctttgcacatcttactggtagtaaaataactgtgaactacgtaggagaagggaatgtttgttgacagtgttaatcagtgtcatacagggtatggcatatatcatatttggggaggtggatttagtcattggaagtggaattctcttttctagattattattttttggctctctatggttaagatattgctagatgaaattttagaagcagttggctgtgtatactacatcattcttcgaatggggactttatcgtcttgtaagtatagcctctagatcaatagggcaattagattataattatttagatgtttatctgctagatatacttgaactgaaatgattctcctttaaaagcttgatattttctgttttagttagttatctcaagtttttctttgatttttctcttctttcctccctttctcaactaatttagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctaggtatttatcccacaggagagttgcatgtgtgtttgcggtgcagggaaaggagattaacacggtttggaagaagtgctgtgtgacactgactctgttaaattgttgt

SEQ ID NO: 51451 - DNA, 1037 bp, Homo sapiens
gagcaagagaatataatagcaccttctttctaatcctctgactcattgtcttacaattttgctcttaaattgaagtttcctgtggactgagttggtgtttgtgcccagcactgttcaaaaataactccaggctataaatagagactgcagtaggagttaggtacacttcattcaattcgatggtgttcagaagaatcattagagaatacgtaaagagacagaggaatgttgatgcaaggttgaatattgattcaggaaggttgatatttgtattacgctgaacattttatcaccatttctcaagtaaatttcccaaaggtgaaagtgtctttttcacgtagataaaatcctattgcatgattatagtaataaagcaggcatccttcctaggaaccagtttccacatggtaaaagtgctgtgttacctgttttactgtaaattttctgtgggagaaattctctctccctggcctatttagttgtgactttctctaacaaccgtatcagattgtgtgctgcttttactaatacctctctttctggacttctaacaccccagccttgcctcagatctaaattctctccctactaggaggaataaaatgtaccaagtgtataaaaatagctgcaaatactcatggagcattgtgcgccagatgtggtgtcagctctgtccatgtatcagcccctttactcctcgctgtagcctgctgtgaggaagtggcagggggaacgggggggccggggggacagacaagagggtcaaaatcatagaaatgcattcagacttgagcatcctgaatccagactcatgttcaccaccgcaccgtgctgccacccacttttccatttctgcccaaataggtcttgtttgttcttgttccttactactgtttttgctgccgagagtctgtgcatctactcggttcctttggcagggaagtgccagcatttcactccttaattacaaaatgccatcccagtcagttgatatgtcccttgttggccgttacagtgaactgtgatcatccagattt

SEQ ID NO: 51452 - DNA, 1048 bp, Homo sapiens
agtcacaaagatgagggctattttgtcagtcccttataacttttcccccaaagagtttgattacagcagtagcatagtctggctttaacctacagccctctgagtgatgccattctttttggttaaagtacctgtgatgtcccttccaatgcttaacacttggtaccagttcttagtgcttctggttttctaagttgccacctgcagtaagaagcagcccttcttaggtccctgaaatgttaccaaaagttactattgttggctttggagcaggtgaaacaagcagtcagggtggatcttggccgcatgggtgtttgtgctttgttatgtgtacagggatcctaacaggctttctgctgcagaaatgcaaactctgccaaaaataatcaagagataagaatcagaatttcttcttgtcttctctgaagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaaggtaatatgaaatggattaacttaaaaaaaaaaaagcctagttatttgtttgattatccccacccctggagcattcattgatttattcaatcagtaaagcaattattgagcatttgccatgtgccaggcacaatactaggaacttaggatgtgtcgatgaacaaaacagagatccctgccctcgtggaactcacattctaatagagacagagccaaggtttgaacctagatggcctggcttcagagtcctctcttgaccacactgtagctcggtaccgccagtgactcatatggccctgataattctactgctttgttataataaccaacattatagagcctctgtagattgccaaggactgtgccaggtcgacattagcttgtatcctcagttgctctgttagtgcagtggaacccggtataacataggcattcttttttcaacgtatgactaagcaaatgactctcagagagattaa

SEQ ID NO: 51453 - DNA, 1061 bp, Homo sapiens
agggaaaccacaaaagctgctatgtagacggaccaaaacagaagggggcagccaggaacagacccaagggggcagccaggaacagacccaagaaggcagctgcaagggcgtgagtgcttcggtccgggtgagacaggccagtggctgcagctgctttgccagaggagaaaagggcatccttccttgactagtaataaataatgaatgaatgatgtgatgtgtatactcagaagcaaaaatcatgtagagagaagagcacagatcttgtgatttctgatcgtggttccaccgtttactaactgcgggaccttagacagtgactcctctgtgcctccatttcctcatctgctaagctgcggtactactggtactgggtttattatatataaagctgttagagtggtgcctggtacacagtgatcactcaaccaatattaactatcattcttatcattgttgtattattatttttttcttaacagaggtaatcaagttacattgttatattgctaatgcaggagcatgctgatgctgtcacctagagaaacaatgtcacatgataagaagtggagcaacttgttttgatgctcttgagggaaataaagaggagaaagaggccgggcatggtggctcacgcctgtaatctcagcactttgggaggccgaggtgggaggatcacttgagcccaggcatttgagaccagccctggcgacataatgagaccccatctctacaaaatatacaaaagtcatctgggcatggtggctggtgcatgcctatagtttcagctacttgggaggctgaggcaagaggatcacttgagccagggaggtcgagaccagcctgggcaacatagggagaccctgtctctacaaaaaaaataaaaaattagccagtatagtggcatagacctgtagacccagttattcaggaggctgaagtgggaggatcacttaagcccgggaggttgaggctgcagtgagctatgtttgcaccactgcactacagcctgggcaacagagtaaaaccctgtctcaaaaaaaaaaaagaaagaaagaaag

SEQ ID NO: 51454 - DNA, 1040 bp, Homo sapiens
catggtgaaaccccatctctactaaaaatacaaaaattagcgggtgtggtggcacgcacctgtaatcccagctactcaggaggctgaggcaggagaattgtgtgaacccaggaggctgagcttgcagtgagccatgatcacggcactgcactccagcctgggcaacagagtgagactctgtctcaaaaaaaaaaaaaaaacagatacaaattgaaaaaaaaaatcaagttatcataatatatctataaaaaagccaaaaccaaagtgataaaatagaatgtaagtttttgaagaagtaggtgatatttaatcaatttatttaacctatctgaagtgaattctggtgattcatagcaaaaaatataatactgttgttctcaataattctacttttcaggttatattcccaaagttggaggaaaaaggaataattttgtttacataaatcctcccagtagtaacattatttataatagaaaaaaattagaaaaaagaaatatgcagggaaacggctctggaatcagtagtttattaacataatttaataccatttcgagatttaaatatttctgtattgtgttgaaaaatggagattttatacaatacatcagtaaggaacatcaccaaagattgttgatgggctgggaatggtggctcacatccataatcccagcacttttggaagctgaggtgggaggagagcttgagcccaggagttcaagaccagcctgggcaaaataaggaaaccccatgtctacaaagaaaaaaattagcccagcatggtggcacatgcctgtgttcccagccacccaggagactgaggcaggaggattgcctgagcccaggaaattgaggctgcagtgatctgtgatcttaccactgcactgcactgcagcctaggtgacactaggtgacagagtaagaccctcttaaaaaaaaaaaaaaaaaaagattgtgatggacatctgtatgcacatttaacgaggtaggacagaatacggtggtccttgaatggagctaacaggaattctcttcttctt

SEQ ID NO: 51455 - DNA, 1023 bp, Homo sapiens
caaggggcccttatctggggtctgtgcacccccctaagcagtccacagatgtgtttcaaggggatctataaactgcttaaattgccaggcatggtggctcacaccagtaatcccagcactttgagaggccgaggcaggcagatcacctgaggtcaggagttcgagaccagcctggccaacatggtgaaaccccgtctctactaaaaatacaaaaattaactgggtgtggtggcacacgactgaaatctctgccattcgggagactgaggcaggagaattgcttgaacctggtaggcagaggttgcagtgagccaagatcgcgccactgcacttcagcctgggcaacagagcaagactctgtctcaaaataaataaataagaaacataaaaactgcttaaatgtatacatcagtgtgtgcatgcatgtgtgtgtaattctgtcaacaggcctctaggtaggaattccatccttagtggccagcattttgcccgagggcagctcgtaagaggcgacactggaattcagacactgattgtttggctttttcccactaaccaccctgacacccaaagggcctccctgtcgccaccctctcctcatcaggttatttacttgtgactgttggaactcaacattttgagctttaactgtgtgctagacctggtggtactcggtggtttgcttgccacgcctttgtttttctcaggaaaaaggtcttgagacacaaccagcatcttatagctagttaggagatgaagctctagaagctctggaacccaaatttcccatctcctggccccagtccctgcccagtccccctgtagggacttagctactgactgatctttgggtggggacatccctgcttccacagaaactggtacggtgcaaggcctgtgctgatgctggcctacttgacgagagcttcctgagaagatgtctgaatttttatggccttctcattcagctgctgctccgcatcctggaccccgcatatcccgagtgagtgtgcttcttcctgt

SEQ ID NO: 51456 - DNA, 1456 bp, Homo sapiens
ccaacatggtgaaaccccatctctattaaaaatacaaaacattaactgggtgtggtggcgcacgtctgttatcctagctacttgggaagctgaggcaggagaatcacttgaacccgggaggcagaatttgcagtgagccgagattgtgccagtgctctccagcctgggtgacagagcgagactccgtctcaaaaaaaaaaaaaaaaaggaaaagaaaagatcctataaatatgctgagatgatgggttaagtgtttttttggtgttttctacgatgacagtgttaaatgaagttgtcagaatgagtgaaatgaaatcttagttcctgaatgttggaaggactttagattttgcaacaattaggtcagagttgtcatttaaagtatcattctttgtggtaaggccctaaaccttaattaaagacttttcatatacctacctgaaatctgagtgactgcttaaacctggacattagtaattccatctaaattatctgtcagtgcctaaaaacaaaagggagatgaagatgctgaactcttgaattattcttcaaaaattttatcccatctaagggccgggcgtggtggctcatgcctgtaatcccagcactttgggaggccgagcagggcggatcaggaggtcaggagatcgagaccatcctggctaacatggtgaaaccccgtctctactaaaaataccaaaaaattagccaggcatggtggtgggcgcggtggcgggcgcctgtagtcccagctactcaggaggctgaggcaggagaatggcgtgaacctgggaggcggagcttgcagtgagccgagatggtgccactgcactccagcctgggcgacagagtgagactccgtctcaaataaataaataaataaataaaaattttatcccacctacttggatcttttgcaacccatgttagatctttgatcaaatctagctatacttgttaaccgaattactagtcaataatatacaaattaccagtggaataactatttgccagatagatttctgtgaagcaaactttttaactttttgtttccataaactgctcttatggtcagaattgtgttccagctaaagcctggcacgaggcaggcccatggcttggtctgaatggtgctgattggagcgcttgtcctgaacttgccatgttcctgagatcgaggcctcctgcacttgttcacaggaacttctcttctccagcatgggcttaccaccccgtagttgcacagttgtagaccctgaagtgtagcttctttttttctctacgaatctggcatctccagagtctaacagaggtaggccaagctatttcagttcaccagcaagttctcattataacacgatctgcagaacagttccttagattggaggcttccagttttaaagtaagttaatatcccactttatcaatattacaggttccaatttttcttccatgc

SEQ ID NO: 51457 - DNA, 1046 bp, Homo sapiens
cacgggcagagctgctttggggctgcatttgtgggtctgatgatatgcgatctgacatgctgggattttccttccatgaaatcatattgcaggattggaataggaaaattcttaaataccttatctgaagctaagaaatgggttgagaagtctttgaaaatgtacactgaaaactttctctgcctttttaattttaaagggcttttttggagatgagcttttattgtctgaatatattaatattcatgaacataattaggaaagaaatctctagaattatgtctgctggacaagaatttgatttgttcctatgggcttctctaggcaactgtgtgaatcactcaggatcctggcggggtgttttttccctttcagttgatcttgggttttatattcagttattaatagaaaagaggcctggcttgccaggttccatggaaagcacgtgccgtgccagtaccagtgctctttcctgacgtgcgtagcagccactgagatacttccttggtcgcttatgaggcccttgacagttgctggtgacttcttagattggcttaggtttattgattctgttcttggaattgtcaggctcagaatcagaactgatttccataaggggttctcatgtcaaagtggggactgctttttcttcactttttcttttttttttttttttgagacggagtttcactcttgtcgcccacgcaggagtacagtggtgcgatctcttctcactgcaatccccgcttctccggttgaagcgattttcgtgcctcagccttctgaatagctgggattacaggcgcctgccaccacacctggctagtttttgtattttgtttgtttgtttttgagacggagtcttgctctttcacccatgctggagtgcagtggcacgatctcagctcactgcaatctttgcctcctgggtacaagtgattctcctgcctcagcctcccaagtagttgggactacaggcacctgccactacgcctggcttattttttgtatttttagtagagatggggtttcaccgtgttagccag

SEQ ID NO: 51458 - DNA, 1061 bp, Homo sapiens
gtgacaggtgcctgtaatcccagctatttggaaggctgaggtgggagaatcacttgaacccaggaggcagaggttgcagtgagctgataccatgccactacatttcacatttcagcctgggcaacagagcgagactccgtctcaaaaaagaaaaaaaaaaagaaagaaagagtcttgctctgtcacccaggctggagtgcaatgacagatcttagctcactacagcctacaacctcctggcctcaagcagtcctcccacctcagcctcccaaaatgctgggattatagttgtgagccaccatggctggccagcgtatattttagatgttggaatgcaggtctatagcacattctcgtattcatagtcagtacttaatagcatttgtttatgagccaactgaacaaataatattgatttttcctgtgttaatggatgaaaaaggcccaaataattcccacaattgctatttcagaaataatttttatttggctttgaagtcactttctacctcccactgccctggctgttcctgctcatctccctgacgtctgagcttggtgagctccagcactcagcccttaggcttcaatttctttcccactcatgctctctaggttagtgtttctcaacgagggcactagttggaattttgagcctagtggaatttggtataataataactcatgatgagaaaccatcccatatattgcaggacatttaggatctctgtttcctgccatttaatgtcagggatgtaccctcctacccccagccttcaggcaacgagaaacactgccacacataacctgatgtcccccggtgaacatcactgcttggtgagctcaggtataccaaggcattaaatacctgtgttctaaagactccagaatatatctccctggctcagatctgactgcagacttgcagaccaagtatttgtctaatcagtgtctcaaactcactgtgtccaaaacggaacccttgatgttgtccacatctcctgcctgagtctgcccaatctcagtaaatggcgccttcattctaccagctgctcaggctc

SEQ ID NO: 51459 - DNA, 1069 bp, Homo sapiens
cgacggggtttcaccatgttggccagggtggtctcgatctcgacctcgtgattcgcccaccttggcttcgcaaagtgctgggattacacgcgtgagccaccacgcccggcagatggtgacttcttttatcattgaggaagcagagttaaataaggcaccaacatcacctggctggaagtctcaaagagctccgatgctgaaaggatgaaacttcagttatctgggacatgtggcaggcggttctgtcattccctaagcatgttgggtttatcacgcactttccagttatgtgcttggcgctttgctgagctgatgaccaggaccgagccttactcagcgtctgttcgatgtgtcctaggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggtgagtagaaacccggggctctgtttggtggtttggactccacattcagactctctcacttataactttagcagttgttgaagttctggaaattttaggatcacagtcatcaataagtgaaattctgtgactgattttgttcccagttatgctaattgataccagactctgttgatggactgaagagcagatgtctgatgtcaccacatagtctacagccacttccaaatgccttactgcactttgtgcttagacagtacattggattattcatgttgatgtcatgacatatttttaccattattgattcctatattttacttatagaaaaagcataaggtgccgggtgcggtggctcacgcctgtaatcccagcactttgggagcccaaggcgggcagatcacgaggtcaggagatggagaccatcctggctaacacagtgaaaccccatctctactaaaagtacaaaaaattagctgggcgtggtggtgggcacctgtagtcccagctactcaggaggctgaggcaggagaatggcgtgaacccgggaggcagagctggcagtgagccgagatg

SEQ ID NO: 51460 - DNA, 1065 bp, Homo sapiens
aactttttttgctcagataatggtaagatttgtataattttctctcttttacttgtttctcaatgaatttggagtgatactttttttaattaaaagcataaatgtaaagaaaagtttggcttcttttggtatttataaataaatatttcatcagcctgcaacattccattaagtattagaattatcagatcagaaatggggagtaaagttgaaatataatgttgtctttcttcagcttatgatacacagcacctgtaaggattctttgaagattaatccaaccaattcctgttcctccactgaaatgggagtttttggtccttttcacttgtctcaacagcatgaattgtcctattatcctgtgatttcctaggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccaggtcagtgagttgagttggtctctctgtgagtttactggcagatttggagataataaccacagtggccagggaactcgtctggtgtaaatgaagatgagtgggttgttttcctttgagtgtgaagagcagatttgggctgggcgcggtggctcaggcctgtaatcccaacattctgggaggccaaggcagggggattgcttgaggccagactgcagtgagccgtgattgcaccaccacactccagaatgggtgagagagtgagatcctgtctcaaaaacacggtggctcacgcctgtaatcccaacactttgggaggtcgaggcgggcagatcaagaggtcaggagtttgagaccagcctggctaacatggtgaaaccccatctctactaaagatacaaaaaattacctcagtgtggtggtgcatgcctgtaatcacagctactcgggaggctgaggcaggagaatcgcttgaacccaggaggcagaggtttcagtgagct

SEQ ID NO: 51461 - DNA, 3570 bp, Homo sapiens
gaacaggagaaggctcctctagagtatgaacaatagtggattgtttttaccatgcttacctttgtggaagagagctgaaattttcacctcttctttcttataggctgccagggcacagtgccccccaaggactgaaatagactagatttccttctctttttaatgtttaaactttaaaagaaatgcgtgctagctgtaaaaattcaaaaaaaaagcccgtctgcctcagtcctgcagccctctccagagggagtgacctcgtacagtttggcacatattattccagtctttatccatttgtaagcataaaaagtgcatacttttatgaggctataaatgcataaagacggatatataaaatatataagtgtatatataattttagggcttttttagtgggggaaaatccacaaatggataatactttggatattttctgcagctcgcttttttccacctgacgtacatttacgtctcacattgccattcctcctttgcagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagaggcaagtggactcgtcgttttcatgctgatttcttttgagttaactggaaatcgataacattacaagaggacgtcctgtgcaattaattttttaatggtgtgctagagctgctttttgagacaatctgtcttaaattacatttgcctatttttagctcatattgtaaattgagaggaagaaacatccttagcttagcctgacttaaagccagataacaaccctgaagattctaagggcagggctgcctttgcaagtggggattcacattttcaaagaattcccagaagtcctaagacaaagaattccagcctgccgtcctcgccacggagcctgtggggcctgctgctgggtctgtcccaggctttcttctctgttccctccccccagcagtagctgacaaagaagcgccttccccttacaaaaggcaatgtatatgcctttattgaaggctgatttccttctaaacctgggggcctcacaggggccctttgattgctgttcctttggatagatttttcgctggtagaacgggctttgttttctttttcagtcgtgggctctcagtagattagagtttgctttgctttgtccccgcagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccaggtagaggagggtgcagtttgaggtgcagcgctggcgtcagtaccaagagataaagcccaagtcacatattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaagaaatcttctttgagtctcttctcttttgtggaaaaaaaaaaagggcagggcgggtgggtaaacaagagccaagtgagtttgcatgtggtgaatgatctttcctggatccaattaggagctgctatttttaaaagaaaactttcttattcatgtcagtctcgacatttggttctcatttcactgtttgctgatttgagggggtaagctttgtcatattcagtcttctgcctttcttgagtttcttctgctttatctcaagtatcttccctgaccttcaagattcttcctcaggccgggcccggtggctcacgcctgtaatcccagcactttgggaggctgaggcggatggatcacctgacgtcaggaattcgagaccagcctggccagcatggtgaaaccccatctctactaaaaatacaaaaaattagccgggcgtagtggcagcgcctgtagtcccagctactcgggaggctgaga

SEQ ID NO: 51462 - DNA, 1896 bp, Homo sapiens
ccggccccccgcgcccccgcgcgccgcggctcctgttgacccggtccgcccgtcggtctgcagcgcggctgaggtaaggcggcggggctggccgcggttggcgccgcggtcgcggggttggggagggggccgcttccgcggggaggagcggccgggccggggtccgggcggggtctgaggggaggtagcgcgggacgggcgccgggtgcgggagcctcgccctcgggggaggggacccctccctaggccagcagcgagtcccgggccggcgtccagcggtcggctggggcccccgcagtgccctgcaccggccctccgtttcccccgcgctgccaggccccggctgtgcccagcgctctccagacccgccgctgcctggccgttccctgggctccgcgcacgttgcagcccggggggcggctgtgcttcgtttgaagccatcgtttctcattttccctctcccctttcctcctttgtggtgggcatcgggcttcggctgggaatgtggttatgccctttgccagatggcgataggaaaggtcatcgcttggcgctgggggagccgagggctcgaggcctggaaagaggggtgcgataggaagggagggggcttgttggatgctggccaggtgtgaggaaggctggtgtggtctcggcattcagccgactgggattactcgggcagccatattgggaggatgatctgacaaatcctttaggagccaagtccagttgttggaaggcaccgagtgacagccctggcagctttcagggtgactggccagaccagaagccaagttgtgggggttgggaggctgcttgagcaagctagtcattgttcatgcaacacaaaacattcccgcccctaacgccagaatggagcttccagatccctttttttttttttccttgattgctaaatgagcttccaaggtaaactgccttcaagattccattcttgttggggtgaaattccgtgtttctctattcatcttctgcgtccagtgcgggggctgtgaaaggcctgctgatgctttacatgtgcataggccgatctgagaattgctaaggccactgtatcagtatggaggcctcgagtagccgtagagcattggatggatagattttcagagtcgctcgacttgcagagaagaagtaaaccagagtattctgatagtgggcgaggctagtggcggcatttctgaggacgcaggctgtcatctttgtggaatctcgaggtagctgaaattagattgtcaacagatcccttgctcatatctcttactgctctgagcagctgttctgccaccattgaacattccgctttgtgtcatgatgtgcctgtctgagcctgatgaaagtgtgctgatgagatttgaataactcttaagaggtgatatcatggtggatattttatttaaaggctggcattttgtctccttagtttagtcataacaaaatctagttcttgtgttcctctaagaagtgaggtggtgctttctgattaagttgatatggttgctggattatagagcaagtgttgttaatgtattgtttgaaggtggaatatgagaattacacataggttggtattgtaaagcaggtctggagatgatcaataactgggttcagcatgagtctgtagatctgttcttttctatatcctagatgtggacaggacctggagagatggcatgcctgctttcttctttgtggcctttgctttcattcaagttcaatttgttcataaatacattctcataacttctcaggttgaactatgtaaaaaattttgggatgggtgtggtggctcatgccttgtaatcccaacactttgggaggctgagacaggaggatcccttgagctcaggagttcgagaccaccctgggcaacag

SEQ ID NO: 51463 - DNA, 1033 bp, Homo sapiens
acctcctgggctcaagtggtcctcctatctcagtctcctgagtagctgggatcacaggcatgcgctaccatgcccagctaatttttaaatttttgtagagatggaggtctcactatattgcctattgcccagcctggtcttgaactcctgagctcaagtgatccacctcagtcttccaaagtgggaggattaaaggcatgagcccctgtgcccagccccattgctcttttggattactatattgttggcttagttctctctttcatccagatttttgacatcatcttggcagatgtcaatgactatgtaaataaacaataacagaaacaacaatagtgataaaatagcttattcatattgagcactttctgtgtgccaggcttttttctaagcactttacgtttattaactaatttaaccctaatagcagccatatgaaataaatactgttattcccattttacagatgaaactaaaacaggccaagtgacttccccaaaatcataagtactagtaagtaaccactatgctgagtttcctttgtaactaccgttaactgtgaaatttcttgaattgagctcaagcaaacattggcttcattctgttccagttgtttagtgttatggccacatttttaacttgtcatcatgttaaggtctcaaattcaccttcaagtcttaaactgtgataattgatagctttcactttcataatcactttatgtgtgttctcccactctaagtctcctaaaccgtcggcctcttccagattttacttcttttccttccttttctatactacgacctctgggttgcattgcttgcagtttttattctttcttattattcttcaggacttactatgcagaagccagcctcacatcatccctaccatccataccctccattcttactccgtgtcatggagaaacctgcatagtgctggggattagtgccacaattaatgtgtagtccgaggtctcccttaaatctgtctttggtccctgtcggagcagttctgcttagctccctcc

SEQ ID NO: 51464 - DNA, 1058 bp, Homo sapiens
cttgttggaaatgaatatgctgtacacatgtgttagctgcattaaaaaggctgctttgctggcaagctggcctggactgttgctcacaaggattataactgattgcagatggaatgcactagaatgtttctgccataaactctcttatgaaaaagtagaagagtatgaagagtactttagggaatgtgctaaatctgaaaactgagaagtagctattttatttaagcactttctggtcttggaggaaatattctccatggcacaaataaatgttactgtcttgacattttggagtcccaagcacatgcaaatggctctgttcaataatatcccattatattccaaggttctcccacttgagaagcatttcttattgtctaattacttggtaaaaagggaaatgagccaaagtgaatgatctaaccgcttacatttatggttaggttatttgtgtaaacctggagacattaaacctgtataaatgcactcaaaaacaggaagtagataaaattggttttcacttataatatgaggtacactccatcaagtgactgaactgtgatattttactttatttttacccacaaattgtctcttgccctttggtgaattttgttcatatatttaacaaccttcctttgccaggaccttttttttccccagtgcccaatcttggttgggatagaagtagccctgacttttttttcctgtttattactcatattatatgtcttataggctttttcattcacgcatacatttctaaaccaaatgccgcacagcgtaactgatacaaataatgatttcatgtccactattgaaaatttggggggtgggtgcagtgactcaatgcctgtaatcccagtactttgggaggctgaggcaggcagagtgcttgagtccaggagtttgagaccagcctgggcaacatggcgaaaccctgtctctacaaaaaatacaaaaaagctagctgggtgtggtggtgtgcacctgtagtcgtagctactagggaggctgaggtgggagtatcacttgagccctggaggtcaaggctgcgg

SEQ ID NO: 51465 - DNA, 1087 bp, Homo sapiens
tcccagtagctggagtgagttcaaagaagtatttttatatgtggacttgacctttggtcttttattctcattttccacttaagaaaatcttggctgtgtgaatgaaagagtgatacttttaaggttatagaaagtgaaatgtaatcatgccagataattttatatagatatttttatgtatggctgacctggatgactctaacagtgcatgtgtttgtgagtgtgtgtgtgtgcatgtgcgtgtatttaatgagaaaagtaaacttgtgtataggaggcttaaaaaatgtgtagggaattttaggtgactgttctgattccagacacttttattatggaagcaatcaagtaagtataggaagaaatattaataaaaggttatttatttctccttttactctttacagcccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacaggtgaaaaacaaaacaaaacaaaaatcttctcttcattattagtgttagtcttaaattgctttaacagttatttttatttggcgaacatttatgcggggattgttttatgtcaggcacaaagatgaacaacccattattttccctcagaggagctcacaattgaatgggaaggattgacatgtacacatgtctgtcattaaaggtgggaaagtcagtgttttgtaatgattttgccatatatccaatgccatattattttgtcatttgaaaagtgttaccagcttgttaaagctctgttctaagtcctggagatggggggatattgttgatctgattttttttcaaattccatgcatagattacctctgaagaatgtgattatttttggtttttttgatagccttattcggagatactttcattttattttcctaatttaatactatgactttaaacttcaaacactctgagattctccctctttttttttttttttagaa

SEQ ID NO: 51466 - DNA, 1128 bp, Homo sapiens
gtggcacgatcttggctcactgcaacctccgcctcctgggttcaagcgattctcctgcctcagcctccagaatagctgggactatttttgtatttttagtagagatggggtttcaccatgttggccaagatgttctcgatctcctgaccttgtgatctgcctgcctcgtcctcccaaagtgctgggattacaggcatgagccaccttgcccagcccaaatttttaatttttgaaaaaaaatttaaacttttttgttaaaaacttaggcacacatttattagcctaggcctacacagggtcaggatcatcaagatatcactaggtgacaggaattttccagctttcttataatcttatggggatcactatcatatatgcagtccatcgttgaccgaatcatggttatgcagcgcatgactgactttattcaaagcattaatcgtatcttgatgtttatgacataatatattttgagatggagcaagaaaggacgtctggctaattcattgagcacgcgtggatgacttagtactcctctcatttgtgctcttcatgcctctctcattctacttccctagttatgtgaagaactttttgagaaaatcaatgacaactgtaatgaagaaatgtcttactctgtagaggtgagtacagccgtgagttgacaccgtaagcccttgttttccattctctcaagcatcacttaaatggctccaaattatgactgtggtacacatcacttcaccattccttcatttttgtcctttcaggctatttctgggttttgggtataatgaatagtgtcctgctttaatcttttttttggggggtgcgcggtggggacagggtctcactctgttgcccaggccctggagtgcagtggcgtgatcacagctcactgcagccttgaccttctgggccaaagcgatcttaccccctcagcttctcaagtagctgggacaacaggtgtgtgccaccaccacccctagataattgatttttttgtagagatggagtttccctatgttgcccaggttggtgttgaactcttgggctcaagcaatcttgcctcctccacctctgaaagtgctggggttgcagtgtgaatcactgagcccagccacaatt

SEQ ID NO: 51467 - DNA, 1176 bp, Homo sapiens
gaggccacatttatagctatgaaagttgctttaattgtggagtcctctgatcctttgactgtgctgtaacagtgagggcttcagagtgttaagtatcttctcatctaaacagtacattgctgaaacatgttagagctctcattgagttttactcttaggttttgatcaagtcatggtaaaatgttagttatcatgtatatatgcggctgtggtagtaattgattctggaataaatgagcaccaataaagaataaaaattaaatgcttcattggtttctaaagggatagctggagtatgaaaaatgattctgatggggtgcctttggaattggagagtaacttgatgggctcacaaataaggcagtattgagagcaattgtgtaagtgacaatcttgcaatctgtgaataagtttaagactattgcttgtgattgttatgcttataatgtggagcctgctgtccatttcaactctcatctaagaattcccttgtcacgtggtcacctttatgtttatttaggacagtggcagctacaaacatgaatgaaacaagtagccgttcccacgctgtgtttacgattgttttcacccagaagaaacacgataatgagaccaacctttccactgagaaggtaggagagtttcagtctctaggcttgagttgtgaaggatggagattttgagaagtcccttttgttgccctctgctttttgtggaaggttgggtgttggggggtgctcttttacttaatggagggtgttttatacctctgcttatcatttttcttccaccctacaccagttttctgtataggttcttaaatgaagttgtaagatagagaatagggttaagaaaaaaacaatccaggactttgggtctcaaaaactactcaatacaagacagttaagcagtcttgcaggagaaagttctttcttttcttcttcttgactgaacctttttattaccttattagctgcctttggtatgtgtattctttttttttttttttttgagctatgataatgttatagtgggattaaatgtttaagcaaatgatatgtttcattcctggaaaataactccacaacagttctggtgttcttcaaatacctttctttgcttattgatttttcattttctatagtggttaaatgtcacagactttagcgttggatt

SEQ ID NO: 51468 - DNA, 1984 bp, Homo sapiens
ttaaagcttcacttttagtaagccatttaatgagttgatgagttttatatatttttataacatactctagtaaattatgtcatgtttatcctaaagttacttttttttgaaccgtgataattgctatgaattttgtgcatgctctttttttttttaattaaaaaaaatttttttttagagacacaagggtgttatatgttgccaggctggagtgcagcagacagctttgaactcctgggctcaaaggagcttcctgagtagctgggactacaggcatgtgccattgcacctgccgtgtgtactgtttaaactaactgatagatgttgtcttgatctttttgtgccatatttaaaagctctaatacttttagttttttccataccttaatcttttaaaaagcattctgcctctaaatatttcctgcttctatcttgcttatttttgaattgcccccatgttattgttctttatcaggtcagtaaaatcagcttggtggatctagcaggaagtgaacgagctgattcaactggtgccaaagggactcgattaaaggtatttattttagcaaataaatggcctgatcaataaatggccactacctgtttttgtaaataaaattttattgaaacacagctacatacatttgtttatgtattgtctatggctgcttttgcactacaatggcagtgttgtgacagagaccgtatggcccagaaaacctaaaataatttgtgtctgtccttctacggaaaaattttgctgactcctgatctgtaacttcaatggaaggataagttatctaactaaatagttagggagcacatcatagtcagggtgagagttgaattgcattttaaggaacaggtagaatttggctagatggaattaagagatggcagtgggaataggatatacaagattcagatgtgagaacagaaatttcatgtcgataagttgagggaagaaggctgcacacatctgtaagcttttggagcacaaatatctcgaagatacttcaggactgtgagttaggcatgtggtctcagcatgttattatcaagtggaaaagaggacagatggaggactaaaggttgtttttagaacttgtaataaagaaatatgctagcatatggcaaatcatattttatgttctgtatgatatagcagtagtagaaattcttcatcattctttcatatttggtatttattttaggaaggagcaaatattaataagtctcttacaactttgggcaaagtcatttcagccttggccgaggtggtaagttttatacttcattataaggggagttgtgtctgttcagcaaatatacttgatgatattttattattgtttatgaaggctgtctttttgtggcccttttctgtaatcttgcctttctccttttagagcttttcagataagatactaggtataacacagtttgactttgtactgaaagtaaaagatactaaggagaacaaaagtaaatatagatctgtaaaaactagagcaaacactgaaggtttgactcatttttttgagccttattttatgtttctcacaaaaaccaagtatatttattgtctcttcttttcctgtataatcttttctgagtaagatgcagtatcttttggagtattttgagcagtttggctttggtgaatgctgttgatttgagggccagtagttttttttttttttttcccccaatagttttgttctttcctactcctttatggtagaacagtaaaactaaaactattttttttaaattaggggctttgttgtctacattatttaaattagtcattgtgtgttctagtttagtttaaaacctctttttaattgctaagaagaatgaaatgctttcttgcttgccttggagaaatcataatctatgacatgaaatttaaacaaaatctaattttctacttggaggcttatcctgtgttcttattttctcctttaaatgctttcacctg

SEQ ID NO: 51469 - DNA, 1073 bp, Homo sapiens
aaaattgaggatggggtatttgatgatgttagggaattattgtttattttggtaagtgtgataatggtcctgtggtgttttgttttgtttttaaaaaacatgaccttttccttcacagtaagaaaaaggataaaaaatgatatggacaggatattaggtaatagtattgtgttgatgtttaattttttgaatttggtcattgttttctgtgtaagagaatgttcttatatgctgaagtgtttaggggtaaatggagatgaggtccgcaactgacttcaaaatgggtcaggaaaataagttgtagaaaagtgtttgggggataattgaaagatgattggcagagtattttggtaatggttgaagctgcacgttgggtatggtagctcattatactgctctctcaactgttgtgtatattacacagttttcaaaataaaatgtaaaatgaaaaaattaccttgttgcgtgagtttttggttttgtgaagaattgaaactatgaatgataaacttccacagtgtcggggttgtactgtaatttaatttacttgggaattttagactgatttgcctttcttgggaatttttttccctaacgaaaaatgctaagaccatttcttttcctttaatagagtaaaaagaagaagaaaacagattttattccctacagggattctgtacttacttggctccttcgagaaaatttaggtatgttgaccactagtgaaaagtagttatctttttaactttgattatcttttgtggttaattgtcctgtgtctgttttggagacaaataatctctagatattcatgttactacttgagtgttccttgcctgctttcatttttactcctaatttcagttggttggattcccttggttttaagccagggtatactcccatatctcattttcttcagggcatgaactgtgcagtagttgtcctcccgactccccatacttgcttcagattattgctctttcttcgaagttatttcaaaactccatgcttctctgaggtgcacaaaattagacattgccaacccttaatcctcctcgttgctgatgttt

SEQ ID NO: 51470 - DNA, 1598 bp, Homo sapiens
agatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatagtaagtgaattaaggatcgttacaaaatctaatcctttcttcttcagggttcttattcagcgttcttatatttaaaataaacttcaagttaaggagcatgatgaagctaaatggtagtgaaaatgttttgttttgttttgttttctttttccttaaaaaacccaatggaaatgatctctagattcctttatgtaatgtgtaccagactatccatttgaactcaggaaattagttttaaatcgcaaatatgtcactagtatttttgttagaattctgttttagatcagcaatgaagtttatttggaacgttaaacctgttatcactgagcaattaattacttcatagaaatgttatttgaaattttgagttttgtttcatgggttgctctggattagtgtcgtggcagtaatataagaaacgcaccattcaagcctaccttcagataagattcacctttgaatggccccctcctcctgtaaaatgctggagtgccccgtgctgcctatgaacatatgaaggggaaaagttcaattcctatgaagttcaagaactacacttccagagagtattgttttacaatgttgtattaaaatttatcttaaaaaatctccgtgatgtgcctatccagtggcttattcagaagttctcttaagtgagtaaaatggattcatataggaatagaatatggtagaatatgggttagtttagtaaagcatttttttttagtgtaaagttaaacttatattccttgaagttctaataagattttcaaggcctcttctagtttaattcttcttattgattagagtccgagtttagatgaataccgtttgtaaaaatgataccgtattctaagtattaacttttccatctccccaaatgccaaaaactgctctgttccctctctgtgtcactgctgaacctgaactttgacccttctcgtattttccctcctgcttaccttcagttgatccattgatcgatgattactctggaagtggaagcaaatgtgtgtatttcacatattggttatttccagtactctgacttgctaatctgcctctgctggatcagccttaaaataagctttgcatgctggcaatccttacagggaaatcccagacagagcatagtatagaatcagaaatgatcctatttttgcccttcttcatttagcaaactaatctttgctgaatttcagtttgtggcttgagtgaagttgaaaggcttaagaatctcttgctgcttctactcttcagtttttcccattgtgattcaattaaatccaaaaatcatagatgatagcaactgacacttactgattttgcataatatgccaggccctattctaggcaccttgaatatattgtcccttttaattctgttaatggctctgaaaatattttattatgttccttttaccaataatcatttttagtcagcaaaactatc

SEQ ID NO: 51471 - DNA, 1617 bp, Homo sapiens
accaatactgagtgtaaaagcaaaattaacagttctattaaagacttagtaaatggaagtatgttcctaaaacttgcattttatactaggaagcaggcttagcagtgacccatggttgtactgttaggctaattaagggccttaaattagcaaataatcagccttattttttgcttgctctgacagaagaatggaacctgcactaaaactcattaatctgctaattgttcttccctgttgaggcaatcaattagtcctgagtttttaaccaggacttatacaaaattcctctcatttctataattaccccttttttatttaagacatattaaaaatccttttagcatgttgaaatgttgccatacaaagcatactactcagtgcacaaattttgttttaactgtaacattttcttggaaatttttgctgaattacacgtaacactgagccagaccaatatggattattattgataaataaatgatcattgttttcccttactgttacaaactactggaaaagtgtaaatctgaagacattgtagactaggaacactagaaagactaaatggaaggtagtttggcttttttagggagagtgcctaagcagtatcctttgaggctctggtttatccccctgcgagatacagcgttaacctacattggaatcttttagtttgtaaatgcagaaatgattctgaacctgtaggataccactattaaagacagacatgttttagaactgccatctagaacagttgtaacctgtgtttgtattatagcgtgtcttggtcttggcgctttaatgctgtcctttcttacaacgatattccttcctgtctttttttcttcctctgcttctttcccttttccctacttttcctgccttctcttctttctatctcccagatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggtaagtaatagttcagactgaatacaaggtattctatgtagctccacaaggaagaactaggagtaaaaatcactaagatttcgactcagcatatggagaactctttgactcttagaagtgtcctgaaaattgaattttgtgctttgtaagttaatttcttttcattagaatgcctgagtctgacatggccaggcagagttgggagaagtgcatgggcagttcataggctggcaaggcagagtaacagattaatagatgtgtacgttaattctgggatagtacatcaagttacagtgtaattgttttgttagaaatttatttggaaacgtggtttcattgaaagatggaattctgtgtagagccatgcttctgttaataaagatgaagtttgggccgggtgcagtggctcacgcctgtaatcccagcactttgggaggccgaggcggggtggatcacgaggtcaggagatcaagaccatcctggctaacacggtgaga

SEQ ID NO: 51472 - DNA, 1030 bp, Homo sapiens
cctagagtggggtatgggaagccctggacaccagcatgcctgcctgccagcagaatgagttgatgctcctgagactgaatgctgttttgcacttggcttccctatttatactaagtttgctactcaggcttgaacagaatatccttcactttttcttaacttagggtgaactgtttcatagaacatttacttgaaagcctattgatcctgttttatttgaagaaagaacagtgagtcagcaaatagctctagacctgtctcagtgagtagtgtgggctcacttagcttctctggtctgttggaacacagtggcaccatcttggctcagtgcaacctctgccttccaggttcaagcgaatctcctgcttcagcctcccaagtaactgggactacaggtgcgtgccactgtgcccggctaattttcgtatttttagtagagatggggtttcaccatgtgagccagctgatcttgaactcttgtctctggtccagttttcttatctcgtgaatggttccagaataaacgattttgcaggcttttttcagccctgaagttgtgctaatgtgactcacagttattattttctctaagtttcccccaaagtttttaaaaatagctttctagacaacctaaaaattgcagctgaaaactgtaataaaaataaaagttgtaccttactcattaaatctcttttctgcaaagagatcatgttctgatttacccttcagttggtaagtaaaattagataagtcatattagagttggctgcaaaatggtaagaggattcctagacagtaattttgctttcttagagtgagttctacagttgccccaaaataggatggctttaatatgactagataatcctctgctctgaaataacctttttctgaaggtaatcaactaggaagaaatatttttaaaatatctcatatgtcagtttgtattccataatcaacagtggtttattgtggttagtactataataagtactagtcaagatgccttgtttaggtcgggtgcatcctg

SEQ ID NO: 51473 - DNA, 1027 bp, Homo sapiens
ctttcaggacctactctcccccttattatcttgatacttgccttaatttcagatatttctgatttcatcttagagcatggtcttatagtacaaaggcagcctatttctaaaatgcctatcttgtttactgtttacaaaagaaaaaacctaaggcaatatgtaacctttggccatgattcagtttgtttagtcatctttatttgttgctttctcttaaattcccagcctaacctagcgtactttcagttttggctactctttcatgtagattttcccacagaagtcgtctaccctgctttataactttttggaaccaatttcagctgtacaggtttgtggagaataatactgcttccatttgcttctgcaatttgtattatagacagccattgtactaagtaaagcaattcctgtccctatccttctagactcctctgcttccttcttcattttttaaaaagtgtctccaatagttaccttcctttttacataatcatagttatgaagtagttacgtagcttttagctaattagagtagtaagggtttttttgtttttttcttaaactaagttgcaacgtcttgttggatactagaaaatgactatcaaatggttattttgtgtgcttatgtatcagaaaataggagaacatatatcgatgtacaaagcatgtattttatgccactagtaaattgtcctttatttcaagtgacctcacattggctattggagacttaaacatctttattcataggttctgttgatgatctctctaagttaggatacaaggggtggtgagttttgaattggtacttttatgtgatatgaaatattcctgtggttttcgctacaattcttctggtcaggtttttctatcctggccacataacttttttttttttttcttcccaaattccaatgtgttattttcaacagaaaagactgatgtaaagacattttagatgcatattgtagaatagaacagttaagtattttatatgtttatattatgaaaggttagtggtttt

SEQ ID NO: 51474 - DNA, 1036 bp, Homo sapiens
ggatttattctacttactgcaaatcctgataagcaactgctttccattatttgattccaatagtttgtaatgataacattagtttgtgtttgttcctcttagttatcgtgaccttagagccctgtgagcgctcagaaacctacgtaaatggcaagagggtgtcccagcctgttcagctgcgctcaggtgagactgggagaggtttgccatcttcagcaatgtgcacatggcttctgtgacaactctaatttttggctgtttaaaggctgaagtaatagtcagcattaggatttttgttcttgtaaaaacaacagctctgaaagctgtcttttcacattagggaggggtgaggttgttaaatagatactatatattaaaaaaattatttcttaaccctatttttctgttttgtgctaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggtaatgcacagttacgcagcccatatgactgtttcttcttttaaacatgtaatactaatagcattcttgaatttttttttttttttttacttctaggctacaggaaatggagatcttatacaaaaaggagaaggaagaagcagatcttcttttggagcagcagagactggtaggagtcctgaatctgctaaactgttgggaaaagggcagcttgttcccatactttccctgttccacagagcagtactcacccaaattgcttctgtctcaatgataccaagcactattctttaatttccttaatggagaatgaacttaaatctcccggtagccttagcctgaaaaaatagtccacagaggtactcttttgggctttttatgtcttaaagccaaatcttaacttctgttacaaccaaatactttttaaggaaatagagc

SEQ ID NO: 51475 - DNA, 1497 bp, Homo sapiens
tgtataagtaaaatatgtaatattacctccagttgaggaaaccaaaacttggctgggcgcggtgggtcacgcctgtaatcccagcactttgggaagcctaggcaggtggatcctgggacctcacttagaataactaagcacggtgctcgcttcggcagcacatatactaaaattggaacgatacagagaagattagcatggcccctgcgcaaggatgacacgcaaattcgtgaagcgttccatatttaaaaaaaaaaaaaaagaaacaaaaaccacaaaaacaaaacaaaacaagacaaacaaaaaaaaagaataactaagcacggcagaataaggatgcctggtgctatccataaccaagagttggtgatcattctgtgccctaaaataaagatggccactaaataaagagaaagtgaatgtctaagacgtatttagtttctagggaatgtacataccctgcagataatcagattctggttgttgtttgctctgtgtatctgaaagcaagccaggatttcaagagcagcttcttaaagcaaggaagttgctttcctctcaaaggtctgtctgttccactttcatttcttgacttaagggaggaactgatttctaacacttcagcctgaagaatatctaccagtagtaatactgaatggaaaatgtctttatatattaccctgtattggtcaattaacagatgtatttctaatgcaccctgtgaataaacattgagagaatacaaaggaattattaatcagtaaatatttatttaatatttaccatatgtaatcactttttgcataatgtcagcattaaacaatggaattcaggctcatgagttttctattctgatagttcccaaatgcatcacattgttagggtgctgagtattttcttcagttagtgctctaggataccctggtcctttctgtgcttgctttttacacacagttttgggatcttctctcttcttatttgcataagttccttgcagagtctctttaggaggcctactttgcatttggcatttaatgaaagccgaaggatcattttgtgacatgtgaattgaccagacctcagtagcttttccaactccttaataaatgaatctaaatattttaaaaatctggccaggcgcggtggctcacgcctgtaatcccagcactttgggaggccagggctggcagatcacttgaggtcaggagttcgagaccagcctggccaacatagtgaaaccccatctctactgaaaatacaaaaattagcaggacgtcttggtgggcacctgtaatcccagctgcttgggaggctgaggcaggagaattgcttaaacctagcaggcggaggttgcagtgagccaagatcgcgcaactgcactcaagcctgggtgataaagctagactcagtgtcaaataataataataataataataataataatatagataaatataaaaaattctttttttgacatggagataggatttatatcac

SEQ ID NO: 51476 - DNA, 1050 bp, Homo sapiens
tcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagaaagtggaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggag

SEQ ID NO: 51477 - DNA, 1022 bp, Homo sapiens
agtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttctta

SEQ ID NO: 51478 - DNA, 1099 bp, Homo sapiens
cagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatctttta

SEQ ID NO: 51479 - DNA, 1081 bp, Homo sapiens
aatcggtctgcttccagcctcatacccttttccttcaggtactttgtaatcctttgctgtcggagaaactgttggaaaagttgcaatgtccctaccgtttatagggtgacacagaagattacagtgtgatatgtgtagtgacactgtgctgatgagactgtggccacacagtgctgctggtggtgagaagcgaagttaagtgttgtcaacaactggggtgtcatcttgggtgtggatattttccttccagctattgcttgctaattataatctgccattaggagccaagcctttaatgtctaaaacagcctaaccggaaaactcagaatggtgatattgattttactgtgaatatcaccttctcagaggtgccttaattgtaccaccatcatctctcatcgagagtaccctagcttgtctctttgcttctattcttgacccctataatccaatgtccacatagcaaccaagatcatcttttaaaaacataaatcatatcttgtcagtgtcctcaggggctttccattgcatgaaagaatcttagtcttactgtagtctccaaggctttacatgttttggctgcttacctaccactcttaacactgtcactctcacaccacagacactctgcccttttttttgttccttgtatatgccaagtttcttcccacctctgggctcttgcacttctcaagcctggagcccatttccatcatgcttacctccccttccagacttgagctcctcagctctttctgcccagcccaccacaagttgactcactgttttaataatgatggcctgtaattatcttttctttgtatttgtttggttcttccacgagaatgtaaactcacctagaataaatgccgtatctgtcttattcacttcgccagtcatataaatccataacctggaagagtggttctcaaactttaatgtcagttagaattttggggtcttatgagaacacagactattgggcccaccttcagagtttctgattcactaggtctggggcgagacctgataaatttgcatacctcataaattcccaggtgattctgatgctgctggtcca

SEQ ID NO: 51480 - DNA, 4358 bp, Homo sapiens
taatagaaaaatacttctcttgggtttctgaataattttaattttcttccacttttctgttattaagtttgcacctctaagtttggtatgcccctttgccattgatctgcttctcctctagggtctgagaggcactgctgtgtagtggacaagcacatgcaccctggacccagacagtccaggttccagtcccagctccacgagtggtgttgatccccctagccctgtgcctccattcccccatctacataatggggttggcagcagtacctggcaccaagggattttgtgaggaatgaaaatgggcatatgcataaagcacttatagtgtctggcatggtaaaaggcaataaatgttattcatttttgtaagtattaccaaaacttcacaccaaaccttagattcagtcttctgtatgcccccgtgtttatcagtttcttcactgctaagattacagtggaagaccatattgtgtagtaggtaagagcatggaccacctaactttggggaaattaattatcttctcctagaactaaattctagttttagggaatacgatatgttcttcattcataatcttggcagcctttctcattttataattatttattagccactcctctcctcaagtagactaaataaaggcagtaactgtctttttttcttactactgtgcatagcatttaattaatattaaataattgtttaataattgttggtgaaactataacgtggtagggagaaataaatgatgcaatgtcgtgaagtacttaccatatttattaaacacttttataaaaccatatttattaaacacttttttttatgagataggatctggctctgtcgcccaggctggagtacagtggcgcaattatggctcactactgcctccaccttctgggctgggctcagtttgtagagacagggtctcactgtgttgcctaggctggtctcaaactcctgggctcaagtgatccttccgcctcggccttctagtgtgctgggattacaggtgtgaacttccgtgcccagccaaataaatgcttttaagagcagtagttgcaatcctctgaatttaaaatgggaaaccttgctgtgttttcatcctctctcattagtgagggactagatatgcattttgtggtcgaccttttgttctctggtataaattctataaaagtcttcattcattcaatcaaaatgtatttataaagattttatgccgggtgtggtgggttgtgcctgtgatctgagccgccgaggtgggtggatcatttgagctcaggagttcaagaccagcctgggcaatgtggttaaaccccatctctacaaaaaatttttaaaaatcagctaggctggtgatgcatgcctgtagtcccaggtactcaggaggctgagatggtaggatcacctgagcctaggaggtggaggctacagtgctctgtgattgcatcactgcacccagcctgggtgacagagtgtaaccttgtccccaccgtgcctcccctcaagaagattttcgtatgtgcaaaaacactgccaggctaggaaaacaaagtccttaaatagcttaatttgaagttagggttattccctatgactgctaacaggtggccatatttttcagtagaaagttagtcacaagatatttgttgagcacattcgacctctttcccattgggtatgattgtatcgtctcatctctgaagcttgcttgctgaaaaccatttgtcaatggtttattctttctattcaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagtatgaaaacattcataaaggctggttgttttatttaggaaataacaatgacctgctcaagtgagctccctccagctctcctctctctgaggacactgttgcttacttccctgtactttctaaatgctgttgttggccaatggtattaccatccatctgttttcttttaagtgaataaatgcactcctcacacactctgacatttgtagatatttaagtttaccctccatagaccctcttataaattttaaatattccagtttcatcatatttctgttacagatttggaacttatttattttttctatcctggacctcaggataatcaataataaacatggaagttataatctggcttcttttacatgtagtataatgaggtatttcccccgtctcagtgtatttgagatgtcacatacagttgacctacaatattcccccttatgacttttcacccggtagaggataggtggccattcttgacttttgatggcttatctctagaatcaagacactttagatactgagtgttggtttctgtatttttgggcttcattctttttagtaacattaaacagtgggagcaactcctttttttttttttgaagaaaatcttgaacggaagatgcttccaaagtgaaagtttaatgcaatctcattatattaacccaatgtgctttgtgtttactaaataggcagaggctggatttgatgcgagagatgtatgatagggcaggggagatggcctccagtgcccaagacgaaagcgaaaccactgtgactggcagcgatcccttctatgatcggttccactggttcaaacttgtggggaggtatgtgatgattttgttgatgtcttcttttaaaataatgattagttttaagtgtttaaaacctgagcagataatataaaaagttaagaggaaaaaaaaaggtgtaaaaaggccttatctataatcttatccactcacaaccactgcgtcatttggtatatttcccttcagttatattcagcaggcatttttgtttcgactctcaaactttcagccaaagtatttaaatcttccctgactttaaacttacaaagtgttctgtaattgattaagataaatttagaaggaaaagaaaacttacgcctgtatcctacacagtttaaattcatagtacagcttatcagacacaatctcttcgtgatctgatttgtttttcttttttttaaaaagcaattcatcccactttagtcattgcaagggtaaattaattgcaccttggtagtccccttcagcctcattttttttttatacattatttccagcacttaatgaaaacacatagtgcctctatgagtccatattgagtcaagtgttcttagaggttttcaaattttcaaagcagggaaatttaactttgagcttatgatttcagaatttgaattgctttttcaattgcagaaaaccctgtgatgttttttaaagaggctgggtaaaaaggagttgctgaagtcatagtatgttgtggaaatgaagtaaatcttttccactctgctctgatagcaaagtagtttttcaaagagatgaattggccaaacacatcttaccctagcaaagcacatgctgctttgccatatgccatttcatccattttggtttctgctccaaaatgacgtgagaatttcagtaaagactgaaagccttcttgtttcactttgatgttgagtgggtcctttgaggcctggatgctgatcttttatgtgaactggagaatgtaaacgtgttatagcacagtatttacctaggatggtctactcacgtgtttcctttgcttttcttattctaaggattagtccttacataactttttcaacttgcccttgttccctttcacctgacccaaatgatttatgcttattttatccttttgcttttccatttgcttttattgtgttgattccccagtggattctgtcctgttagcacctattgcttcctgtttaaccaactattcctctctccctggctgtgttaattggcgtcttacctggtgtctagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaaggttggtgaggttattgtgagaaaggcgaaaagggaccagctcttgctctgaaggcctccctgcttgcacaattttggataaccttgcattagccaattcaactcatgaatgctctttttcaa

SEQ ID NO: 51481 - DNA, 1038 bp, Homo sapiens
gccactgcacttcagcctgggcaacagagcaaagactctgtctagggggaaaaaaaaattagtttcttgtgaaattccattagtaagtttgttttttagccatgactgcctctgctaaaactttatattgcaagtgaaaaagagcttgtccctttagctattctcttatggcatgctgggatgttatgaaccatccatcataatttgggatgaaatgtaaaatatttaagctagtcttctgggttaaaagggggttaaagatgatgattctgtgatctctctaagtaccttaactgacattctttctataagtagcaccataattttgctaatttttcttatctttatgttgaccagtttgttccactttttgaagtaacttcattgaactttctgctaacgtatcctttccatattcccctctctcatccctgttctccttcagtctgctaggtcaaagtataaggattctcaaaaatgcagagtaattatgaaaattctgtttaaaaagcttcagaatagaatgtttatatagcattgatttggagctaagggctatattctggtaacataacaaggtgctatctagtgaatgtgtgattgtgtagtcatggagctgatgtccctgccatagaattacagaattatctaaaaagggaaatctataataatggccttcaatgctcccacacttggactagccattgccataggcagaaaggcaatctcatctttactgtgtgtgcaaacagtactttaatgtaatgtgtgcttaatataagctttctttaaaaaaaaaaaaggtggctcctgtttttgaatagctatttttaagatagatatagttaggaatctaaatgtgttctatatagttaatatccattatgaggtggctctgaaaaatcaacctagtataagttggatggctttgcttttctgcttctgttataacccatttttctagaaaagcttccacttctacttaaagataagaggcaaatcattttcctgttcccttatgcacatagatgttcactt

SEQ ID NO: 51482 - DNA, 1044 bp, Homo sapiens
aaaaaaaaaaaaaaagacatcaaaggcatgaggtgtaggcatcgagtgcagagaggactccaggcaggggacatgtgcgatggctctttaatggcccaggccttgaaatgggcaagtctagctggggtgcccataatagaggagggtgatctgtgtatgtgttgactttgaaagtgaaattatccatttgataccttacgccaaattctttgtcttttaaattctgttgcagtagttgttgtttgagggtcttgtttagaactttttagaacttttcattcttacgtttttttacaccagagcttcaactctctgtttcttagcatttctctctctcctgctttggagcagactgaaagggaagtggcattatttcatctgatttaatgttcatttgcagttatttttgttatatgtttcatttgtatttcatttatgctctagttatgttaacatttgtttttctgtgatgtattatgtctgttttcataattttcattactttgagttgaaatcccaaatacccagtctatcctcctcctctctttgttttaaaatagatttcagagcaggaaaagcatcagataaacatgtatgtcacttggttttgtttgatttattgatacaagtgtctgtctttgtcttttgtcttatgttcgaagatcagcatataccaaatgggaagactggaatcatagtaggaactagattctatttccctttcactaattggaatgaacactctagctttgtgaccaccagtttttattgcttttttaaaaaagtagtagctacacaataaagaagaaaatacaaatgtgataggactttgctagtttgcttgaaatataaagtgttagagctataatttagctttcacttatgcatttctgaattaggttttgaactctaggagcaaacgcaaaccttttaggcatcaactgtcatcttctcccttaacatttatcttttttctttttttctcttgagacgaagtcttgctcttgtcccccaggctggagtgcaatggtgcgatctcggctc

SEQ ID NO: 51483 - DNA, 1038 bp, Homo sapiens
tgaatagagtgcgaagcagcccatgccgtgttactactttggtatcattctctcatgccaaagacttgagtttataatccagcaagagctttttccctccctccccctgtgtagtctcactcaattcttgctaatttttttttctgctttagcggatgaagaagctcctgattatggctctggaattcgacagtcaggaacagctaaaatatcttttgataatgaatactttaatcaggtgagaaaccgtcaggaagaaggaaaaccctgtggaaagagaaagaatgttcagcattggagatcagttctcctgtaaaactgaaaaatacagggtgctggttgccacagagtagttcaatagaatatgggacatgtctaacaattatgaaggtaaaggtgtatagactcaatattcatattttattcattgcctttcctcagacagccctcagtccatataattttccagtcactattatttgttggacagataaacagaagtaaggcaactggggaaaaatacgtttttatactactttaccatgtatctgcccctgcctttttttcagagtgacttttcgtctgttgcaatgactcgttctggtctgtccttggaggagttgaggattgtggaaggacagggtcagagttctgaggtcatcactcctccagaagaaatcagtcgaattaatgacttgggtatgtagacatagtttactgtgcttggggacattttcgacaaagggaaaatattgaccattatcaagggacatagtggccttcatcaactaggaatggaaagcatgcccaactccctcctctttgcattatttgaaccatctgtgtcttcatttgaccctctttagatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaagtaagctgc

SEQ ID NO: 51484 - DNA, 1045 bp, Homo sapiens
tttctgttgttttcttgtattatagtttaccataggaaagagaaaaaagaaacaaacttctgtttgctggcaggggctgtggagaaagagggaaggagtgagagggtacatatgtatgtctggggagggggagtggcagaaataaagaggggtgctttgactatccatgggcaaaatcacgagcaatactatttccctgaagtcagcagtaattctgcatagctttctgttttctgccaatgttcagccgggttttaccaccacattttctttgtagctatgaaaaatgtattgtaaatttccctagggtacttagtaaaatatacagggaaagatgggctttggttgaaatactggttattctaattttgcctccattagagtaactttaagaagtcctttaattcacgcccaacaacaggtcaggtgctacaagaaatgaatttggctttgttagaagcagcttatcttgtgagttagaatgagttcatcaaaaaaggctgaagtcaagaataacaacaacaacaaaaaacaccttaaatatttctgttctcatttaaactatataaatctacattaatttatcaaacttttgctggaaagccatggccttttctttaattataagatcatttactggagttctgattgtctttcttgcaaaaccacacccataattcatcatctatgactttcagtttggtggagcaagaattagaaacctgtgaagaaaatctaagttcaaaatcctttaaattttttatcatttattaacattaatcatttaaacattttatcattttcccctttcttttacatttgtctcacccaaacttaacagttatttttaaacaactcaccattttctaaccttttgaaaacattcaacttagttttcacaggaacaaaaattatttatgttttcatatttcattgatttgcctaatgtttaatgaagttagataataataataagtacaactggcataaacagatttgggaccagatactactgacatttgataagcactcaactcttcggagc

SEQ ID NO: 51485 - DNA, 1064 bp, Homo sapiens
cccaggaggcggagcttgcagtgggctgagatcacgccactgcactccagcctgggcaacagagcgagactccatctcaaaaaaaaaaaaaaaagaattattaattcgttttgacctaaacttggaattgaattttttttctgaaacaaaaacttgtttcctcttgtcttaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtatccaggggcagggttgttcagatgcaagaactctcggacaagattgccaaagtatcagtcttcctccccgctgctgcatgtgatcatagcttttcacttttctctcctgaggtcttaacgagctttgtgtttgctatagcagtagtattgatcttctcaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaaggtgtgaatcccttcctctttgctgaacgtcttcccacaaggctccacaaactagcctctcggtttattcattttcaacacctttgttcgaggtgtttgaaggcctgtgataatactgtgaatgtagaaataaaaagacgcagttcctaccctcaacaagcttacagggccaggcacagtgcctgatgcctattatcccaccactttgggaggctgaagcaaagggattgcttgagcccaggagttaaagacaagcccaggctaacatagtgagaccttgtctctacaaaaacaaaaattaggccaggcatggtggctcacacctgtaatcccagcactttgca

SEQ ID NO: 51486 - DNA, 1378 bp, Homo sapiens
aaggacaggagtgtaaattggttgtggggtggtaatgaggcctctgcatcttgtaaggcattgtcatgttctgaaccaccagggatactctggtcacacatgtgcaccaattattttccttctttgtctttttgttctcaagagttctaaagatggggctcaggggagagagtaaagggaggacagtgagaaccttaatggtctcccaacctccagccctgtgattcagcctcacgttctgagggcttgtgtcacagggtcccggagtagacggcttagaggactaggcctgcggtgccaaataggaagatgctccaggagggagcctcagagggagaggactgtgaggggacaagacttgtacccagacttctaatcctacctccccgtttgtcccccataggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttct

SEQ ID NO: 51487 - DNA, 2507 bp, Homo sapiens
ttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcaca

SEQ ID NO: 51488 - DNA, 1052 bp, Homo sapiens
ccaggggcagcccggctcggcctcagcgggcggggaactctttgggggtcgagatctccctcgttctctccgacgcctcccaccctgggggtcgcctgagctcacttggggctctgtgaccctggccctacggcgtctcgggcccagagctccttccctgcgggcccggccccctgccctctcggccgcgcaggcatggggcggggcgggtcccttcgagggccagggaggaggcgcggccaggcctcgccgagtctgcagggacacctgcgggacgcgtgccagcgggagccgggcgcgagggcggggctgggggccgcctgcccggccgaggctctgcagcgtgcgcgcccggcttctgggggcccgcgggaggcgcggaggaaagtgcagactcccagtcacggccaaatgtggaaggaccggacccctgggttgcagcgcgtcgagcggtgctgactctttcctttgttctgtttctgcctctctagagctgacatcgcgctgatcggattggccgtcatgggccagaacttaattctgaacatgaatgaccacggctttgtggtaagcggcgtgggcgcgttgtcttctctctggttcccgggcgctttagccgaggccggcgataggtttgggagcttacgggtctcctggccgtgctttgctaatgtgctctgttgctgctcgtggcatttttgtatggaaaggagaagcaccctgtaggcgtgggcgggccgatcccgaacttagtcctgcggagtgtgcctgtgggtccgtgaggttcacagcccgaatgaacgaattagtgtcttaagtagagaagaagggtgcgggaggagaacccttgctggctgtgtagagctctaacttgattgcctgatgagatctggggagagtgaaaatgtttcttctaaatgttaaagtggcttagacgccaggatgatcaataacaacagatagagcctgttgaaccggccagttcctggatttgattttgagtcctaacacgttgggtgtggattctacctgacacaccgggggtagttggc

SEQ ID NO: 51489 - DNA, 1049 bp, Homo sapiens
gtggctcaggcctgtaatcccagcactttttgggaggctggttcagatggatcgtttgagcccaggagttcgagaccagcctgggcaacatggcgaaaccctgtctctacataaaattaaaaaattagctgggtatggtggtgtaagcttatggtcccagctacaagcttatggtcccaggttcgagaccagcctggccaacatggtgaaaccccgtctctactaaaaatataaaaattagctgggctttgtggctcatgcctgtaatcccagttactcgggaggctgaggaatgagaatcacttgaacctgggaggtggaggttacagtgacctgagattgtgccactccagtttggcgacagagcgagactccgtctcaaaaaaaaaatgaaaataaaatcaagatctccttagggaatcctagggaactggatgcttatttttgtaccaaacaatttgttggctttagcaggtatatcttttttggaagaaaaaagtaggggaaccagtggaaataatgtgtttagatacccaaaataattctatagtaacaactctgaaaaaacccaggcactcccatttagaagaaatgttttgctgtaagcagtgcagtgatagctcaggggaggctgagcattcctttctagaggagtcgtgtcaacagtggggttgtttccacagggagaaggatttgtaaccagtatgccactgtttttcaatcaaatgacctagaaaggaagaacactgagtttaaaaaaaggacatactaaattttttgtgtggcaagctgcctgtaatcagtttcagacagagaaaactgaaaaatggtggattattcttcagtataggaaaatactaagtaatgttaactggagccttgtagggggaagattgaataatataatgaagcccaggctgggcgcggtggctcacgcctgtaatcccagcactttgggaggcagaggtgggtggatcatgaggtcaggagatcgagaccatcctagctaacacggtgaaaccccatctctactaaaaatacaaaaaatt

SEQ ID NO: 51490 - DNA, 1094 bp, Homo sapiens
tgctcctgtaatcccagctcatcaggaggctgaggcgttagaattgcttgaacccaggaggcaggtgttgtgctgagccaagatcacaccgctgcactccagcctgggcgacagagcgagactccgtttcaaaaaaaaaaaagaaacacggacaatggagtcctgatgtgagcgtcagttatacaactgacggtccaggtggtgacagccaggagagagactgcccaggtcatccaaacacctggcctcctgggcaggtgtgtccctgtcatggagctgggtgtagatgactgagagtttgatgccatgaactgtttggctctcgtcactccctttgttccagttcttgacaactaaataattttcggataatctggcttcccagttgcttgtctatagggccagaatgtgttgaccggactaacatttgtaaccacgaagatccatagttaaggttttcatcctacattcattaacgggtattctgattttatacatcttgccagcttataaataaagatctggtctttatttataaatataaatataaatataaatataatgatggggccttggagggactcctttctgggcttacaaggttgagaccttggatctagggtcattttacttttcagtagccattaggaacaactacaatacatttatattttgaaaaaaaacaagtgatttaattggccaatatattttaacctctagttgctagaaaagtggtaactttgggaaaaagaggactttttttcttgtgggtgggggctgggaaggtggggagttgctttgaatgatgagaaagagtagaaaatacaggctagagagccataagtattgaaagtgaattcagggactttgagaaaccttgagaagaatgagtctagaattagtgttaaataatattgtactggactgaagcttgctttgaattgctatatgattcttgtatcaaaaatgctgtactcattttatacttgttattttttgtgtggagaggtagccttgccagggatgttggcatgaaagctgatgtggacttctctgatgtgtcgcctgtttctctgaaggcctcttggtgcttg

SEQ ID NO: 51491 - DNA, 1030 bp, Homo sapiens
agtcttttataaggaatactttctgaaaatactaaatgtcttaatattaaaatactacattgactttttaattcaaatgaagtaaagtggttaaacttgaatgattacggctatactgaaaaccgtaaaatataaaaacctaacatttttttgagaggtgagtccgtaaatgtgacttatcaatgtaaaatcttcaaaaaaaaaaattaaggtcctctaaattgaatttgaaattttactcatggaccaacactgagtattctacataacagtggtttttattttattttactggttttagagacagggtctcactgtgttgcccaggctggagagcagtggtgtgatcatggctcactgtagccttgaactcctgggctcaagtgatcctcccacctcagcctgccaaagtgctgggattacaggtgttagccaccttgcccagccataacagtggtttctatctcttcattttccctcaaaactcccttttgaatttcatgttaatctttgtgattgaatactcatgtttgtattggaagattgtcttaagagttttagttatcaaattaactgtttagagcttcttataaaagttccttccgatccatgtcaacttttgtggcctaaggttgaaactttcagctctttgtataaacagactttcctgctccacctttcttctggttgctgtgcgaactttggtaattttcatgcgcatccgtgtgaaaagaccaccaaacaggctttgtgtgagcaataaagctttttaatcacctgggtgcaggcaggttgagtccgaagagtcagcgaagggagataggggtggggccattttataggatttgggcaggtagtggaaaattacagtcaaagggggtttttctcttacgggcagggccgaggggtcacaaggtgctcagttggggaggttctgagccaggagaaggaatgtcacaaggttaatcgctcagttaaggtggggcaggaacaaatcacaatggtggaatgtcatcagtaaaggcaggaa

SEQ ID NO: 51492 - DNA, 1002 bp, Homo sapiens
agaaatgagaaatgtaactttgtttcactagggtatacatcggcttccagcttacttccctgttagagttaagattcattgcatttggccgggcgcggtggctcacacctgtaatcccagcgttttgggaggccgaggcaggcggatcacgaggtcaggagatccagaccatcctggctaacacggtgaaaccctgtctctactaaaaatacaaaaattagccggttgtagtggtgcgtgcctgtaatcccagctactggcgaggctgaggcaggagaatcgcttgaacctgggaggtggaggttgctgtgagctgagatcgtgccactccactccagcctggtgacaaagcgggactccgtctcaaaaaaaaaaaaaaaaagactcattgcttttttccccccttgattatttcagtgtattcctaggaaagataaaggatgcatttgatcgaaacccggaacttcagaacctcctactggacgacttctttaagtcagctgttgaaaactgccaggtatgtagcctagggctggtgccatggttactctacctccctggggccatcagttgtgatgtttggttttttgttttttttttttggttttttgtttttttgagacagagtctcgctctgtcacccaggctggagtacagtggcatgatcttggctcactgcaacctccgcctcctgggttcaagcgattctcctgccccagccttcctaagtagctgggactacaggtgtgccaacatacctggctaattttttttttttttttgtatttttagtagagatggggtttcaccatgttggctagactggtcttgaactcctgacctcgtgatccgcccacctcagccttccaaagtgctgggatgacaggcgtgagccaccgcgcctggcctaaccatcagtttttcatttacccacattgatatgaatgaaaatctatccgcgtcaccaggggcagatcactaatctctggccgtgcgttttgt

SEQ ID NO: 51493 - DNA, 1261 bp, Homo sapiens
gcagggattaacctggctggcccctcgggggcgtgcgccatggactgtcctgaccaacctactctctcgtttcctaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtctgatttatttcctttcccacacctgtctctacttgctctaagccaggcccagggattttgaacaagctaagccggctccttaaactaggcttttcactttatcttacttactcagagaagataaaacctgccagtgatattgttgtgtggcctggggccagtgtgactgttccctgcagcggtttgacttcatgatgatttccctggagtgttaaagtcctaagagttgcctaagaggagcgagcagcgcctgtgcctcgacagctggtgtctacagtgtgacctctgacctct

SEQ ID NO: 51494 - DNA, 1373 bp, Homo sapiens
gcctcagcctcctggagcggctgccagcctcttcatctgtggtcacctttgcgcttctctcgtcaagttggatagtcagaaataatctagtcgagccctctcagtgcgttgataggaaagggacgcactgtgactaacagacgccaccaagcttttggctgaggacccatcctcgcttccctgggtttggttttgttggccgagggctccgctctagcttttcacctgcagattcagacaaatcccactccaataaggggaccataaggaccagcgttgacgcctgtgcctctgcggccgggaggcagtggatgataaggtctccgaaggggtttatagtccaaaggtggggtagggtggggtgaggagaaaagggctaagagacatcttacatttaactgcctgtgtggtgtcatgttgagcacaaattacatctattatctcgtttagtgttcactacaacctttatgaagtgcaggctactaacctccatttcacagaaatgaatactaagggtttgtgacatgccccaaatcgtgtgctctgttgagcctgtattgaacctgtgtgactccactagtcatccatacatttttgagtttagttaggattagaatgaggaagaagaaaatagtttcaacttggggcctcattcctcctctcccatctccttgaagcacctctaagagttttcagcaacttactagtatttcacttccttcagaggcagaagaccaccgcttagtgtttcttactgtcttattctgcacgtctgttacaagaattgaacttaaaggagttggtgtgttcccccataccagtttctattagcagtgtgaatgattcaggaagaagatgtcttgattgtaaaacatgggagataacaaggactgattctggccttctcactgtcaggtgttctggagtttggcaagtgtctcgagaggagggcctctcctttcttgccttaccacatttagtttgctgaaatactaaggcatcttggggtctgggtttctctgaattgttttgtgttaggaatgcccacaggctgggattgaagggtgtcctcagttcctgattcttttttctttcttaagacggagtctctctctgtcgcccatgctggagtgcattggcgcaatctcggctcactgcctcccgggttcgagcaattctcctgcctcagcctcccaagtagctgggactacgggtgcctgccaccacacctgactaatttttgtaattttagtagcgataggtttcaccatgttggccaggctggtcttaaactcctgacttcaagtgatctgcccgcctcagcctcccaaagtgctgagattatatgcgtgagccaccgtgcccggctctgt

SEQ ID NO: 51495 - DNA, 1007 bp, Homo sapiens
ggatcatttgacctctggtctctcctgaatgccctgtgaggacactccagtctggctgcttgggactcatgattcccctgagagttctaagaaatgtcagctcctagcttcttcttcactgtggagtttcaccctatgcatgcacaaattttagtattcagcagagacctgagggaacctccagacagatttctggaccactttttctgcatagctctttctttctgaagtctgtcctgcagctttcagctgccttggcctccctgaactctgatctctgtctcttcaacttaagtgggtggcgtgctctgctggggatccccgtctctctccagggcctgaaatgtgtctcctggcaggaagccagagtgattttagggcccaagtaatttgtttctctgctttcagggatcgtagtcctgcactgcctgctgtccaatgtgtacacacagtggttttatttatttggcttagttttctagttgtttacagtgggagggcaaatctgttccctatcactccatcatgacccgaagtggaagtgcattggttgactttgagcagaggagtgacatgaaataacttatcatctcctctaatcccaaatgtgaggtggtggtattattcccgttattcccatagatgaggaaactgaggctcagagaggttgagcagcgtgcccccaaatcactgagttcttaatgccaaagcttgtgtactttctgtcatgccactgcatctcaaaggatattggtgggatcgaatcttattcttcccagcagagaactacacagactggcttaggacctatctggagtcacagtcaccgggcagatgcaggatgggttctcctatctgaagtcgcagttactgggcagatgcaggatgggttctcctagacctggagctttcgccagttgctcaaatctgtgagctgcttgtgaggttgttctttgttggacagcaggtcaggatctgggaacgccttccagttggggaaggtcagc

SEQ ID NO: 51496 - DNA, 1078 bp, Homo sapiens
tgtccattgggtggcactgtgatcttatttttgtttccatttttctctgcagccaagctctactccaggaagtgaaaatgtgctgcctcgagagccgctggtaagtacccaagatatgtggtatcactttctagtaattaaaatgccacgcgagtgaaaagaaaccttctgttcctatggttctgcgtcagtagtgtccctttaaaagtagctgttacctagagactgcctctgtcagtgacctctgacttctcttctcgcgtgtggggacgagtgagatctctccttagtaaaggctggtcctttctaggactaaaagcatccaccccagatggtcctgcaccactttgtttgtggctgatcaatagtaattagtgagattcctgcgcccgtgggaggctgaggtggagtgaggtggctgggcttctagattgtttgaagtagccgccctctgctctgcccctcagggtgcgagcgcctcagtggtctttaaagaacaggtaagcgatggaattctggttttgcctggtcagtaattgtgtgattgtcattcccaacgctgtcttcttagactatggatagggaagaggcctattaagcactgcaggtaattttctctcccaagtgcttttcatttggtggccagagtcccaggctgcccaccccattttcattcttttttgcttttcagggcctgctgtaagtcctcttggctgggtagtaagactggctctgtataaaccagataagtttgatgggagagccagctctaggtttaacttttcagagctttttcttcctgcgtagcgatagcaggcgtagggctgtactgccaaggctttgtttcagcagggcctgtggtttcacctgttctgcttcactccccttctggcagtcgcgggaggagatgacgtgagggacttagcgggtatgaacacgtctgaattccagtgtgtacgaaggctttcccaggctgagggcgagttggatccagttgagctgtctgtagaaaggccgaggtgatacaagcactgctgggactgtttcaggggagcagtgttgtcattcatgtcacctg

SEQ ID NO: 51497 - DNA, 1050 bp, Homo sapiens
gtcattagggctagagattggtgaacagaccagtcttgagaaattctgcaaactccaagttgaaattctctgttgttgacaaaactccgccaaagttaaaatggctggttacttttttctctttatactctcttcactgagctttgcctgctgaggcaaggagttcggacaggcctccagagtacagacctccagcttctcccagatctgtgaaaacctgtgaatttcccacagactctggttttctagccacagttgtgtgcctgtccttaggcccacacagtctctggatccagcttcttgtgctgtcctagtaggaccaagtccctgcctggtctataagtattttagaatgggcggacaattgtccacatgtgcatggggtaattcagttcccatcttgtttggatactgaaacttgggttaaataaacttttgagctttccatttagtcatatgatttttggttatttgaagtaagcagtaaataaggtttgatttacacatctgctcacttgtttcaattcagtttctcaatgttcagcaatactatagctcatctactttaaacagtgcttatggattttggctaaactagaattttagctttttgctctttgacaccaagttctctctaatggatgagtccttggccatcgtctcttcctttaacttttaggtgtaggttctttttgttttttctttctgtcctctttcctgcatctctccaccaaaataatcccaaagaacaatttttttttttttttttttttgagatggagtcttgctctgtcacccaggctggagtgcagtggtgtgatctcggctcactgcatcctccacctcccgggttcaagcgattctcctgcctcagcctccagagtagctgggattacaggtacgcgccgccatgcccagctaatttttgtatttttagtggagacagggtttcaccatgttggccaggatggtctggatctcctgaccttgtgatctgcccaccttggcctcccaaagtgctgggattacaggtgtgagccaacgtgcctg

SEQ ID NO: 51498 - DNA, 1033 bp, Homo sapiens
ttctacatcatgtatttgatctcagtcctggggaagctcatccatcttacccctgggacacccaagattttctctttggtttacaagccaattaaccagaggctggtaatcagaaggcgtattttgatggattcagggagccagtactgtgatctctgtaagaataggcaaggcacggtgctcacgcctgtaatcccagcactgtgggaggccgaggcgggtggatcacctgaggtcaggagttcgagactagcctggctaacatggcaaaaccccgtctctacttaaaaaaaaaaaaaaattagctgggtgtagtggcaggtacctataatcctggctactcaggtggcagaggttgcagtgaaccgagatcgcgctactgccctgcagcctgggcgacagagccagattctgtctcaaaaaaaaaaaaaaaaaaaaaaaaaaaaagaaaagaaaagaatagctacagccggttgcctgtctgccaaagacctctaacatgtattcctggcacagtctcctcagcatttgtgtcttctgtgacttttgtggttagaatactttggtgtacttgtcggcaggttcactgtggataagtggttctcattttttttcccaccaaaacatttctttttttgaagcggtgtctcgctgtgtcacccaggctggagtgcagtggtgcaatctccgctcactgcaacctctgtctcccgggttcaagtgactctcttgccttagtctcctgagtatctgggactataggcgtgcaccaccacggccagctaatttttgtatttttagcaaagacggggttttgccatgttggccaggttggtctcgaactcctaggctcaagtgatcctcctgccttggcctcccaaagtgctgggattgcaggcatgagccaccacgtccggccccaccaaaacatttctgaagaatgacattaacatgtttctttgtgtgcactcatgtatgcatgtgtatgacaatacatatatattttataacatttaagcattttgtggggaaa

SEQ ID NO: 51499 - DNA, 1904 bp, Homo sapiens
gactgcaggacctcatcaacacgtgtattgccagaagagaggcttgattgtgttaacctgtttctctccagaggtgtcacatactagaatttctgctcagtcttatggcttaggtggggtgttgagtctaaatatatatattttttgagacggagtcttgctctgtcacccaggctggagtgcagtggcataatcttggctcactgcacgctccgcctcccgggtttacgccattctcctgcctcagcttcccgaataactgggactacaggcgcctgcccccacgctcggctaattttggtatttttagtagagacagggtttcaccatgttagccaggatggtctcgacctcctgacctcgtgatctgccctcctcggcctcccaaagtgctgagattacagacgtgagccaccgtgcctggcccaagtctaaatttttaaggactagagctctcagaccaggactttctggatctttttttctgatacccaacactgtggcacttgactaagtcacctgattgatgacatgagcattgctgggtgttgaaacacctggccagggaaacagagacttctgtggattcatccaaaggatggcagacagattgtggaattttaatgaaggtggggtggatccctgatgttcgcctgctttgaagcatagcagaatcccagcattaacttcaggggtgttggttggaaacctgcactggcgtcggtggttatattccacatttgtcaaatccttaaatccaactgaactaattttagaagtagctagttataatgaaaaagaacaatatattcagatgcataggatcgtttttaaatgaaatgctccctgttcttttccttctttttttttttaacttttattttttatgatggagtcttgctctgtcgccaggctggagtgcagtggcgtgatgtcggctcactgcaacctccgcctcacgggttcaagcgattccctgcctcagcctcctgagtagctgggactacaggcgtgtgccaccacgcccggctaattttttgtatttttagtagagatgaggtttcatcgtgttagctgggatggtctggatctcgtgacctcgtgatccacccaccttggtctcccagaatgctgggattacaggcgtaggccaccgtgcccggcccttttccttcttttataaaaggcctttggtctcttttggccttcagggtgagccatcctttgacttatattagaatacattttttttcctgtatgcctccaatgaaggagagtgtgagagtgttttctatgatgtgagtgggagaaaatagcgtgttttcacaatagttaacaaattgatggctgtgagttttgaaagtgagttctgtatatacactggggtaggattccacatagaatgctgtttttcacccacctggctggttgtctgattctaacatagctgctatccctgattctagaaatcagaaaaccacaggctgttcacataatactctacccttctgaggctaaggtgggaacaggatggtggcggggtttgagtcaacatggtctcagttcccaccaaagaccagtgtgttcccctgttccagccgacagcttgaacaaggattctaaagtttctggccgttttaattgaactgcagtgaggggtggcccgatagcctgcttaggacatgggtaattactcctagggcctgggagccaagtgtccctcgcaggttccctcttggttctctacctaaggatatcttccccttccctgggcagggcctctgaggaacagaaggatcatttagtgctcatggcctgctcattccttggcttctctgctgagctatccagcaggggtgccaattcttccatttagctgactattatatagcccttaaaaggga

SEQ ID NO: 51500 - DNA, 1314 bp, Homo sapiens
gtaacagttaaagaatggtaatgagtagccaaaaaagaaaaaaagaagaaagaaaagaaggaaatagaaaaaaaggaaaaaatgtataaaataatctatgcctctgtgtgtgtgtgtgtgtgtgtgtgtgtgtgtgtgtgtgtgtgtatggtgttagaaacggcagagtcaccttctaaaacagcagtgagaaacttctgtcatcctttctcccagttcaggttgatttgtacggtgctgctcagcccacgtattgtgcatctgtatgtgtgtatgtgcgagcgcctgtgtacgcacgtggtcgtcacccgccagaaagatgccatagtgaggtgtgctatactgtgttgtttgtgcacgtgtgtaacaatatacagtgtttgttcaatgtcctggcaggaaattggtctattagcgattcaccttcttggtgagtagctaataccttattttgttcaaggttccacgttcacacaggaactttgggcctaagacgcaactcaagggaaagccattggggaatgctcagttgggattgaactaataggccattgggtgtcactgtcgctctactggctataggagaaagaggggttatctgctggggaaactggatttcaaaagaaagaagtttttctgcttgagttggaggtgttgtctctttgagatgtttgtctctcatttggagattcctttaaaaaagtagttgtttgcttgtttttgctacaccaagcttctggcatttttattgttcttgaaaattgtgtactgattgcgatctgttctgctatcacctgcagtgcatctagatgagaacttctgtgtgcagaaaactgtcccccttaaaagcctgggtaacaaggagagctgatttgggcaagaacttgaaaaaggagggagaaaatctccttgggcaaatgcttgccactcccctgccgcctgcccctgtgtaggtgggaagagagcgcagagggagagccaggctgctgcctggtcacagaagagtgggctccgtcctccagcgggctctccagcagcatggatctgtgccaggcttcaccacaattcatactgtgtcagtttaataaatgcactacttaaattatgaaattacaaaagaaaaaagagaatgcacttattcagactcttaatacattaaaaataaggcattaaaactctgacttttttttttttcttccagaatcaataatgaacaggaagggttgtagacattaacagtcatggacattcaaactcttatacataaattatcttagaaaaatgcacataagacttgaataatgtaaatacatt

SEQ ID NO: 51501 - DNA, 1033 bp, Homo sapiens
ggatgacggtcagacctcggtttgttcttttcttttccagttttcagagcccaagcctgctccctctgttgcttgtccagccttgaccagtgactgtcttcagcctgcactctgcatttcaccccagcagtaggaagaagtgaggtcagaggagcacgtgaaccagggagaatcgaattctctttggattttgctggtcacacccagcaaagctgctttctcttcccttaagttccaagaactgtttgatggccttaactgcacaattggcttgtgccagattgagatgtgttgaactgggcagtggaggtgggggtgaggggcaactccctctcctattgggggcagagtgctggctgcatcaggcagtgatcagataggcactgatcgggtcggttcaccctctgatatagcccgtatgcagacttcctttgaagagagaggagtcaggctcattaattaaaggagcctggcttgagaggcctgtaattataggtgctagaaatctgaattttaagaggttgtgcagctgcattttgaaaaatgtagggaggcaccgagaagtactggttgtgggcaagaatgtggctgaaccagattttggaggttcaggttttggcagaattcccctccaaattcatatttattctttctttccattttgttcttttttttttttctaaatgggaagcagaacctgtgattttttttttttttaaatgaaggttacaccctgtgaccgagaggctagcattgtcagagtatatggggggcagaaaggagttgctgtgaactagaagatgcttagtttttgaggaaacggcacatctttgggccttagggattcagtatttgaaaaaaattaaataatttctttcttgaaatgagtgaggggagcagggagcagaagcccaatttgaatgcagtctagggaagtaagtcccaggcaaatggtggactctagaacctttgtcccaacttgacttccccagaagtgtctcttcctctgtcatgcgttacttttccatgtgaa

SEQ ID NO: 51502 - DNA, 1065 bp, Homo sapiens
gagatggtgtgaaggtcgttatgtccgttttgtcctcttggagagaaagtgagggagtgtgtttcttgccgtgtgcttgtcgtggtagtggtggagttggagaggcccccacttctgtcaaaaggagtcgagccaaactctcatcctctcttcttcaccctgtatactacacgttgtccaacagggggtgaatgatttcaaaagcggaattcagaatttcaggaagagtagcacaccaccgagtagagggcctccccctaacaccccccttttcatcattctcccctcctcagcccagccgtgacaaactgacagataattaacagatcagaccctcctattaggcgtgccctgtgctggaagctgctctggctttatgcagtcctttagcagctctgtgtgtgtgggtggtgcctcactaagtggccatagcagagggcagggagtgctttgggaaaagcaaacagaatgctctttggaagagagagtgcttaagagggagagcgggggcagtaaggtgcctggcttgaaagcacctggcgaaaagactcggactttcagggttgtgatccggaataccaccgcctgtctcagggaatggtgcgctgggttataataggatgccttattacaaaaaacattttgaaggccacttcccaggtcaggctatgcattaggtgcactcttccttcggtgtaagactgtgctggacttgcaaaattggaagtgtgcagcctgttgtgtttcagccttggcattaaatatttctacagagacactgccctatgtggctttctctcagctacctaacttttctttccctggtggaaagaagaattcattgtgagaatattcatttctacttactagtgacttttaaaaactacttttctttgtttttggacacagggacttgctgtgctgctcaggctggagtgcagtgtgcaaacacggcttactgcagccttcaccttccggccgaagtgatcctcccgcctcgacctccatgtagctgggaccatagatgtgtgccaccacacccagctcatttgaaatttttgttgt

SEQ ID NO: 51503 - DNA, 1048 bp, Homo sapiens
tttgaggttgcacacagaactgcctctagtttttgtttattcctgctgcttttttagtctttcttttcattttggcagctggggaaatcctggattgaggctcacacacatttgccctcctgccacactgagaatgacaattccgacgcttgctttcttttgcatacttgtagatttttcttctactctggtttaggatatgtcaccttttggatatgttcgtggaatgtggcttgtggttgccgctgcttccttccctccccagcctgttccctagctagaaagagagcgtgtagacttgagaaagaacagggagcccggcattgtgaatggtagatcagagaggagcctgcatgtagaaaaccagaattatgttgtcctaggaccctggatccgagagtgctctgcctggaatctcaaggaacacggcctctttagtgagatatatagcttcataattagcccgttgcattttttcacgagtgctagcatcagcgttctacgatgtgtttctctgattaacagctgctttgcaactatttccctgtgccgccgatgaccatatttgtcaaggaactcctgacagagtactgatttcttactaaaatgcagcatttctgtttgaagagggttctctcattcttggcagtgcctggctttttaagtcagtccttgttaaaactcgagttggctttggtctaacgcttgttaacaggattctgggtatctactttagtgtatgaacgtaggaacctttcacaggcaatttaatcttctgagcagcgcacgtggagcagtgcggcgctggaatggggtttcgggcccgtagattatattggtcattttcttttgccctctagttgtgatctctgtgggttaaaaggacttggctttggttgttagtgtcattaatttttgaatatttttaatattttaagatggctaatgaatgctcacatcttaggagatagatgtgtatgtagtacacaggagtgctggaattggtggcattccaaataagtgtcactggagacaatgcatcaggttt

SEQ ID NO: 51504 - DNA, 1023 bp, Homo sapiens
atacaggaagccagtgaagacagggaaacaacatcgcctttcatttaggtagattttaagtttaagaaataactggttataaatttgaccacaatagtatgcttgtctctgtggagctgggaaaaactcctaggatttttaatcttgaaattcagactattgaagtgaagtttactcctctattttctctctctcaccagattgccacggcagtgaagtttctacagaattcccgggtccgccagagcccacttgcaaccaggagagcattcctaaagaagaaaggtacaggttccacagggctgtgcagcacggcctacagggggactggggctggggcagatggaagccacggtgcaaggcaggtgctgagctgccaggacttcctagagctgcccactcatggggcagtggggctgaggcgaaccccccagtggggcatgcaggtttctttcctgacaatggagcggcaagatgacacgattcgggtaattaagcacggatgacttagtccagtccatcatggcaaaggcagcattcagtagcagagtcggcccattggatgagactgtggaggacttctggtttttggtctgctctgtgtcagtgaccctggctgcaggatgactagcttaggttaggagttcagctgcttcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgatgggcaaaagtaagctttcttcctcccaaagcaaaactct

SEQ ID NO: 51505 - DNA, 1058 bp, Homo sapiens
gtctggaccaggaggggcctgggttctggcacccgtgctcttggactccctgcagaagccttgcagtgctgggcttggagcatgggctctgggagggctctcagctcctggagtcttggcttttcctagcaatgtcacttcagggaattgcagtggagcactgacttgaattataatcttgactttcttttttttaataaacatctctttcctgaaaaggcaaatccaattttgtttttcttttaatattatttaatatttaatatagaaattgaggtccctgtagtgcatgtcagttcagtggaaaatgaggcgcatcagctgagtttgtttcattgtgaaaccgcagctgggagcaggggctgcatcctgtccgtgttaccgactggttaagtgttgtgctctgtgacttctggtgggggtgctgggtgagggtgagtagggaatgagtggtatagggatggaagagcattggtttgcaaaggtctttcctgttactttttttttgttttttgttttgagatctctttcggatgctttaaaatctgaacatggagccattaatgagaaacgtgaagttattagaatcatttatcattttctttgaagtttgtactgccattttgtgtaatttacaacatttcttccttttatcgggaatattttggatgaaagaaaaaagcagctgctcaccttcagagtattagaataaatgtttttgttttccttccaaccacttgattctgcagatgacacatcaactgcggagtcagccacacatcaagataattggactgtgtgtggggtttaagccctcatagaaccagtctatatatagaagcagttcttgccaggcaggcatcatatctggggctttaagcaggctgcaatccaggaggttagagtaacgtaaaaacagcaatagaatcagtccagaaagttagaggcttggaaattgtcgtcaataggcttgtgttgatttgacaccctatccagccacaaaatgtaggaggcagtctgcttccaaagatgtttggcaggctgaggatgaggtgggt

SEQ ID NO: 51506 - DNA, 1057 bp, Homo sapiens
aaattaattttctccttcagctttactttataattaattctttaatgtgtcttagtgaagccagaagtcttttcacaaagcttttcttcctagagcttgggtccagcagatagcttggggggagggcacggaaatcttgccagctcccaccccttgcttgcgtgtggcccatttcctcatcctcagaaactcctgcggctgagctggaaggaatacaattggctctgtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataagagaggacagtgggcaaaatgtagggtgacaaccaagggttctggtttgcccagaattgccctgggttcaaccctgaagttcccatgttgtggacagccccgtggtcctagacaaacaggtcaccttagcggtaaaagcctttctcaggagtgagagctaccaggggagacaaaacgggtttggttttggaacctggaggaagaaggcaaaatgagaagagtccactggcagtgagtcccggagaggcccgcctgcagcagcgtggcatcttccgcacccacttcctgctctttctcccgtagccctgccctagtgtgggtccagtgcagagcctctgggggcggggccgtgccctgcaggtgagcgaggagctgctcgtgcggagcaggcagggctgtgtggcagccgcgcttgttcctgaggatgattgagcatctccatccatctgttgtgaacggaccgtcttccttccctgccagtcttgcacctgcatattcgtcacctgctgttctggcccagcctattcatcaca

SEQ ID NO: 51507 - DNA, 1015 bp, Homo sapiens
tcatttcctcaaaaagtgtaaacatgggcttatgagacatatggaagcccacccaatttgaggagcagggtctctgtcatcactgagttgaatttcagggtgtagtctgcgcctgtgctctccccttgaagaatcacattgtagaaaatgaaatctagaatgactacagaggttacttagttcgtctataccttttcatatacatttcagtaattattttgctacataggaagtgaatttaatttggagtttttcctgctgccttccatgagggctttcatcctaagccccattcttgtgtgtgagaagaggaagtcttgggcttgagtgtggctctaaagtaaatgccgttgactttgttgttctgtatggacgcttttatcaggacaataaagggtacatagggtgacctctgctcctgtggagaggtcgaatggttacattacacaatcttctagagcatcttgcagcaaatacatgggttatattaaaaattgcaatcatatcattttttatagtaaattgctgaccttctgcagcggaatcagctttattgaatttcgccaaaaatgtgtttataattctgccatacacacatgatattcatgtccttgctgtccatgtggaaatgtccctttttataatgttaaacaaattaaatcgactttctcctgagcttccgtgcctcacctttaagatccattctcaggagtcgaacctccatgaagccgagctcatctccattagcgtggatgtcattacacagcgcgctggaggctggtgcattaggcagctttatcccagcagcacggattcggcttggagattctttagaggtgactccagggcagtaaatgtatttcacgcatactgcctgaacactaacaaggccttaccataattactctgtttgttttggggaaatggtaggtatttgtttaaaaggattttgtggtgaaccaagaatatacatgtgtagttagttctcgctattcacttgtgaatgatgcattgt

SEQ ID NO: 51508 - DNA, 1362 bp, Homo sapiens
atctatccatttactaattattaaatatccatttccttcatgtgccaacatttgtgctaaacataaaaatacaaaaataagatttaatatttgtagtttagtggggttccatgatatataaacagatgtggtgtgggtgataaaatattataggtgctataataggtatctgagtggaggcctggggggagagcgatcagttttgtggtaggggaggagaactagtggcgaagaggttaaaaaggtgcctccattcatggaggaggtcccctttatccgagccctgcaagaggattagttgtttttaaggtctgaagcggattggtgacttttgtccatgcagaggatgtgatggggcatagccactaaggcgagagatcgaggagacagcttggaaaggtgggcaaaggtgggatcagggaagacctggcatgtgttacctcaagagtgtggattttgttatgtggacagtggggaaaccacggaaaagttgtatgtggaataataagtttcatgctagcgttttagaaagctctctcaaaggtagggcgggcatttaggagaggggaatgatggatgaaccagggcagttattacggggatggagaggatggattagagagtgaggaagcagaatctcctgggaattggtggctgaatggatgcaagagtgaagaagagggaagagtctgggctcactgtccaaatttttggcttagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgctggcttctgcctttcaaagtcgcttctacagggtgaccgttaagcttgttctttgacaccgacattgttaagtggtttcactgaaatttgagactctctgaagaaagggaagatggcatttatgaagcaagtgttattttatctggaaatgatttctcaggggtaagcctgtcactctgcctctggtaaagtctgcttctccctccaagaagagaaggtcccactgatttgggtcatggtcagagtgggccgctactcccaccttccactgaaaactcagcttccagaaagctcctcttcactcctttgtcatctgtttcctcatctgctcttccctgagtttgtccttctctgttatatctgcatgtgtttccactgatctgcttgtgacagtcaacctgtttgctgatctggcctcggcaattttcagggcttccctgcacacctgtgacatgacggttagttccctgaccttgcatgcacctcggttttctg

SEQ ID NO: 51509 - DNA, 2512 bp, Homo sapiens
gttcagcctgatcttagagctctcttggcattgcagctgcagtcaggttttccttttaaatgactgcagccttcagatgcccacacagtgcagtccagatctcatgcctggggctgaaggtggacctggtttggcggtaaattatgatccacagctttgaaagcatataggctgtatgcttttttttcttttttttttaaagacagagcctcacactgtcacccaggctggaatacagtggcgcgatcttggctcactgcaacctccatctcctggggctcaagtgatcttcccatctcagcctcctgagtagctgggattactgatgcgtaccaccatacacccagctaatttttgtagttttagtagagatggggttttgccatgtttcccaggctggctgtacaccttttaaaaataaagcctatctgaaagcaagttgcttctctagaggcatcttcctcagtctgcttttgtccagccttcccgtggaaagcagccttcttcttgatctggggctgcagtaaatcacatgctggccatcgcgggaacacatcccatcccttcccaaaaccacctgcaggactgaccctaccccccaataacacaccaacctgctgtgttttttactgaccattcctgtccgggatagtcactgtagcagtctactttggtgggcttttacctctcctatctgctttttttttaatttacaaattttaaattaaaaaaatttaaatgaaaggtttggacattgagtattgttacccactcacttctggtgactcttcagacactcactcgaagagccttccttcttccctacatacagagtcggggggagagatggggaaaatgacggaggaaaacatgctaaaaatgattttcaatgtaaaataagggagggaaaaacgaatgtttgaggaaacccaaaaaaagcacctctcattacagtaattaaaccgcagcgtttaacctatcagaatgtgctgcatatgtgagagacaagccagggagctctgtgtttgaaattagagctctaatcctcagggaagagaatagttaaataatttgtttttgaggtgtgagagcagagccggcaaggtgtgagtgtgtgtgtgtgtgtgtgtgtgtgcatgcacccgtgagggtgaggggccgcagtgcctgtgtttaccaagaatatcctggaggtagatatttatcagcacctgtgtgctgtcaagaagcacacaagctgctgttgcccgttcattaggttttcagaagagtccgggcctcacctgtggccgggcgttgcatcataacagcagaacttgcttcattctggccctctgggacacacaggaatagatttgagagacaggatgagacatacagagaaagacacaagcattaggggaggaagaaagccgaatgatcctggagcatgtccttggcgcaggcactgctggacaaagcagtccatctcggtgggctggcactgcggagccagcgtggacattccaccgagcacgaggcgaaaggggcagcccagaggcctgccactgaaaccgccttctgcaggcaccgtctgccagtgctcagcgctgttagcagggctcctcctctgctgggatgaggggttgggatgacaggggttcacagtgtcctgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcacgcactttgtcggtctctgtgcagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaagaactttaaagagctgatgagcctaatggaaacttttcagtaataactcagtacaggaacacacttcacaaataccagctaattaatcctcagagcaccctggggacaggggagagtatggtaatggcactggtgatttttatccccattttatagactgagagactgaggcacctggaagaatctgtgacttgggccagagggagggcacaaatctggaagctgaggttagagtgctttgccttttggcctctcttgggactgttgagtcttaccttaaagtcatttgagtaagtcattaagtaaagccagtcaccttagattttg

SEQ ID NO: 51510 - DNA, 1065 bp, Homo sapiens
tcaattttagtaactgccttgtgttctgctgaaaatatatgccataatttattgtaacccagtccccttgattatcttcattttacacaattatagcaactcttctttaagtatccttgggaaataggtattacttttgtgattacctttgtggggtaaaaacctcagagttaggctgggtgcaatggctcacgcctgtaatcccagcactttgggaggccgaggtgggcggatcacttgaggtcaggagtttgagaccagcctggccaacatggtgaaacctcgtctctactaaaaatacaaaaaatagccagctgtggtggcgggcgcctgtaatcccagctgctcgggaggctgaggcagaagaattgcttgaaccctggaggtggagtttgcagtgacctgagatcgtgccactgcacttcaggctgggcaacagagtgagactctgtctcaaaaacaaaaagcaaaaaacctcagagctgctaatcctaggttaaagaaaatggacttgttttcattttaatgtacattgctaacctgtgctttaaaaaggtgatttcagcttacagcctcaacaccagttggccagtgccccgagcacaagtctcaaacttccacattgtcaagttcacagtttcttcctttgtctaagcatggaaaacccttcccccactgcaagggcatagaactatttgcctacctttttttttttttttaatgattttagttttcttttatggaatttgtgttgttgctagttgcgtaacagggaatataactttattttttcctgttgaccaactggatagtctcagcaccatttatagaacgatttatttctttccccactgatttgacatgtcatctttttcatctgctaaattcttaaatatactgatgtgtgatcagggacattctattctcattcattgctgtacttgtctgttgttgtgctaatgctgcaatgtttttattattatagatttgttacacactgtatttgttagtattcgttgtactcttttgtacaaaaatataaaaattttgtatttttaatagaga

SEQ ID NO: 51511 - DNA, 1279 bp, Homo sapiens
agacaggtagatcatttgaggttaggagttcaagaccagcctgactaacatagtgaaaccccatctctctactaaaaatacaaaaattagctgggcatggtggtacacacctgtaatcccagctactcaggagcctgaggcaggagaatcacttgagcctgggaggcagagattgtggtgagctgagattgcaccactgcactccagtctgggcgacagaatgagaccctgtctcaaaaaaaaaaaaaaaaaaaagaaagaaagaaattactttggaaagaattggtgtctttgcagtatgcactctttccatccacggatgtggggtatctttcaagtaaaatatgtaatgcccctcactgatggttttgtacagttcttgcatagttcctgcacatttcctttaattctgagtacctgtatttttaatttattcttcttgctttaggatatttatttccattatattttctaattgatctttgccaatagttaggaaagctgttgatttctgtgtttttagaattattttattatttttaatagtcctaattgtttttgttggttctcttaggttttctcagtagcatatcacatgaaaataacattttccttttccaatgtcgtatgactttattattattattttgactggcccttctagaacagctttaattaaatatgagtgcacaaggaggtacattgggaggtacaatcacccccttttctttaaagcattaatttagagatgaagagcataggaatataagagacatagccatgatgattcctagacttttcaaagtccttgctttgcaggactttttcatctattttatttttagtttttcacctatttggtccagtatttattctttggccaaaaatggcttgacatgctgaaaaccaccttattttagagaagaaaatacacattatttctattttgtcaagcggaaaagctgaaaggcattggaaataactcccagtcccttggcaaacagatcagtgagtagacccctgtgtgagacaaagccactgcctggagaggatggtgcgggggctggcggtccattgccacggctgctgcagctctcaacaccacggcagcctccccccaccaccacccaacggtgtacagcctgagtggaaagggcaagtttttggccgaaagagtaaatgaaacatggacgctgtaggacatcatcagaagtgattatttattctacagaactagagacttctcttctctcagaggacaactgacagcagcttctgt

SEQ ID NO: 51512 - DNA, 1037 bp, Homo sapiens
tccttttccttggtggggtgaaccctaatttttgtttactgctgttgaacttttacaagctatttcatctcagttagacgcagaaagcctctcaatgctgttttgatttgaatttctcttttgaacttaagagccatttttatttccatatctacaaattgactattcatgtattttaccctttcttaggattaggagattaatgttttaaaatggatttataattttatattctcaactttggatcttaagctctagccttactcaatttaaaaattgtaactgagtgcaatggcttgagcctgtaatcccagctacttgggaggctgaggcaggaggattgcttgaggctaggagtttgagaccagcctgggcgacctcattgctacaaaaaaacacaaaaattagatgggtgtggtagcacatgcctgtagtcccagctacttgggaggctgaggtgggaagatctcttaagcccaggagttctgctttgtgaactccatttgtttatttatttacatgtctgtctatttacttacatctctctagtccatctgaagatggacaaaagctctgcctcagcatcttatagggtatttgctcacctttctgcagttcccttctcactgagatcttggactctcaagtcttggttgccttggcagctccccagtactttcaatcagtttgtttttcagttgttctcagcagtattgttgaacttttacaagctatttcatcttggttagatgcagaaagcctctcagtgctgttttgagttgaatttctcttttgaacttaagagccatttttatttccgtatctacaaattgactattcaggtattttaccctttcttgggattaggagattaatgttttaaaattgatttataattttatatactaaggaaaatagccccatgtctgggatttgtgttacaaatatatgctattagtttgaaatttgtcttgactttgtttatgatgcttttgtccaggcagaatttttttatttatctatcatttcttttatga

SEQ ID NO: 51513 - DNA, 1120 bp, Homo sapiens
ttttacatactgattttgaatgttgacacctagctagatacttatattgtttatggtacgttaattcatgtcagtttttccaggtgctatatgtaaataacactctcccctcttcttttccgttgcttatatctattactacttttcttgtccagttgcatcagcaaatacctccagaacagtgataaataaaactgatgattgtgaacgtatgatgtgtttctgattttaaataatatgcttttatatctttttaataaaagatgatgtcagctttggagagtgacacacatatacacaagtagatactcttcccccccccccccccactcccactaacagataatcatattcaggaagtattcttgtattcttattgtattagagtttttactaagaatggatatcgaattatatctaatgtcctttatcacttacagaaataatcatataattattgtcttttgatctaatatgataaagtatattaatagataacagtgaatcattattatattattaatatgaattccagccagttgtagtgtagtattttttaaatgtgctagattctttgtgccattattttatccagcagttagcagaatagccgtaagtatgtgttcaagccctcagagatgatgaatttgttcatgcctttgtgttcatgccctcagacatcatgaatttgaggatatttggaaaaattaaggtagagtgttttttgttttgttttgttttgtttttgagacagagtctcactctgttgccctggctggagtgcagtggcgtgatctcggctcactgcaacctccgcctcctgggttcaagtgattctcatacctcagcctcccaagtagctgggattacagatgcacgtcaccacaccttgctaatttttgtattttttgtagagatggggtttcaccacattggccaggctggtctcgaactcctgacctcaagtgatctgcccaccttggcctcccaaagtgctgggatttacaggcatgagccactgtgcctggctttgaagtagagattgatggagatctagtttattttcgtagtattggatgcattaaatataaacagtgctaatattataaatatcaaattc

SEQ ID NO: 51514 - DNA, 1004 bp, Homo sapiens
ctgctgtggtcgcagccacagtgggttaagcaagaagttagaaattgtgggtgtctttctgttataatcctagctcctagacttggcttgtatcttcttctgtcttggtttttctcttccagaaaacggggtgaaccattgtgatcttgttaaggatcaagtctggttggtttgttttccccaaatattttctttgttcttaaatttatttatttgaatcagaaatctattcacagggaacaaaattcataaggctaggcagtgaaaagtgttcctcaatctctgttccccagcaactagtcctctctataaccagtgttaccagtttcctgtcctccttttctttcaggtatacacactgtgtgtgtgtgtgtgtgtgtgtgtgtgtgtgtgtgtgtgtggacttctctgtacccttcacctagttttcccccatgctcctgatgttctctttggctttcttctttcgggggtgttaattctgagagtttgcttatttaaaatatgcagactctgtcaagtggcagagggcagtaggtatgtcaggctgcccatgctccccgccccctgcccctgcctagcacagagagccccgtgtgggaatccaattctggggctcacatgggctgtgggcaagtccatgcccctctctctgtccctttttcttgatctataaaacagaaggaaaaaagaaaaagaacaggagagaggtcagataaactccaatttttcttgcagttctgaatttctttgtttggttgtcaaaggcaagttgattcctttttttaaaccacccttcatgacctcttctgaaaacaggagcaagatttaagtatcactaaaagtgtttatcaatttgacttttccatgcatgcacaaacacacgtttggcttacttggcatttaagtagcagagattcctgattacccttcccttggtctttagggacacagtttcttccctaggacttactcagtatactgtgggaagggctgacttttct

SEQ ID NO: 51515 - DNA, 1869 bp, Homo sapiens
agtttcctcagtctttcagctagcagtgaaatacattttgcactggcttttttactcagtgatttacactgggagacgtggctgggtgatgtccagtgtccttttgtctttgtgtttatttttcttccacatttaatgtatttaaaggatatattgtctttatggttcactgggataaggagggattggtgcaagttttaatgagaggtgccccagctctctgtgttgagctgagaattatcttcttggttagatatctttctttctttccttaggtggcaggaggcagtgttttgctgctttttgaaataatgtttctgcctaacgatttctagaaggataccgagaggacattcagcttcagggcatcatcagcaactttttctcctgttgtttgaacttccctcatttaaggagaggggaaagtctcaggtcttgttcttgaatttacatatcaatattaagatgatgggaaacagccccctgccactccccatcatctgatcaattcttataaaaactcttgcattcagggtagtgacatgtggaactagttttctcagaaactgttttcactgcttgggaatagttaatcagtggaggaaaaagtgtttgacttatctgcttaatattttaaccaagtgaattagacaggttggggggctgggggaggggataagaaagtgggtgggggaggccccataaacaaggtgatatataatattttttttgttctccttttaaataaataccgatcagctttatgttcagagacaatagaagccgttggcttaaatttgcagtttactgtatttatggctgtaatatcaaggtgctgccgtcgtaatttcatgccccaatgagaagagcaaggtcgaagcaaatgcttccatcggcatctgctaacacactaactcataaacaaggcccggctggatcaggtggcacggaataatacaggctaatgaaatacagcacagctttccattactgttagtttttacagtgtcgtcattacgtgtaatttatgtttaaaaaattcaattttatacaaggcactgggaaataggggtctccaggtcatcctacgacttttagaggctctgagagtccttattgtactctactgttccaacaaaatgttcataaaataaaataaaaatacttttccccttcccctccctgaaccttttctgagagagttgatttttttcttttaatttgggaagtatttttagccagctgtcttctctgcctcatctcctcccagagtgtgccggggcagataacttagttgttctgagagaggtgaccccctctcagtgtccatgagtcccagatgaattggccaagtcctagaaatagaggggctgcagagcggggaggaagaggtcccaatgaccagcccttgactgccaccgtttgtcactggccccctggccctgttcccgtgatcccagtcagatgccacatttttataataaaactagggctgagcaggaaggcgctggcaggagttcattaccttgcttattttcaaactcttcctaacccttctgtcctggttgttgtttgacctgaaagatgaagagaacactgctgtcttctgtcatctgtctttctgcttcacctgcacagggccaagccccgtggcagtgcccagcggtcactggggacagtgctgaggttacttatcctgagaaacccttgcacggcctgtcccgcagagaaaagacagcccttccgggtccctggtttggtctgagtcgtgggaaaggaccctagggcatcacaatcgcagcctgtaccctgcagctcacagagtcaatcagtttggttttatttgcatttgaacagaaaccttgagaa

SEQ ID NO: 51516 - DNA, 1043 bp, Homo sapiens
caccactctctacaagtaggatgtggggcatcgtttctaccctccttgggcctcaggtttcttatctgttaaatgagggcagtgactgggataatggcccggctctgaatgtgattcagtgagattgttaaaacgcttacttttaaaaagaagagaaaggattcatttactgtaactaaatcaaaatcctgcctctcccagagaaccagggatatcagaatttcagccaatataaattttgagcctcaaatgataacgtctgtgaaaaacaagagcttggaaggaagtactgatgccctttcaactgtggcctcactagtgggctcggctgcgataatgcaaggaacatgttttattaggaaaataggcttcataaaagctcagggccagagggcagaactgcgggcagggcgtcctgtccctttaaccagctccggccctcagggccacagcacagtctgtaacttactgtatatttccccagtgttaaacattattgtacttgtttatatttgaaagagccaaaagggaaaatgagaatgcaactgaatgctccttttgggaaaattatcttcatttgcagccagcggctgacaaggcacacgaaccaccaggtttataaaattccgtagtgtaccagtgaccatcagcctgtgctgacatcgcagatgctgctttcttctctaatggctgattatgaactggttaaaacaatgtctttcccaccagggctccgaaaggggttccccttcctgtttagtcggagcgatcggcagtcactacacaggctggaacctgagaggcacaaactcagggcgggggtattctctgttgttgcctggcttgcctgttggtcctgtccctgttcttcttggaaggtgaaattatgggtaaagcagtccctttgcagcaagcaccccctctctagctccactctactgaccttcagcttttgtctttggaaggtggtacgtgatgcgctgtgaaccctggaagcattttcatccagcccaccaatctgttgagagcatggtgctatcagg

SEQ ID NO: 51517 - DNA, 2010 bp, Homo sapiens
gagggtaaagaggggaacagctgcagttttaaatggggatagtcctcaactcctcagcacagagaagggaaaaaagagtccagggctgtttagaaaagttcgggcattttcctttgactagctgtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctacccccaggggcaaatataccatgctgtgggcctctaatggagagctgccgaccagatgtggaaaagctctcggctgtagtttaaaagctctgtgttgcggctcgcttggatgttgggattcctggaacagcaagggctggccgagtggtcttttgcagactaacagtgacctcccacctgcttttcccactctcagcagctggagtgcctttgtacacacagctacttcctgagctggccccgtgtgaccgctcctttcatacttgagcgccacatttcattctgttctttgggttggatggggctctcttcctcctcccaagagtcagtgtcccaaattggctcagacccggtggaaatatcccagctgtgtccccactggaaatgcggccttcatgggttttcatttgccttttattcttctgtgggcaaatcctctccacatggcatagccactgcagatggcgccctgccacttcctgatgtcccatgtatggtgtggtttagagtgtcgggaggatttcaagaagggaaaagaaaaactagccaaaggcgatacaggcagcgtgtgataggctagaataataatcatctgaaagtttgggcctggccttgttttgatctgttttcttgttttattttcttctttacattctatatcccattcatactaatcacagtcagtcctgatttttctttttatttctgcatttgtcataaaataaagcaaattattcccgtcttcagaaacgatctagactaattagtcgtctcacccaataattagttttttgtttccctgtctgttttcgtgcattattgttagttttttcccctcttttttttttaacaccattacagattaaaatgagccacatttgcagttgatggtatctgttttcgggggaagaatggagaattgcagtaccgagcgacttcaaaagcagcaataaactcaaggataaattaaggaaattgaatgagccacatttggaagcagtgttgaggctaatattctgtcgcttaaggttaaattgcaactgagagaggttccggagaatctgaaatcggggaggcaacttactaggatgcgaggcattctgtggctgtaaaggtctttgctcagtgaagattctgttgcagctatggacactgacaaaaggtactcacctgcaatgatgtcctcttctccccagggctgacagatgaagagattgatatggccttccagcagtcgggcactgctgccgatgagccttcgtccttgggcccagccacacaggtggttcctgtccagccccctcacctcatatctcagccatacagtaagtcacccgctcaaactcctgcttaaccttgattgggattcaggactctggccaaagggcagtgttctgtatctcccagacttagcaaaccaggagaaactgggagcagcagaaagctcttgggtttttcccaaggaatgtgacacaccccagtcttctagacaaactttttaaagtatgtgacaaaggtttaagaagagacaagggatcagaataaatgattttattgttgtttcaggtattttggttacatgcagaaaacctgtacaactatttattgattctgttcccatctcctcataccagtgcttttgaatgttactgtttcactaaaaacagcgtgaccatctgactcatgggtgcattcttgtttgctcactg

SEQ ID NO: 51518 - DNA, 1049 bp, Homo sapiens
tttattattattgaattgtcagagctctttatgtattctagttacaagtgctttgtcagatatatgcttggcagatattttctcccagcctatggcttgtctcttcattttcttgacagtgccttttgaaaagcaaaagctttaaattttgatggtgtccatttgatcagttttttcctttttggttcatgcttcttatatcttaagatgtttttgtttaccccaaggttgcaaagattttcttctatgttttctgatttcttatagaagttttatagtttttgctttcttgtttaggtgtgacccattttgagttaatttttgtgtatggtataaggtgagagtcaaggttcatttttttttcctatggatatccagttgttcagcatggctgttgcaaaaattatcctttccccatagagctaccttggcctctatcaaaaatcagttgaccatgtaagcatgggtctatttctggactcttctgaattcttaacagcttaattagagctcatattttttaatctatggacaggggatatagatatgcctctcggtgtccttcctgcctaaagatgacactgctaatggcattgtagcccatgaaaagtggaaaagattgtctttcatgggatgtacgtgtaaatacaggctttgcattttccaacaggactactgttgggctactgtggtgccttttgccatccaggctgccaagtccttctgttcagagcagagacgatctgtttctgttgctgctctctgggcctgtctttctgcccactgccagccatccacagccatgtgcttcagggcccaccccgcccccaagctatagccagcccttctcagcccagccaggtccccgtctctctgcacttgtgctctccacctctgtgctgtagcaagcactgatttggtgggctggctttattccaggaccttactgggagtgagcctgtcttgtcatttaattttcagggtggcttctgagcgaagctgatgggctgatgtgagaagctagagacactgctgtatagagacatggc

SEQ ID NO: 51519 - DNA, 1626 bp, Homo sapiens
ggacccgcttggcatctatctcagctgtaggatctttgctcctgaaaggaggggtggaagggctccatcctgtcccttgcccagtgtccctgggggagcagctcaccatcgccgagcccttgcgggtcagggaaggcgtggcccttcgaaggggggcgtcctgaatgccgccaccaacctcctccccttcttctccctctaggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaatttctgcctgtggctccctgtctgctcatggcaccctgggcccgggggttcgtctcagcgcagcctccagctggtgaagtgtgggtgagggcccatgggcagcttccgccgctgctgagccagaagcagaggccttgttcaggtccagtggctgccggagggcgacactttgctgaccgcaggaggatcagggacc

SEQ ID NO: 51520 - DNA, 1025 bp, Homo sapiens
ctggagatgatgatgccatcgaagcccgggccagggcctgacctggcaggcacacacctggccagtggctctgaggtccccggggaccgagtcccctgcgagggcaggctgcccgaggccacacctgcccaccttccctactccaggccaccagctggtgtcagattgggccaccgggagagaacaggcctaggagggaatggaaggctggcggggaggctgtcatccagaagcctcctccccagaggtctccaggaggaacctggctcaactggggggcagtggtttacttttcccttttttcttcctttcttttgtcctctcagctgcccacagccagaaagccaggaccacccgaactggacagggagcagggagggaggagtggtcgcacggagcgtacctgattcaacaggaaatcagttattttctaaaacagcccctaccagagcctcctgaactctgtgggcaccacgtgctgctgtgagcatctgcccagacagtgacccgccacaggccccgggcgtctgtggaaggagttttgtaaaggaaaaaaaaacacacacacacaaacattttttcaatgtagcaaaatcaaacttaaaaaaaaaaaagaagaaaagaagaagatgccgacagtgcggagtctagccttttgtaaacttcatattgcacactaggactataagccattgctagctcattttgaattttaacgtgtaatttttgttttattttctttctgtggggaaacaatgcttgatccaccaatgctctttttaatgttttataactatgtatgtgtatatatataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtg

SEQ ID NO: 51521 - DNA, 1047 bp, Homo sapiens
ctcctgcttgctaagggcctgtggcagcagcgcttcctggtggggccgagcacccatctgcagtctgtcagccacatccacggtggcgcccatgccacgccagccagggcctcacggcaccccgccagggctggcagcaccatccttattttccgatccaagaagttattacagccatccttatctataatcctgaggtgtggccatggaaactacttgtcccagcatgcaatgctctgggcaccctgcatattgcaatccctgtgcaccatgcagagctcctaaaaggaggcaggaatgcatgctgggatctgtagtctccagctgagtcatcctgttgagcaggacagcagcccaggccatccctcttggtggtaccgctggtcgtgggggagtgaactccaacacaagtgaagtcaggacaccagcagggagggcttgagaatggcaatgaccttctgggctgtggtttccttccagcgatccttgcctcgccacggactgcaagtacgccaacaagttccacttccactgtctctttgggaactgcaagtacgtctgcaaaacgtctggcaaggccgaatcccactgcctggaccacatcaaccccaacaacaacctggtgaacgtgcgagaccagtttgcatactactctctgcagtgtctctgtcccaaccaggtcagcatggcggtacacggcgcaggggcagagtagggggcagggaggtgcagggctagctcagggcacaggacagtcacctcctggcagaggctccatttctcacaccttgcttatttaaatgggcctcccggactctggaaagagcaccatctgcccctaggcccctggagacccctgggcaggggtccagattggtgctagttggtgaggtctaacccccgagtggtgactcaatgctgggcagccaccgtgcccttgacatcattcttgcctatcctggaactagctttatgccccctttttccaaagccctagaattttcgaacaggcccattgtccgtgcccacacaggaaagtcagatcag

SEQ ID NO: 51522 - DNA, 1071 bp, Homo sapiens
cttgagtgatggatcccgcggcacgggctcatgtggaggagccctgaggaggcctcgcagctcctggggtcggggcagcacagcaggctctctgttcagagagggcccagccacagccagagccaagtaggcgggccgcattctctgctggctctgagggctgggtgggtcccagcagcccagagcttcggctgttgctccccaggctgccgtgtctgtgttctaagctaccccagccccatgctcggcctctgtccctcacagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtgaggggctgctggccgcgtccacccatcgtccccccgcacccgccctggagccccaggctctcctctaacgccagctcctctggctaggtttggtacaaaggacttctgtgacggccagtgtgacttcctccacaaggcccacttccactgcgtggtggaggaatgcggcgcgctcttcagcaccttggacggggccatcaagcacgcaaagtgagtagggtgctgggggccatttccacagagccccacggatcccagcctggctctggggtgggtggggctcaggctggtacagcagttcccgctgggccacagaagctgagccggcttctcggagatgctgccccagcaagggtgggcttcccatcctccttcacacatgcagccctcagccgggggctctgagcccctgtccaggcccttcctgggaccctgagcaacagctgctgctgcacccacgtccccagggcagccatcagtcccagcacgtgctccctgcagagcaggccagaggggcacagagcccagctggagagactcggctgtgacctggagcaggaaccctagctgaaggcctttccaagccacaatattacatctctaggttacctttgacctaaacataatgaaatgaatttgtaaatcccat

SEQ ID NO: 51523 - DNA, 1039 bp, Homo sapiens
agggcagtgggctgggtgggccccggctactggtcagcgcttctcccgctgacgtgatcgctcgcgacgctcgctcctgtgtggcaattcttcaagtgataattattgcaaaattatgtcaaagttgtcctggctcagggcctcctggaggagaagggcgggaggctggggagggggctggggtgggggcgggggcccttcattttctccaccaactgtcacagtcgatttgtggggctgccgcttaggcttttattaaagactctgttaatgctgagggaaagtggcagatctggactgggagggcccctctgtggtccccagcccgcggttgctggggtgacggcccccgcacggagcatgcccaggaagggcctctgctgtgtcagggcgatggggccgatggccaatcagagcggccacaccgggtgacctcgcagtcaagctatccggggcagggacacgaggccaggctgggccgagctgggtccggaagggagctgggcgggtgaggccgcaggaggccagcagagcaggggtaaaagaagttgctgacagggccatccagcgagctttcccctacaatcccccagtgacggaaatatgaatttgccccaaggtgctgtagctgacagagtgctgcttcagaaacagcaagtggcattttattaaaaaataaaacggccccctcccctgtgcttgatctttcttttgggagaaggagacttttctaatgaaaacaaagtacttgacagtctggccaccgagcccacgtggccctggagtgggccctgccccatccatcaggcacctggctggaagggcgtggccagcgaggccccacccatgcctggaccaggaggcggtccctccacgcggccaccgggcatgagcgtcctattgggcctgtgagagttttcagaccttgggacttcacattccagcagctctccaaagtcacctgcccaaggtcccaggaaaacggcccagctcccctgccaagcactggcagcctctgcaaggtgtgggcagagcccca

SEQ ID NO: 51524 - DNA, 1048 bp, Homo sapiens
gggtgctgaatgcaggcctgtggttggctgagaaggcgccaccctggctggggatgctgggtccatgctggtggccctggctcctgggctcagagcctgggccctgggggaggcaggaagcaaaggtagtgaccggggttaggtgcatacacccttacagcctgaacccatgggcaggggaacggcctgggtagtcaagtagtggatggtgtggggctgagcgagacccttccccagagctcctcctgaaccctgggggggctcccggaccccagggggctgcatgccttggagcagatcagggcggcccctgctgcctggggaaggatacacttcccctgcccagctgcctgcccccacctcgaatccctccctgttgggaggcctggtgcccctcagccagcggcctcctgatgctccctgaatgctgggtgccgagcccgggcttctgtggcttgccagcccgtgcccaagggggctgcagccccacctgcacgagatggcactgccctcccagagttgggctcgttgaacctctggccagcttctgccagggatgtcctcagtcccaccgtgggtgcctcggacactgcagagcagagcagaggggctggggcctcagggcaggggctgcccaccagatgcccctgtaacacgaggctgccccatctgctcaccggctgtgccctgtgtgtctcttgccaggaacggactgcccacagataaaccagccgtcactgaagatgtaaacatttaccagaaatatattgccaggtaggcccctggggaggagcctgccgtggagagaaggtggggggccaggactgaccgggcactctgaggccattcgtttgatatctgacctctagggccaaggtagctgcctcctcccatccccatccacttcggtccctccaccgcaccgagggctgccctgcacgcccgtttgggagcctccctccgctctgtgtagtccaggccacacattccctcagcagcctgtgcccccagttagggccggggtcccgacgcagggcctggccacagg

SEQ ID NO: 51525 - DNA, 1035 bp, Homo sapiens
aggaacgtgtggtaaggcaggacgctcccaagcggaacaagctgccaggaatgccacgctgtcccttgacagcctgaccgcatagccggctccttaacctccctgggcctcagtttccttgtgtgtcaaagggcacaccccctcccagggcccagcaagcctaggaaatgcctccaggacctgggcgccccttgtagttgaagaggcattcattcattcatttgttcatttacagactagttcttgaactacctactctgtgccaggcaccctgccaggctcagaaagtagagtgattctcaagcatggccacggagctcatagactagtgggggagatagacacatgccaggcagtctcagggcagtttgatggcactgtggtcaatgggggaggcctgcagcttgggggatgcagggctgttcgggagggtgggttgttcttggccttgcacgcctctgacctccgtgctctcctccatccctgcagctgagggcacccggtgcacggacccgcctgcaggcaagcccgccatggcgcccaaacgcaagggtggcctgaagctgaacgccatctgcgccaagctgagccgccaggtggtggtggagaagcgagctgacgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggtgggtgcctggccttcgaagggaggctgaaggccaggacagggaggccagtgggga

SEQ ID NO: 51526 - DNA, 1021 bp, Homo sapiens
ctgacacccaagagtgtgggcccccaggagcagatgcgagttagactccaggccgagttcccagctcttagactgtgtggtcagcatcgtggtgtctcgcgataggatgaccaaccaccccagtttgcccagaactgcaaagacccatgtgtgtgaaccccctcagtcctgggcaaactgggaggcttagtcagccctgtttggaggcaggaggatgggctacttgacatggtcccaccctcagggtcctggagagcccaggcacctcctgaatggaccatgtctctgttcaggaggaggacttgcagctggctccacttaaacccccttgcgctaccaaaacttgcttccaggccgctgcgttccactaggcgcgtgtgctggggcaggcatgctcgtgtcccccgctccccgccccctccaaggcatggcagagcactgcttggaagcttgacccggcctagaaaagggcttgcagctgtgatcccacccctttaacactgagccttctccccccaaacatatcacagtccagacggggcttctggagaggatgcggacaagggaacccccacccccaagcccctcactcccccaccaccgtaagtttatcagcgccttccttccgagagagccacacctaacatatcatctctcctcatcagttcccttggaggaagacaaggagctgtcccatttcctaagtggggaagctggaggcccggagatactgctgggtttgttcccaaatgctaaatgtcagaggacttggtgcggggcgcccctgagcactgttccaaatggcagcactgagtgaggacacacaggcctccagccctaggtatctaccgtgctgcctggcccacgtccccaaacatctctggccccgatgtgtaccccacctgtagtctgcaaacacatccctgggctgcagggatgcaagataaaatgtagttgttgatgcagatgcattttgagcttctgggggaaagcctccttttctagaggcatcccggagtgc

SEQ ID NO: 51527 - DNA, 1113 bp, Homo sapiens
tccggccgggccagtttggatatttattaagaaaaagccaaagataattaacttttttgtttttgttttgtttgcgggtgcctcccctgctggcactcctggctgcctggcaaattaaacctgctcccggctccctgggtgctgggctgccagcaagacttctgccgactgtcctggatctgccagggctgccagctgcccacccaacaacctaccttggctttcagaccttgggtcactttatgcccccaccgatgccacatccccaggctctactgactctgagagcaccttttagagcagggtaagtgggatgtgggggttgggggaagaggaggggctactgtttggggttgtggccagcacttccctaaaaggaaatggggggaaagtgtgatcctctcccagggcacaagggcgttcctcctggccagttcagggccgttgacttcccaggagaggggaaggagaacggaggatgagctggaagtgcagggagaggccagatttgggccatgtcgatccccagctcttctccccgaaggctggtaccctgccaggcctcatgggcccctgagaacgccctggagcaagcagcctctgggccatggagccatgtgtgatacctgtccacccccaaccccaggctccatcttgctcccacccccaacccaggccaggccatgggtgggggagcggtgggggagctgagtggctggagagccagtgcttgggtaagagctggctgcctccggtccggtccgctgtgctggagccacacagagccctgaggccaagctgtgacctaagcctgagcccaattcatgggccaagaaggtgacactgggagttagaggcttcctggtatgagacagagctgaggacttctcaggagccaggagagcccacgagaggaaggccagtttggaggagctcgctggggttggaggtgcggcttgcccctctgttaagccagtccccctcagccctcccctgccagggaccctccttggccccttggcttcatccccagctggacaagtaggcagtgatggtgggcctcttccaggtggggagcctgcttcggagccggccacagagaagagggcattt

SEQ ID NO: 51528 - DNA, 1027 bp, Homo sapiens
gctaatccttattgagcactgactgtgtgcgggctgagtgctgtgtgacaacaactctattcaggaagtgctaatatgatcccccgtctttcccccactttttaataaccgctttattgagatatcattcatataccataaaattcacctttttaaaatgtacaattcagtggtttttaggatattcacaaggttgtaccatcatcaccactatctaattttagaacattttcattcccccaggaagaaaccctgtactcattagcagtccctctctgtcccccactatcagcagacctagggttccactaacgatgatttcctgaagatgctgggaaggtagagggtcagtgcctgggttcagggagcagagcctgtagaagatggagctgcggtgtgaacccaggtactgagactccagagctggtgctccatgagggattgcttgatgtcctggctaacccccaccccacccctgacacacatgtgcctatcatgtgtgtctgacagttcaggctcaggcgtgtacatacaccatccaaacacctagactcaggcagcagcacacgtgtcttctccccaagtacgctggcagctccacatagaaaacctcacacctcccataaggacagcgggcctcccctcctgggacccctcccttggcttctccccagccctgctcctagaagggaggcttggagcaggaaccagcagcaacagggtaactgaagtagccagagaaacctaagtggtttcagagcttaaaatgagaaatcccatatcttctgcagctgatcattgtaactgagacaaaatgccaacccaacattccagaacaggtccccgcccgggctggggccacaggctgggccaggcccacagggcaacccaactagcccaggtccctgcttcatactctgtgtgtgtgtgtgtgtgtgtgtgtgtgtgtgtgtgtctctatctctctttctctctctgtctctctttctctctctctctgtctctctctctctttctctgtctctgt

SEQ ID NO: 51529 - DNA, 1045 bp, Homo sapiens
aggatctgagtgccgtggaaggctcctcaggatgccccaagctgggaccagttcctggatattggcttcccacgccgtgccttgttctctgtcccttcctttgctctaccctctgatcacgagaaccttgcttcctctagaaacctccgcccatgaggtcctgacagggtagataactccgtccccaggcagcagggtgaagccagccattccgtgtcctgaaattcagccccaagtgcttccattctctggagcagggcttggcagagccctttgacccacagtctgcttttataaataaagttttattggaacacagccatgcctatttattcaggtattagctatggctgctttcactctatacttgcagagagagttgaatggctacaacggagactgtttggctcacaaagcctaaaaggttaatgattttctctctggccctttagggaaaaagttttccggcccccgctcgagaggttttagctcctgcactttagggggcctcggagtctgaccctatggagaagggtgggctcctgattccagggagcaccttgaaaaaaaaagccccacaggtcgtggactggcagccctgggtcttctatttctgtgtcagggccctgggaagcagcataacctctgagcgccagtttctctatttgtaaactgctgtctgcttcccaggcttgtggcaaggaggagctggggtgcctgggagaagctgtgaaggttgagttatcgggagctgctgaggggcaagcaggctgagggggtagtccaggtctgagactgggcctataggtggtgggtgggaaccaggctgcagtctggctgagaaggccctggaggttacacagtgggtgctggctctgtctaggaccagggaccaaggccgccctggcccggttctactgctgtgggccaaggtgggaatcaggctccaagcccgagaggaaaggctggaagggagtgggcaaggagacgggagctgcggccgcggccagaggtctgctgcagagtctgctgggcctcctctcgt

SEQ ID NO: 51530 - DNA, 1017 bp, Homo sapiens
gtccttcaggacagaaccgtaaaagcttcccaactttcagagggtgggcactggggcactgttgggctgtgctgaatcccctgggcccgggggttcaaggagctggggtgtttgtgagcttctgggaggctgggttgtttttttttttcttttctggacttaaaaggccttgtgcaaacctggtacccagaatagcacacatggagagttgtgaatgaagagctggatggccgatgacctggagtgggggctggggctgggctcaaacagcaggtgccttatggctctgcagcccctgcctgcaagacgccctggtctcccagcttcccacaggcctgggacggtcgcgggcctctccctacccctggccacctctcccttttccctcttccttctccaggctgtttccatgccaccctccctggtgggctgggcttgacattggcgcccatggctccccctctgccttcgtttcagtcctcctcactcacaggctgtgttctcttccagagtgggtaaagtgaaaaccttgccagtcacctctcccggtctccctcccctccgtcctggctttcgtgatagagaaactggccaggaagccccacatggtgctatttacctgacacctcagtgggtttggcaggtgctgattcattccctgaaccatttcccccaggacacggagcaggccagggaagaccccctgggcctctgaacacccccatgctagcctctccctggcctctcttcagggcctgggtgattgctgcagcaaggaccccccagggaccagagcggccttggctgggcctcatcttcatgtctcctttcctgggtgccctgggcagctcctgcaggaaaggaatgctaacgatctgctggtgtagtgagctggcaccgcacccaggcaggggccgcacagcgccagggcctagtaaagacgctggcgagggctccattccccgtgcccggtgtttcctctggccggattggcatgcagccttcagcttggcctga

SEQ ID NO: 51531 - DNA, 1046 bp, Homo sapiens
tctcatggggtggccggggagagggagaggagccacctgggcccggctgccccgcagtgccagcctgtgaatgtgtgcatgctcctggcccacagctagaagagcctggtcctcctcccccaggaagcccccctgcagccgtcttgcttcccattagcgccagcgcaggcctgtcttgggccctctggcctcccgccctgcagcggcctagtttcccattggccacctgccttcaacgccgagggcctggggggcaggagccgcaggccggccgccccctcctccccaccccttccctctcctccccactccccttcccccagctgcctcccaaccgcctcccccagcatggcagcctgtccaagacagggttttgtcccctcggtccgggcaccgtgagagtgacagaaaatagctgtccggagagtggggggggaaggcctcttgttttcacctctcaggggctggttttcccaactttcccatcccagctcctgtggaacaaagggcctgcggcccccgtgtgctgggcccggcccagcgaggggactcaccagcaactctttattgagtcttcaagcgccggccaggcactccattaaaaagccattcccctttgtgcagcccggcccccagctgtcccccctctcatgtgacggtcggtcacagttgtaaaacaacaacacacagagttggcaactaacgaggctttttttcaagccggggtctccatggcaacccccgtcaatcacccctcaggagcgctttaacctgaccaagagggggaaataaaaaataaaataataataattaaaaaaagaagccaagaaagaaagagttggaaagagagcaagaggccagtagacagctggggagagaaacaattcagaaagtttctggggtttgcgccctcgattggaacacaaatgaaaatttaaccagtgggacaggattgtcctggtgaccggaggggaaggacgttcattttcatttttagatagtttgcacattgcacctagttttacaaaagcttctgaccttttccc

SEQ ID NO: 51532 - DNA, 1056 bp, Homo sapiens
gggccagaggctcagagggtatgggggtagctggtggagtagctggagcctcctggggcaaagggtctgtgtgtgcttaccttgcgttaggggaatggcactgccaactgggtggccatcacatgccatttgtcactccatggacttctgggcgtccactcctggttagcgggggctatgaggggagaagccatggggtcatccatcttgcccacatgatctcagagctacccaaccccacatgggccctagagaaggggcagggagtgggagcctggaaaacggctcctgggagtggggaaggtgacatgtgcatcctttgctccatggcccaggagccagggcttttggcttgatgggcagactttccagtgggtcaaaggccactccagatctgagctttttcttttccctgctctctcacctccaggggtggtagaaaaagctcaccctccgctctgtccctctgccctgtggtggccccaacatgaggccagacatgggctggggtctaggacggctctaggagaaggtcccgggtccaggctggcccttggttggggtgcaaggtgctgtcttggttctgcacctgcctccagcagtaggcattgccagcctttttagcagacaaccctgatgccagacccaggcaagggggccctcatctgaagccatggggctgggaaggcagaagggatcccgcgcagactccttcctctgggagcttctcctactttcattttctttttgccactattttttcctggggtctaattaaagacttggagccgtttacagcctgtggttggctttttatttggatctttggcaattacctcctgccctaaaataagtttcgatggaacaggggtaggatttttctttttggccgagttctcagctttaattttgccgtgcatgcgtgtgtgtgcgcgcacgtgtgagtgatggagtgtaatgaggcccttccctccccgctcttccaaatcctgcctccttgtcactctcttcatctcaagtgtcctgtggccaaggcagaggcctggacagcgggaa

SEQ ID NO: 51533 - DNA, 1011 bp, Homo sapiens
gtttgagtgggtcgggctccttgcggagggaactgcttctctccgacaccgttttcaggagtgagcctgggagcaggccaggacacacactatcctttcagccctggctctgcactgaagccagctttgtgtgtttgctccctgggttctgtgctgggtctgagattgggtctaaaagttggctgagtttctcttactgtggctttgaatgtgatctgtgcgctcaagggctgagcttctgcacacctttttccacgtgccgggtcatatagagcgtcgttggtgagctgtgagggctggcagatgggtttgtctgaagcccccatatttccatggggtcagctcagcctccagccgctgctcatctgctcatcggcagggatcctaatagtgtcgccacacacaaaggtgtgaattgccccagtaccccgctcgcctgaaggccagtctcccttttcccagtgcctctgacatgaggctccactctcctgggtcctgacaccatctgtgagggccaggttggggcaggcagtcccagcatcgatgctgtgatagcagtgatccccagcgcccctggacaggccccatgccgccctgggcactgccctgtagccctggagcaagccagaggcctggttggcgagcgtgaagctgtcacagccggctgccgggctcgcgtgagcacttgcccttgctggcaacgtattcccagccatatgggccagcccagccttccaggaacactctggagacctgacctccatggaggtgacaggaagggagggccggtgatgtcttgcgggggcgagggtggggggtgcatcggggatgtcccaagtgggaagcaatgtgtggcacagcagcctggccctgtaaggaggctctggaggcctgacctccagaggcagcaacgggagagagcagaagtgcaggctggcagcggcttgcgggagtggtggggctctcccaggcctacagctggtgcctctgcctggctccgaggggcgtgtc

SEQ ID NO: 51534 - DNA, 1337 bp, Homo sapiens
agaggctgctctgctgtaagctcatatgtggtaggagctggcctggggatgatttatcaggctctcttcagtggtcctccggcccaaataggacccttcatagaggagaagctgtaggtgccttttgacccaggcttggaaatagccctttgcgtaaggcaggtcactcatgccagggaggggtagtctgtggagctggtactgtcagatatttacctgcaggtatcaaacgtggcagttcttggggtgaggggttgacacacattgggtgactcattgcatgctggtcattattcagtactttcttgagatcccaaggaaaccagtccagagggattgggtgtttgcgaagttcacgggcaaggtctaggggtggaagcagaggctgagggcctagaggatgtctggggagggcagggccgggggctgctcttcctatgtgtgccagcctggagccggtgtccctggctcacctgcctgcgctcttcctccccatggtcactctgggcaggtgtgtcctgcccctccctctggggctgggctcagcagccctggacttcgaacttgcagggaggaagcgcttgcagagacgggagccttggtgcgcactggggtttggtaggtccctgaagctgcagacctgcctgaatccaggccatgcctcctcagggaactagctctggatacagcccagagatttgcaaatcagatgcaaatgtggcctttggtcgctgtggtggggcaactgtgtggctgcgactcttcttcctggtgtgcagaaggtgatcatgctcctgaagttggtctgtcgtacttaggatgtgctgccgttgtcccctggatagcaccggggctgtttagactgtcacctggaaaaggccgtggggggagtttcgtggcgctgaagtcttctgggcttggcgttagcacctgcacctctgccaccttcccgggctattcttaacagactctgcttcctctgatgatcatgaatcctgggatgcaggctcaaatatatgcaagcctcagggtggtcttgcccagccctgccctgtgccctgcccatgaagaggctgtgagtgcctgcagagccccctcccctctgagagggtaatgtttgcctgctctgttctcagtgacgggttttttgttttcttctttgcctgggcaaaacacgcctattcgtttttccctttctgaagtttccattcgctgttgactcccaggggtcatgcaagcggggatttgtacctggtgtggggtatgggatccacaggtccgatgggacacctgtatcctagcatcggctgtcttggacttgataatgaagcttggga

SEQ ID NO: 51535 - DNA, 1027 bp, Homo sapiens
tcaggggactctttctggaaaaggctggtggagtctgcttgtttggggagctatgctgggaggatagtggtaaagtcctcggctcaaatccctagtctctccttattgggactctgactttggaatattgtgggctcttctcagcctcagctttctcacttgtaaaagagggttcacgatagcacctatcacttggggttgctgtgaggattagatgaaatgacgctggaagggctcctggcacatggtgatgaggggtagctatcgttgctactagtactgtctctactccaccctccccatctgtcatcatgaaggcagtaaggcagagggctccctgtgtttgagctccagagacccccaaggccaggctgaagcgtcatcccagaggctgtggccaccacaagtctgttggagcatgttcgccaatagcaaggcaaacgtgtccgcccagtacagagccctcgagggagcagggaaaggcttgcaatgcccagggctgagctgttggacgtgcaggtggcagtccctgggctggcctggactgcctgcccagggaggagctgactcccaagcactggcgccatcttggttctccttggcttctcctcgcagacgggagtgtggcccttgcccttccccaggagcaggtggcctttgcagcctggcacctgttcccagagggtagctgccaagaaggcacaaacccagggatctccctgcatgtcctccgagtcattgcacaaggcctgtgtgctgcctggaggggctggcctgggcctgtgctagtggagaaggtcgaaggaggagcttctctcctcccagagccccctcctcgccctccaggcaagtcacaggagagccaggaccagcatcctgaggtctgtgtcctgggggtttgttggggtggggcgagtaggggagcggggagacaggtgaaggatgtgaatgaagttggagagggggtgcaggagaagggtcttgcctctgtccctaaggggcagcaaggaagctgagttgattttac

SEQ ID NO: 51536 - DNA, 1034 bp, Homo sapiens
agccaggcactggggtctggctgcctcacacttggggtggagaatgtggcatccctcgctggcaggatggagagtcccggcccctctatgtcctggcttggttctgaggatgaaaggtccatgtgccccctggccccctccctggggagaccaggccctgtctggcgtggcctctccacctccgttccagagcacgtttcctggggctctccgggagaacggtgagaaaccagctcctctgcagccagtgtggcccgccagggcctcgccaatggctggaactcctcactggcttggccgggctcccccatgatgggctcaggtgcagccacatccccgcttgacaagcctctcagcaggaggggacttcctggagacttggcggggtcctgttcaggcctcacagttcctagaccttcagtcagggtgacagatggtcctgagaccagaagtgattcaggtcgttcaggcctcggggctggcggtgaaggagaggaggcatctgaggacacgggcagggtcagagccgggtgcgttggcaagactggacgtggccgccagggactagcctggacaccctctacaggctccgaggggagcgtggctggaggtgtggggtgtccagggatccctgcttcccctgggggaggctggggacctcgctgagcttgcaccactctggggagaatggaggcagatgtctggcctcttctcgccggtttggctgtttgcaggaatggtccaagccccttcttcaccaagagagaagtggagagagaaaaagcattagaaacaagaacacatgggctccggctgccctgagaatctcaacccaaagatgggttcgagggaccgggtgcggtggctcacgactgtaatcccaacacaataggaggccaaggcgggtggatcacttgaggccaggagttccagactggcctggccaacatggtgaaaccccatctctactaaaaatacaaaattagccaggtgtggtggcgtgggcctgtaatcccagctactcgggaagctga

SEQ ID NO: 51537 - DNA, 1066 bp, Homo sapiens
gaccggaggaactggagcccacacagagagagtggataaatggaaacagctcttcttgtgccaggcactcactcttctaagccattgattccccttatctcattcagtcctcaaaataggtactggtatgcctattttccagatgggaaaactgaggctcaacatggttaagtaactcactgaggttgtacggttggttaggaaatggatgcacccccatccgcctcccttgtcccctccctggcagactccagggccaggaaccacatcaccactcagttctcatgatactgttgttcttctgccagttccagccagtatgtctgacacctcacttaccttgtaggtgtgggatctgtcgggtccagggagtgaaacattgtcacagaagaaagaaccccagggccaaggaaagagggtttgtgtggtgtgtgcctgttaccagcagtcacaccctcatggtgcctcactcacccacacactggaagaagctctccactgtccagaggaccggggcagccatctcggcaaattccaggctcaggtctaccctatagaaagcttgtgttcccggggttcctccgacttcttggcatcgctgtggggccacaagaaattagttgcacattggctgggcgcagtggctcacgcctgtaatcccagcactttgggaggctgaggcaggcggatcatgaggtcaggagatcgagaccatctggctaacacagtgaaaccctgtctctactaaaaacacaaaaaattagctgggcgtggtggtgggcacctgtagtcccagctactcgggaggctgaggcaggagaatcgcttgaacccaggaggaggaggtttcagtgagccgagatcgcgccactgcactccagcctgggcaacagagcgagactctgtctcaaaaaaaaaaaaaagaaaagaaaagaaaagaaaagataagaaattagttgcacatggcaggggcatcccatgccctgtggctgtcccctgatggggctaccttggtaaaagcacgggcctgaggagcatacatggtgaagtccattttcagccagcg

SEQ ID NO: 51538 - DNA, 1087 bp, Homo sapiens
tacaggcgtgagccaccgcgcccggccgatgattttactttttattcaccccacatcccacccctactccacacacacataccccaacaccttccagcaaaagcaaacttctctttgtcccgagcatttctgaaacgcatagccaaggttgggactgaggagaggagaggtgggatgagacagaggggaataaggtgcccagaggagggagaaaacagaccagaatgtgatgaagttggaaaggtggacattaggggcactcctgggtcttacccggtgggcaagcagcttctaaagaataggcatggtgaccgctcaccagccatagtggcaggagctcagcagaggtgttcagcacctggggaggaaggggggtcccccctgaggtctccaaaactgctccttccagatgcagactccctccacaggggccccctctcctaccttcgaattagtctctgaactaaagccccaagtgttacaaagcccaggtcagggattatggcgccgatgcaactaggaaatattatttagctgagatatttttagcaggaagcgagctcagagcaaatgtcatgtgagccgtcttctcttacacagcaactttgggctatttaaagagacggtaattacgctcctgccgccatgatcaggacgcactgaatgcatgattgcaggagcccctcatctgcagagcggagcgctttacgctaatggggcccaattttcgaaggcgcctgcctaaatctgtccagtctcgcaggtggacatttgacttgtcactggaggggtggcaacctgctcttctaggtgctatgccccagaggcccctcacctcctggcagagcctgctgcccaccactgacctcccacctctgaagaaggccttgtctcgggctttggacggtgacagtggtggcattcatgtccacatacagtcccatcaggctggcgtcttcaagagaagccaccagctcccctcgaagggacagcagccatggagtctggagaaagaggacacgatcacaaaccatgtggccagggaggcacggtcactaggggttacggagaggggacacttgaaggg

SEQ ID NO: 51539 - DNA, 1062 bp, Homo sapiens
ggaggtgggctggcggagggaggagaagacgcactaggttgcctttcagaaaaggggtccaggccttatcctgcctcccaggtggactcggcccgggatcccgagccccgccccctccaggccccgccccgccccgccctcgctggccgagactctgtgctactctcgcgcgctttgaaagtgcgcgagctccgaccgagacctgggccggcggttggtcggccgaaaccatctgctacgttacgtggggggaggtcagctcctatacagccacacttttttcaatcttcagcttttcaggcctaggtcctggttttattttagctttcagagcttctctgtaggcttgaatttccaggaggcagcccgagtccctggggagagggtcatcgtggctctcgtcggtgccttccacctctggacaggcaaccggtgggagaggacgccggtgggcggggggaggaggcggccctagcgccattttgtgggagcgaagcggtggctgggctgcgcttgggtccgtcgctgcttcggtgtccctgtcgggcttcccagcagcggcctagcgggtgagtcgcggagccttctcactgaggacgccgtaggtgcctcggcttctgcattggggcggcccgaggcagacgcagcggcttcggaccctgccccgggaagtcagccgtgagaccgggcctagtcctgcccgagcgggctcgcgcgggagcgtcgttaggtcctggcacggggaggccggtggcgccgaaacggggggccgggcccgcggtgccgcgtagcctgaggcggaggttggccccggacccggacagtgccggagccttcggtactttgtacttcgagggacgctgccagcttgggcctggtgctcctgcgccccaccccgggccgcgccgagaaactcctccctcggctggcacgcgcgggcttctgggaggcgacggccggcaccgccaggacctgtcgccgcgggccttggggctcgggctcgcagagcccccggaagccccaaaatgaggaacagagggaaacttttctcctgttctttac

SEQ ID NO: 51540 - DNA, 1380 bp, Homo sapiens
ctggttcactgcccatattcagtcttcaggttcagctgatggatcgcttgcttaggaaaatcgactgggacctatcacgcccatgcctcagccagttaggctcctcctctgccttcaggattacttaacgactaacccgattgtcataaaatagctactgtttattgttcccttgcataccctagcttgtaaccagcaagccacgttggactcacagttacagtttcagtacctgacgcatcataagccttcagggaaagttttttgaatgaatgaactggcgaggcatcacattttgataggaaatcactacccttaccttcacctcgtcatttttcagggataaccaatgcatatacgaatccagacaagcatttttctggaagtcagaactctgacatggtttgggtattatcattataaggaaacagttattctgacatgaatgttgttcattcatatctcttttctctttaggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggtttgttaccatttggtttttgtaatcatgctgaagtgtgttcaggtgtgtgtctcatccatggatcttagcctcttttggtggcagaatgtctcctgaaacttaagtatttccttgaacttcagtgttagacaagtttggaagaccacgagtctaaatttatggaaactggggattgtagatcattttaaaagagaaaacaatgtatttaaaaaatatctgaataaactttgccaagttgatgataaatttcaggaatcactaagaatgttttgtacataaatcattgttgtaaatagattcttctgaagtgcttcagtgtttggatttgatcattgtccttttggtgttacatcattcattcagcaaatctgagttcattttttcccttaaatgagcaaacagttggagtagccaaatcttgaattagtgcagttccaattacaatttcgaggttctggtcttatccttctctctgcctcttatcaatgatgttctaaatctaagaaaaggaagcatgaagtttaagaagtgtgccaaggaaatacctaatttcagcattttgaagtagtgtgctgttagtagtcgatctgtctgtgtgttccttttattataacttggtattgcaacaaagtccatcaaatttggtcagt

SEQ ID NO: 51541 - DNA, 1019 bp, Homo sapiens
ctctgttgcccaggcatattgcagtggctattcataggcacactgcagcctcaaactcctggactcaagtcgtccttcctcctcagcctcctgagttgctggaacttacaggcatacacaccactgtacctggttttctgttttattacaaaagttgtgtatttgttgttgaatgtttaggaaagataaaagttaaatcttcatcaggatatacaagttgctgatatttaaagtcaaagtgaagtagaattatttttgttttgataaaccttttgagagggagagattgtaatccggaaatgctacaaaaaacaaacttggaaatcactgaatttgcaccagaaaagcacctcagacactaaacttaagcctttattctgtcctctagagcaaacatcacttcttgccaagttttcagtgtcttattcttcttagagtcttctttttgcttctcatttctagatgtaggaggtagtgtttttaaagaagtgctaagtgaagatttctaaaaggtttctgctcgttttatttagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtaaacttcgattgcatcaaacagtttttctttaccagtgaatgagtatctagcatttatttattggtataaatagagatggggtatcactatgttccctaggttctggcgtcaaactcctgggcccatactgtcctcctgcctcgaccccaatgtgctgagccaccatgcccagccacaatcttgttacctttcttttttttttttttttttggagaccaagtctcactttgctgcccaggctggagtgcagtggcacgatcttggctcactgcaacctccacctcccgggtttaagtgatttctcctgtctcggcctcct

SEQ ID NO: 51542 - DNA, 1076 bp, Homo sapiens
tgggactacaggtgcatgccactacacctggctaatctttgtattttttgtagagacagggttttgctgtgttgcccaggctggtcctgaactcctgtgctcaagcgatccaccctcctcagcatcccaaagcactgggaatacaggtgtgagccaccgcgcctggccccatctctcttttttaaaaaactcaaaaacatttctgttgtataagtgagttttgctctgttgttaacacagtatggattcaatattaacctccttgtttttactgttaagactaacttggtttaagttttaagccactgcatccagttgaaaccattcaaattgttttctaaggaactatgatttgggaatggagtgtgtgagtatgtgcacttttagagtaaacttgtatcatcctttctaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaaggtacttgcgtctgtgctttgggaatttttgccaacaaacttccttagaggattgtaagataaaatgttaaacacacttagaaaagatagcggcagggtgtgttcatgaaatccttttgtcttgttgaagtctttggcccttagtgcatgctgaatattttatgcttgtttgaaatatttagtttattacttctccaaactaaacctttgttcattttgttcttccttttcgctatggatggaaaagagaaaaggttatttgtcaagttaatagtttcttacatagttatatgttaaaacataaagagaatcagaatacatacattaattgttataaagacctaactttttccaagcaaacaaataacattggcttatttggaacatcatcatctttgccaagagattgcttatttattaattttctcaaatccaaacacagtcatgtatcacatggcaaagttgatcagtcagcagcagacctcgtgtacagcagtggtcccataggattataacactgtttt

SEQ ID NO: 51543 - DNA, 1085 bp, Homo sapiens
atcttggctcactgcaacctcctcttccgggttcaagtgattctcctacctcagcctcccaagatgctgggattacaggtgcctgccaccacacccggctgatttttgtattagtagaggtggggtttcaccatgttgaccaggctggtttgaactcctgacctcaagtgatccacccgcctcggcctctcaaagtgctgggattacaggtgtcagccaccacacctggccacgatgatgaaattgtgtaatggctcatgatgtatttatatccatcattatgtgatgcatgactgtgtacttttgtaacttaaaacgttactcttcactgaagccttacaagaaaaagaaatgctgatggaaaaaattaagggtacgtctactttttaatggttcactgctatccaaggcgaatgattttgttatatcccttaccttaatgtttttttcattgttcataacatatttctgagtttttttcttccttttgatttgatcagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcaggtatttttctccttaacgatatgtcccggccgggcgtggtggctcatgcttacaatcccagcactttggaggccgaggcgggtggatcacgaggtcaggagatcaagaccatcctggccaacatggtgaaaccccgtctctattaaaatacaaaaaaaaaaaaaaatagctcggtgtggtggtgcacgcctgtggtcccagctactctggagcctgaggcaggggaatcgcttgaacccaggaggcggaggtggcagtgaactgagatcacaccactgcattccagcccagtgacagagtgagactctgtctcaaaaaaaaaaatatgtcccaggtaattaggtaatttctcttgaacattgcccatgcagctaattgctattcttagctaagttttctgaccttgtaagacgt

SEQ ID NO: 51544 - DNA, 3492 bp, Homo sapiens
cagcttcagcctcccaagtagctaggacagatgcatgccactacgcccagctaatgtggcttttttgtggttttttttgatagaggtggggtctccctgtgttgtctaggctgccaggctagtcttgaactattggcctcacacagtcctcccaccttggcctcccaaagcgctaggattacaggcatgagccaccatgcccagcctatgtcttttgaaaatcgactgaaatatcactgctgctgttaataaaactaaaagctgtattgggggtttaaatgaaatgagtgttcattgcttatttttcctctggctttagataaattaatgcttgtaatctaagttttgttgctactttaaatatatgaatcagtggtttaatcttctttgtttacatcccttatttcttatagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacataaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagc

SEQ ID NO: 51545 - DNA, 3297 bp, Homo sapiens
aagttaaatcagcacttaagttgtgtccttagtaggaaaaagtaggaagttaactactccgtaatccaagagataatgtgtaacagtaagaatgattttgttgttgttgagtatgagcaaagtagcccctaagtgtgtattagggttctgtacttaactgttgtgtgatgtgtgcttttgttaggcatcactgtgcccaagtatttcatgttcattgtaaagaggaaaaatacagatttctctataatgtcaccacttatttctaatgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggcttttgaaatgtattgccagtctgtggcctgccaccctccctgaacatgcctggtcttgcttaaaatgtattgccaaatagtccttgggaagtttatgttgtctttaacaatgtgaaatagtactactattcacgttccttttgtctgacaatttgataagtgaataattgtatcccaccattctgtagtattggtttttaacatggaaattttagtcaatacctgggctgaagtatcagtgtttccaacctacctacccaaaaaaaggattcaaggttattcctcaatcagtactgccataatatataaagcacttacagagatcaataagaacaagtttaaaaacaaagagcatggacaggcagtttacagaaatgccaacagccagtatgaaaagagactggctttttaaggtaatgaaatgtaatttgagcagtgacattacactgggtgggcaaagatgactgtcactctcgtggtttatgtccccttgagtcaatgggtaaggctggaattaaactggcaagtggagaaatgacagcagcctcacctggagtctgtttttttgggtggagcaacaactgccatgtccacagtaatgatgaatgcttctcgagccacgtcgctgccaaggtcttcacaggcatttctaaaaatgaagaatccttgactgcagacacgcaagttaaaaatcactaattatgttctcgatccagggaatatagttaataacttttgtgtagactccatactgacctgcttccccacaattcatggaaccccaggacactattcctcccacaaaccacctctctgtttcactatctagaaacaccagtgcccctccgctgtcacctctgcagctgtccttgcccccactttctaagccagcacaaagcatgttagcagttacacttccccttggatagggtggcttttcatatgcagcagtacatttttgatggtcaacaatcggtatgtcgacatacattagatttctagcaagaaaacccctttgggttaatccccatccagatgcagttccaatgtcatctgtcctcataaaggattcagcttcttttcttggcagacaaataggcgtgatgttgctattgattacaactttgttattcaatttaatcagtgctatgtcattgtcaaagccagcatcatgagtataaccttcatgtataaaaacagcttcagaccaggcttgtgtataatgaggtgatagtcttttcagggtgcccattcgaatgtccagggcggatgcatcatgtttttgctcatagacggcatgagcagctgttaggacccagttgtcatataaaagtgcacctgctgctgtggttccacctaatatcaggacttgccaaggaaaatcaccaggttttgccttttgccctccatatatacgccctcctgttgtgcgggctgatagtccacaaactggagaaagaagcagataggtagagagcctttgtaaaaatgtcaatcgtgtttttcttaaattatgaccgccttgaagtatatatttgatgtcaaccaaaaattatattacatgaattggtgggtgactacctatacaggcaagtgaggctattttaaaacatcacagttcaaacacctgataaaaccttttggtatttcttagctcctcagaaaatgagattagtgaaaactgacttttagaagttattttgttttgctaaaataatttggtctataagattgggaaaattggccgggtgcagtgtcacacctgtaatcccagcactttgggaggctgagatgggtggatcacctgaggtcaggagtttgagaccagcctggccaacatggtgagaccctgtctctactacatacacaaaaattagccgggcgtggtgatgggcacctgtaatcccagccacttgggaggctgaggcaggagagttgcttgaacctgggaggcggaggttgcagtaagacaagtcacaccactgcactctagcctggtaagagcaaaactccatctcaaaaaaaaaaggagattaggaaaattaacagggcaagcaggcattgtctgagcagatggactggatgatgtgcataggaattagaaggatataaccttttcattgtttctgttttcctacttgtaaaatgggtatttatgtaatcctaggaaagcaggaactaaagtcagtatcaggatttgcaaaattacttttacctttgaacatacaaatgttttagaaattagaatgttgcagttgtggctaggaccctgtggattccaaaattttatttttggtctagttgattcttccaaactaagttttattgtatctttattgcaaattaaatacgcccattaatgtagcatatatgtttgctgttgtggtagtgtacttgcattaatacctacagacgttgtgttagccaaatacaggtttaaaaaaactaatttgagccaaataacacaagggtaattaatatattactatctttctgggttttttttctttttttttttttttttttttttttgagacagagtctcgctctgtcacccaggttggagtgcagtggtacaatcttggctcactgcaagctctgcctcccaggttcatgccattctcctgcctcagcctcctgagtagctgggactacaggcacacgccaccacacctggctaattttttgtatttttaatagagatggggtttcaccgttttagccagactggtcttgatctcctgacctcacgatctgcccgcctcagcctcccaaagtgctgactttttttttctttttctctttttttttgagacagagtctcgctctgttgcccaggctggagtgcagtggcgcaatcttggctcactgc

SEQ ID NO: 51546 - DNA, 1156 bp, Homo sapiens
aggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgatctctgtaagtgctttatatattatggcagtactgattgaggaataaccttgaatcctttttttgggtaggtaggttggaaacactgatacttcagcccaggtattgactaaaatttccatgttaaaaaccaatactacagaatggtgggatacaattattcacttatcaaattgtcagacaaaaggaacgtgaatagtagtactatttcacattgttaaagacaacataaacttcccaaggactatttggcaatacattttaagcaagaccaggcatgttcagggagggtggca

SEQ ID NO: 51547 - DNA, 1068 bp, Homo sapiens
acaggcatgtaccaccacacccggctaattttgtatttttattagagacggggtttctccatgctggtcaggctggcctcaggtgacccacctgcctcggcctcccaaagtgctgggattacaggcgtgagccacacctggcctaaaaatcatttaattttttatgcttgcctagttataaggtcaaagagaatcaaatgactgatgcagtcagcacctaacaacctctgtatatgggaagggggtaatgagaacatactatttggaaataataacagcctaagagccaagtgctgaagttacatttctgcctaccacagctaaagctctcctcactgtctcctacccagtcctcctttccatcaattaccagtctcttgtataaatgtatccattaccaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaatacattgtgtgtttgtagtagtcatttactagatctgttttcagatttttgcaaattgacattaaagtcactttagctataatatttcacttagcggatgggagaagtggcttttaatcttttgtctagccttagccaaaaatgttggttaaagtttattttcagaccatgggggctcaagttccaagtattgcccacccccaactttgaagaatttgcataccatcattcactttcattgtgtagaaggtctcttcacagctgtactgaatcacagctttgtaggtggtcactccaggacctgtgatgtactccactcgg

SEQ ID NO: 51548 - DNA, 1076 bp, Homo sapiens
acccccattcagggtctggcctggaggagcctgacccacagaggagacaccctgggagatattcattgaggggtaatctggtcccccgcaaatccaggggtgattcccactgccccatagggcacagccacgtggaagaaggcaggcaatgttggggctcctcacttcctagaggcctcacaactcaaatgccccccactgcagctgggggtggggtggtggtatgggatggggaccaagccttccttgagggatagagcccagcccaacaccccgcccgtggcagcagcatcagctgttccagcgaggaaggagagcaccagactcagtcatgatcactgttgccttgaacttccaggagcagcccccagggcaggggtcagacctggggaaagggggtgatgagagacccttcttccggatggttcctccaggaacccagggggctggctggtcttggctgggttcgggtaggagacccctgatgaataaacttgggaatcactggggtggctgtaagggaatttaggggagctccgaaggggcccttaggctcgaggagatgctcctctcttttcccgaattcccagggaccaaggagagtgtcccttcttcctccttcctgtgtgtccatccacccccgccccccgccccggcagagcctggtggaactcagtgctctagcccctaccctggggttgcgactctggctcaggacaccaccacgctccctgggggtgtgagtgagggcctgtgcgctccatcccgagtgctgcctgtttcagctaaagcctcaaagcaagagaaaccccctctctaagcggcccctcagccatcgggtgggtcgtttggtttctgggtaggcctcaggggctggccacctgcagggcccagcccaacccagggatgcagatgtcccagccacatccctgtcccagtttcctgctccccaaggcatccaccctgctgttggtgcgagggctgatagagggcacgccaagtcactcccctgccttccctccttccagccctgtgctccggccaggtcttcacccagaggtctggggagctcagca

SEQ ID NO: 51549 - DNA, 1082 bp, Homo sapiens
acttgggaggctgaggtgggaggattgcttgaacacaggaagtagaggctgcagtgagctatgattgcagcactgcactgaagccggggcaacagaacaagatccaaaaaaaagggaggggtgaggggcagagccaggatttgtttccaggctgttgttacctaggtccgactcctggctcccagagcagcctgtcctgcctgcctggaactctgagcaggctggagtcatggagtcgattcccagaatcccagagtcagggaggctgggggcaggggcaggtcactggacaaacagatcaaaggtgagaccagcgtagggctgcagaccaggccaggccagctggacgggcacaccatgaggtaggtgggcgcccacagcctccctgcagggtgtggggtgggagcacaggcctgggccctcaccgcccctgccctgcccataggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaaggtgccgtcaggacgggagggctggggtttctcagggtcggggggtccccaaggagtagccagggttcagggacacctgggagcaggggccaggcttggccaggagggagatcaggcctgggtcttgccttcactccctgtgacacctgaccccacagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgagggtgagccaagaggggtcctgcaacatctcagtctgcgcagctggctgtgggggtaactctgtcttaggccagg

SEQ ID NO: 51550 - DNA, 1077 bp, Homo sapiens
tgagctgagatgacgccactgcactccagcgtggcaacagtgagactccgtctcaaaaaaaaaaaaaaaaaagtgccccccctgatgtgcccctggcccggtccccagagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaagattggagtcctgtgtctcctgaccttggctgggcccaggcagggccacattcaccattgggtgcctctggggtgagggtctgcagaggccttgctggctgacccccaagtgtctgctgcagggctgaggctgcaggcgggccatcgtggatagcctggggcacagagggtcaccgcagtcgtcacgtgggacccagagctgtcctgggaagctgacttagctgtccttttaccaagcccttcacaaggccactggtgacagccccccagggcagtggggtgggtgagatcagggtggggctgcccgggagcattctcagaaaaattggggacactcacaggtgtaagtcaggtcccatccaggtactccagggcaaatacaggaaggggtggcggggctggttaccttcggcctttttaagcacatcaggagcttaacactggcccagtgactgtgccctgactccacccgg

SEQ ID NO: 51551 - DNA, 1849 bp, Homo sapiens
ctgaggttcccaaaaggggccaggtgtggtggctcacagctgtaatcctagcacttttggaggccgaggtgggaggatcgaggagttcgaggcaacatagggagactctatctctaccaaaaatttaaaaagtagccaagtatgattgaacacacttgtcccagctactcaggaggctgatgggggaggatcacctgagccccggaggccgagggtgtagtgagccatgatcgatgccactgcactccagcctgggccacaaagtgagaccctgtctcaaaaaaaaataataaaaaaaagggaaggggttggccaaggcggcttgcctgtgaggcacttggagagtcccacgtggctgtgctggctccaggtcccccagccccttggcccagactggtccctcccatcccctccaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggtaagcagtggatgggccccagggttttctggcagctgcaggtctggaggtcagcctcccccaggccttcagagtaaaggatagagcggcctcccaccccccgaactagagctgtacttttcccttctcatttgttacctgccctctgaaacatggctcaggacagtaggcaggagccaggcgactgcccagattcacaagctggtgaccaaggagagtggggatctggcattgggacactgaggaccctgtgtcctcttcagcctcccctctgctctgaagtggtcagcactggagtgggggcaggttctagtcttgaacgaaggcctaggttagaggttcctctgctgtggtgccaatgagactcccccaagaatgggattcaggtgtggatcccccacagacctgggttcagatcctggctctggccacctggtagctgtgtgggtgacagtggccctggaggtcacagccagactgttcagtgtgtctccctctgtcttccccaggccccgccgaaagtctcttcaaggagtcctattaccagctcatgaagacagccctcaaggaagatggtgtcctctgctgccagggtgagccacaggcctggagcactggggcggggcggggtggggcagggcaggccctgccggatgctgatgcttaggggcccccaggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggtgagatgggggtgtctgggggtgggggttggggggaaggtgggcataaatagagatccctgcccctgccgggcgcggtggctcacacctgtaatcccagcactttgggaggctgaggcgggcagatcacaaggtcaggagatcgagaccatcttggctaacacggtgaaaccccgtctctactaaaaatacaaaaaaattagccaggcatggcagcgcgcgcctgtagtcccagctgctggggaggctgaggcaggagaatggcgtgaacccgggaggcggagcttgcagtgagccgagattgcgccactacattccagcctgggtaacagaggaagattccgactcaaaaaaaaaaaaaaaccctccccaggccaggtgcggtgtctcatgcctgtaattccagcattttgggagaccaaggtgggcggatcacttgaggtcaggagtacaaga

SEQ ID NO: 51552 - DNA, 1029 bp, Homo sapiens
cagtctggctgtgacctccagggccactgtcacccacacagctaccaggtggccagagccaggatctgaacccaggtctgtgggggatccacacctgaatcccattcttgggggagtctcattggcaccacagcagaggaacctctaacctaggccttcgttcaagactagaacctgcccccactccagtgctgaccacttcagagcagaggggaggctgaagaggacacagggtcctcagtgtcccaatgccagatccccactctccttggtcaccagcttgtgaatctgggcagtcgcctggctcctgcctactgtcctgagccatgtttcagagggcaggtaacaaatgagaagggaaaagtacagctctagttcggggggtgggaggccgctctatcctttactctgaaggcctgggggaggctgacctccagacctgcagctgccagaaaaccctggggcccatccactgcttacccatggggtctgaggagtcagtgatgatcacgtcgaaggcatcctgattctgtttcatgaactcaaaaccgtcacccacatgtagggtcagcttcgagctagagtagccaatggccatgcctggcaggaacttcttggagacttggatgacatcctggaggggatgggagggaccagtctgggccaaggggctgggggacctggagccagcacagccacgtgggactctccaagtgcctcacaggcaagccgccttggccaaccccttcccttttttttattatttttttttgagacagggtctcactttgtggcccaggctggagtgcagtggcatcgatcatggctcactacaccctcggcctccggggctcaggtgatcctcccccatcagcctcctgagtagctgggacaagtgtgttcaatcatacttggctactttttaaatttttggtagagatagagtctccctatgttgcctcgaactcctcgatcctcccacctcggcctccaaaagtgctaggattacagctgtgagccaccacacct

SEQ ID NO: 51553 - DNA, 1050 bp, Homo sapiens
tccgcaggtaccgccgctgcccgcaggcgcctgccccctaggctcagcccgggccgcctgctgcccgcctcacgggcctctccacgccgggacccaagcgggctggacctcgtcctgccctggccccctcgccacccctcacaccgcctccctgggctggggctgggactgcgggctggcctcttgggtgggggagtcggagtctgcgccccgctccacgtgtcagccctcaggacacgtcagagcccgaggagaccccgggtcccaccccggcctccacccggcggcccgcctgccgttcctcgccacgtgtcaccatcgctcctcatccctgggacccctaggcgggatggggagaccctcctcacccagggcggcttggggtacgttttccccaccccagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtaccccagtgtcccctggaacagtgccggacgaggggcggccccaggtgtgctccgggctcttcccagatgctgcctgcatggttgtcagagaaagtgctagcgaggccaggggcgtcccgcggaggggtgggggccgacactgacgcggcctcggaatcctagggcagccctggaaggaacttccaggaaaggggacaccggcacgaaagcgtttccgagggtagaaaaagatgaggcccgtgggtccgaggggtcagggggtctgcttcaggggcctgggggctcccagtcctgccagggcccctgccttgactgccccctcctcccaggtgctgatcatcgggggcggagatggaggtgtcctgcgggaggtggtgaagcacccctccgtggagtccgtggtccagtgtgagatcgacgaggtgagtgccggcgtagagccaggtttgagtcctggttctcccagcggccagctgtgccctgaaatg

SEQ ID NO: 51554 - DNA, 1113 bp, Homo sapiens
ctcttaccctgatgcccaggctggagtacagtggtgcaattatagctcattgcagccttgtactcctgggttcaagtgatcctcccacctcagcctcccaagtagctaggactacaagcacgcaccaccatgcccagctacatttgtttctttttttttgtagagataggggtcttgctatgttgcccaggctggtctcagactgcctaaagcagtcctcccacctaggccgcccaaagcactggaattataggcatgagccactgcacctggcctgcttgcctttcttaaatgacctcatgtcattgtccagtgaggaatttgtttcagctgaccctgagtgttggtcccgaagttccagccacagctcctctccccaccactgactgttcttcttaccacttaggcagctgggtcccagctattgctgaggccggtggagttccctgttcccatgtgcctccctgttcctcccccacatctgttcctgatctacagctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggtgaggaagtaatggggccccatacagggacatctgtgcgcgtcagaggggaggaagccataaagagaccacaatataggggccaagtgagtcctgcacaaggcatggtgctagccaggaattgttggagtagtccagagaggccgtggcaatgtggacagtcgcctgcagcctcattaccacctcctccatgggagctcaactcatggtggcctccatggtgggttagcaagatcacctgtcacttccactgtgaccagggcgccatccttcctcactataacttgtgcccataaaccctctctctctctctcacacacacacacacacagaattttgtttgttgaaaaatctcaaagcctatgacatgaacccctatggctgcttgggctgtgagagtccgtctgctttgaaggggctacagatggcattctcgactctag

SEQ ID NO: 51555 - DNA, 1629 bp, Homo sapiens
ctctgtgtggcagcagagctcttttgttaggcaaaaccgagaggtcccccagccccgttcctgtccctgagttagcttgctatttttggaaatggggaatcaggtggggcttctgccttctctcctcttttccccccacgggttatgtcacactgaacaactgcacgtcctgtgtgttatgcccagtgtcacctccatgtgttgtaacgccataggtccgtggggtgtcataaagaaacacagcagacttgcggaagcccagccttgagtctgcttctgtcatttactgaccatgtcccttggacaagttatttactctcccggagtctgtttgctcatctctaaagagagggtgatgacagtacctttttcccagggttacagagggattgaatgagatgatggatggcccagtgcctggaggacagtagcactttgtccttaatagggattttagcaataaagccagcatgaaatttatttttcatgcccttagatttgaaaatttatgacttagaatgtgtgtacttcttaggttaacctgcccttcgtcacctcatgaaaagtaagacagacttaggtggctgactttggagggttttttttgttatatttgctttcattatagatcagcaaccgctggaagctggcccaggtacaagtacaaaaagactctaaagaagctgtcaagaagaaggcagctgagcaaacaggtaacactcacttccttgcaactcagtcggctgttaaagaatggctgttgcacacccgctgtttcagccaagtgccagatacggcgatgaatgaagcccctgtggggcttcccttctgctgagggatggtgggcaatcagtatctatcctggcagatggcagcaggtgctgtgcagagagattggtggggagtgctggaggtgctgtagctgtctcgttggtggttggagaaggcagtctaatgaatgcgacattgacgagacctgcagtgacctagagaagagttctggagccacagcacagcgagcccagaggccctggggctagttcactgggcatgctgagcagcagcaagtgggcctgcatgagcagagcgggtagagaagagcaggagatggggaaggagccagcagaggcccacgggatgacgctgccttttactctgagttcagaagccaggagggtgctgagcagacggggggaagtgactgacatgtggcactctggctgctgtgtcaacagtagactatagaggacaggatgggagtccaggaagggataggagacatggcagtggctcaggcgagaggggatggtggctttgagaccagcgtgggagcagaggaggtggtgagaagctgtcagagccttgatctgtcccatagcaaagctgacagcatttgatgatgaggtggatgtggcatgtgagaaaagggaagggaaccttggatgaaggttttgtcctgagcagctggaaagctggagttgctggcagccaaagtagctggtttgagcaggtttgtccacgatggtgatggtgacgatcctgttaaacgccctcaggtccacaggccactgagcatttaggttcacagaagaggagcaggcagggctggggaggatcagctcacgtgta

SEQ ID NO: 51556 - DNA, 2068 bp, Homo sapiens
ttttaattttttgtagagatgggtcttgctgtgtttcccagactggtcttgaacccgtgggctcaagcagtcctcccacctcagcctcccaaagtactggaattacagttgtgagccacctgccagccccacatttgcaatttttgtgttaaaaatgtctttgtaagctctgtactttgtccaagtaaagagagaccttgattactagagaagagtctttttcaagctctttggaatccttcctattgtgcttagtcatgttaaagagctttattctttcattctacaaataattattgagcaccaaataattatcatgccaggcactgtaaggagtgaagagaggaaagaaaatctctgggcttttgagaaacaggctggtgaaggaatacagtcagcgctggagactgggggttggacttgaggtgcttgggcaactttcctcaattcccttcgtttttttccttagtctgaagttgcagccggagtgaagaagagcggaccgctgcccagtgctgaggtagagtgtcggatctgttttctcccccaggagggaaaacgtcaagtcacagccagtgcaagtacacctctgacagaggcctgtgctgacagctggcagaaagctactgccggcttgcacgttttacatgccagcctgctggtgtcttttaatgcagagattggagaatgttctctttggacctcacgactgctcccatgcccctccggatggctatccaatcatcccaaccagtggtaaagtcgagagccctcctgactgtcccgaagaggttgggacacagctaccttgtctaaaattctgtaggcttggccgggcgtggtggcttatgcctgtaatgccagcatattggaaggctgaggcgggtagatcacctgaggtcaggagtttgagaccagcctggccaacatggtgaaaccccatctctactaaaaatacaaaaattagctggcatggtggtgggcacctgtaatcttagctacttaggaggcagaggcaggagaatcacttgaaccgaggaggcggaggttgcagtgagccgagattgtgccattgtactccagcctaggggactacactaaaactccatctcaaaaagaaaaaataaacaaaattctgtaggctttgaccttactatcttctgctcctctaggatctgtgccagttcagaagcaggcgagcctcttccctgatgaaaaagaagataacttgctgggtaccacatgcctgattgccacagctgtcatcacgttatttaatgtgagtagcacagaaacttcactgaggtgatgaggaccccctgggatttactggatttattcagcaggctgtctgcctggagcattgcatacactcggagactaatgctgagagcaaaacccagcagtgctgggagaggcatagagaccaatgagcaaggtggcactgaccactctggaggaggtggtctggggacgtggatgggggattctcttgagctctgtgtgaagaaatcttccaggaaaggctgacgtcctgttgttgaacagcacctagtgggaggagggcctgcgctaagagaacatacaagcagggctttccagacaagctgcagtggtggtggaggaaaaacggttcacctggatgcccagcaggggtggcatgggtgtactgtccgatgaactgtagaatgtgcgctgcccatagcttcctgcctgaccccagcaccacatatgtgtgctttcagtgaagaagagaaatgattttttttttttttgagacaatcttgttctgccaccaaggctggaatgcagtggcacaatcatggctcactgcagccttgacttctgaggctcaaacgatcctcctgcctcagcctcctgagtagctgggattacaggcatgagtcactgtgcccagctatttcactttttttgtttgtttggtttggttttttgagatggagtttcgctcttgttgcacaggctggagtgcagtggcatcatctcggctcactgcaacctccacctcccaggttcaagcgattctcctgcctcagcttccctagta

SEQ ID NO: 51557 - DNA, 1043 bp, Homo sapiens
cttgggctctgtgtctggccaggttctagttcttaggtttgctccttacattcatgaaaagagccaaacattttccagagcccagggcacaattttgattcccgttgattttgaatgttctctaatactttgtagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacgggtaagggattagaggttcttttaatacttgtttccagactgaggagatctaataacaagtaaataatgggcttttttcttttgctatgaaagctggttatttcccctatgtgacagcatctaatggaacttactggctgaatgtaatgtgtccccaccgtgtgtgtgtgtgtgtgtgtgtgtgtgtgtgtgtgtgtgtgtttttttttttccagatatgtactgccaaaccacatgatgctgaaaatagctgaagaactgcctaagtgagtttcaaatctgattaatatgttctgactttctcagtagatctgatgttcttcaaaatcaagcttttctggttgctattacccaaggctgcttactcagagattaatgctccaagcttggaaggtagcaagttgaaggaatatagaatttctgccctcaggctgccatttaagcactaaaacttctgaactggaatcatttcaatgattatgccttagtttgagtttattttaagtctctgagccttatagcatctacttgcaagggaagaaaatgtcccagattctgtcatctgtactttcttccaaattaaagcagctcatgatcttaaacgttttgtgatcttgattgaagtataagcaagaatgaaaatccacagcccgttggttgccccctgcggaattgagaatccacagtgctatggcacttactttcagctctccctgattgtgggagtcaggctccaagagggatccacttaaagcttggt

SEQ ID NO: 51558 - DNA, 1024 bp, Homo sapiens
atccacccaccttggcccaaagtgctgggattacaggcgtgatccaccatgcccagctgcatatatctaatcttgattagaacattggcttcagccaggtgaggtggctcaggcctgtaatcccagcattttggggagctgaggcaggaggatcacttgagcccaggagattgagaccagcctggggaacatagtgaaaccccgtctctacaaaaaataccaaagtttagctgggcgtggtggcacgctgtagtcccaactacttgggaggctgaggtgggaggattgctggagcatgggaggcggaagttgcagtgagccaagatcacaccactgcactacagatgggacagcggagactaccttctaatttcagtgttctaataaactagaggcagagttaatttctgagcatgagtggcctgctaccagtgtactgcatgactttggttctgttttcaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacggtcagtttgctcttactgaggaaatgtgggtggcagaagaaagtgattattcattaacctgtcgtccagagagacctgggtttgagccctaccacgctcattgagatgaatggcatcaggcttttcgccaggcatcttcagcagcgtaaaagtggtaggaaattttttaatgctaaggtggactttatgatgggctgatgcagttacactgtgttccatggaaatagtggttgaaaaagaggtgccgcaccagtatttgcccatgctggtcttttgtttgaaactgggatctttctaccagatgattttgtgtgtgtgtaagatcttctgtagggatgattgtgtgtgtgtgtgtgtgtgcaagatgacct

SEQ ID NO: 51559 - DNA, 1087 bp, Homo sapiens
gaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacatatgtatatgagtggcgttttagtcataattttgatcagttcaaaaaggaagcatttactctcttcagcactcagccttcagtaaacactctgtagtagggatgacagaggacgtaagggtgtacgtgacatggtccctttcctcagactgttcccaggccagacaggtggagacagcatgccactgaagtgaacagaacttaccccggccaagtgctgagaagaggcatgtatgggccacaggtaggagcgtgtattccaccgggtgagcctggaaagccccatagaaagggggacatttggcatgggtcttaaagaggggtgggagtctgtcagatgaaccaaggggggggcattctcagcagaaaaggaagtgtgaggcactgctgtaaaagcaaggtatccat

SEQ ID NO: 51560 - DNA, 1012 bp, Homo sapiens
agtgcgtagagaattagatgctaacaccaacagtggctttttggtgtttgaattttctgttaattgatttcttttcccatagaaattttggacggtgtggaacttggagagccagcccataagaaaacggggaccacagtgccagaatctattcattctttcagtaagttcagcctctgaggaaccgcaccagtgactagctcattaagaaaatagcagctgtgttataccctgagaggggtcaacaagatgaagcaacaaaactgcctttgagcagaaaaggttccatgaatttctcattatattctgaggacaaagacggacatagaggaaggattgcttaacacttacaaaagtgaatatttgagaaaaacagggcacccattgaacctgttgtattgctcccattcttacagttatttctacttttgtgtattccagttggagacggtttggtgaaaccagaggccctaaataagaaagctatccagattattaacagggttcgagataagctcactggtgagtgtgtcatgtgtttacttaaaagggacataaaatctgagcacactttcctctctgagtggtggtcagccccatgtccagtggtgttagtgacgagctttggcaccatgcagctgacaaagagtgtctttgaggtcatcagttaaacattgtctctgattcttctttctgatgactgataacagtacttaatgttagtttaatctcatttaactcaggaggtgaataaatttcttttgggtccaaaatcagccaaattcagagaagtgttttttaatcatgtcttttttttgtttgtttgagacagttttgctcttattgcccagtctggagttcagtggctccatcttggctcactgcaacctctgcctcccaggttcaaacaattctcctgcctcagcctcccgagtagctgggattacaggtgcacgcccagctaattttttgtgtttttagtagagatggggtttcaccatgttgggcaggc

SEQ ID NO: 51561 - DNA, 1025 bp, Homo sapiens
ctctccatgtgtggtttattatggagggattattaacccatctgttaatcacaatatttctttttttctgaccaccctgttgcctattgaagtcacagtatttctaaaatccctcagcaacttggagaggtctaaacaaatgactcaaatcagttaacccagagggtaaaggtgacaaggtccacatcctccttcatttgaggatctccagccagctaagagccaggtgtccctgttgcctctgccgtacagcgactcttacatgtgcagacttgtggctttctaaaggttatcctggctcgtctgtttgatgtttgcatacatgccatggtgacccctcggtgacctgggatgaaatgctcatttgctcagggtgactcttacggtgttcagtcaagagcactgccacccatcacagacacctgctcccatgggaggccaaacacatttgagagttactggttggagtccctgccagctctcttctcaggagccttagagatgaaaaacaggcaggcaaaaactgggaaactaaattttctgtgactttctcatttctttttcagagttctcaccttatggtttgattatggtcactggccagatgtcaatgaggccttagtggagggggtgaaagccatccagattgatacctggctacaggtgaggatacttggttacaggtgaaggtggctccaagtctctcttctgtgtgtctcctcttacaagcatgctgtgttcagtgtcacaaggcagtgtgtgttaatacagtgctaaggaagtagggctcggtcccagtgtcaagtgtccatattttctttattttcttttagaaactaaagggaagggaatgaaccatttcagagcatcaaccgaaacaagttaaaagaattgatctttgcctagaagaataactagttgtttcaagtctcatatgctacatactgtgtctttttgaataccaggttatacctcagctcattgcaagaattgatacgcccagacccttggtgggacgtctcatt

SEQ ID NO: 51562 - DNA, 1068 bp, Homo sapiens
aggttgcagtgagccaagatcacgccactgcactccatcctgggtgacaagagcgaaactctgtttcaaaaaaaaaaaaaatcagatttaagactggtcaatgtagttctcctagaaaaaaaaaaaactaaagggtggttcacacctgtaatcccagcactttgggaggccgtggtgggaggattgcttgagcccaggaatttgagaccaacctgggcaacatagcaagacctcatctctactaaaaattaaaattaaaattaactgggcatggtggtgtgtgcctgtagtttcagctactgggaggctgaggtaggaggatcacttgagcaaaagtgttcaagtctgcagggagctatcattgcaccactgcactccagcctgggtaacagagtgagagaccctgtctctaaaggaataaaaatttaagttaaaaaaattaaaattaaaggaacatttatcacttcccaagtgtgggatgctattgtagttcatttttcaaagttggtggtgagtaatggatccctgtgaagacagatgtctgagggagacaggtgtcttgttaagtgttggaacatctgtgtgcctgccctgtcctcatgcatggattagctgcttgatcaattgtttgtcatgtcattctggctctgggttaacccagtctcttcatgccaattaattccttatattgaaaagcatctgaggttggtcctggcccccaagctagggagtttcattttcttcaaggccatcatcactaacatgttttttgtttgtttgtttgtttttttgagacagggtttcgctcttgtcacccaaactggagtgcagtggtgtgatctcggctcactgcaacctctgcctccaggttcaagcaattctcctgcctcagcctcctgagtagctgggattacaggcagccaccaccacgcccagctaatttttgtatttttagtagagacggggtttcaccatattggccaggctggtctcgaactcctgacctcaggtgatccacccaccttggcctcccaaagtgctgagattacaggcgtgagccaccacacc

SEQ ID NO: 51563 - DNA, 1754 bp, Homo sapiens
taccattgatcaaaccaatgaatgtgatcacagttatatgtatttgtatctagaaagtgctgggacatagaaagggcacactttctacccctaagagaagatggactgtttggtacaaaaaagagcagatttgtaaatacacagactagaactttcacaagaccaatttgggtttttcagacctctgtctcctctcctgacatcagtttggattcaaaaggaataacatgcagggtataatgctgaaaccaggagggaaagttatcttgaagccaatgtagaattcttctgactttatgtacagacaagcccttgggaaatagatgtggctcctggtttgggggtttttttctttaaacaatctgcctggatgatgctgaggactaataaacagtaggccctggaggcaaagtcatcacctgctttggcttccccttcctccttcttaaaaggaagagggagtctcactagccttctctccccattgtgacccccacagtgaagtacctgagatgagagaggaataaaacccagccactggagcctctgctgtgggaagatctcataaaatagaagttgtgtttctgcagaaggcacacttaggagatctggggactgggtctagaaattgactaattttatacatgactgaatcagagtggctgtgaataccacccagagtgggatcagccagcctgtacccaggcacctggtctttgggatttactgcagtaccaatgacctaagtttccttcttcaaatatgcagcttggagattttatttgtttttttgttgttttgttttatttttcagtctctgtgagcctcccaggccagagcatttctgattcaaagcctgacctcctccaggcaaatgagaaaaacagaaggtgctggatctgagtatagtctggtttccctcctatgtatagcctccaagtctttgactgtcttgcctaaggcaggccgaagaagtcttttgggtaatatctcaagcaaggagtggcttctttcaacataagaccccagcccaacttctccatggaatagtctttcttagtagcccaaattctgtggaattaaaaatcaggaacctatttaaagtgctgggacttcaagcccagaactagagatgtcatatcttcatagttaaggagctacccaaggaaaactgactacttaataattgtgctactgagcaagacactcactgagccttactttcctccactgtaaacaagaatcatgctctgcctcgcctgaggcaaaggaaagtatttgtgggaaaagcagaccctgttatcctggaaggcatcaggctatgggtatatgtatcatgttttcctagacaagacacttcacagagtccagagacaggctggtccttctgtaaaatttcactgagccaaggccattgttcttgcccacaaacccacccatgcaatctagaaccagaatattgtgcctagctaaaatcctgtgggtctatgagaagccccttcttccaagtgacaggtccttcatttataagagggaaagaatcacttttcccttttttcatttcctggggatggagaaaacaaattttaaatagaaaatttccaattccttgaaaataagttgccttgtactatacagtagaaagatactggattctcttatgctggataaacgaaatattgggcttcaaatccaaacttaatacccagcctccccagctttggcagtttatattttgttcagctccttattaa

SEQ ID NO: 51564 - DNA, 1169 bp, Homo sapiens
ctgcagagctttttaaaatcctgatgcccaggctattccccaggccaattaaatttctggggagagactcaggatcagtatcttttcaggttcccccagatgattccaccagccaaagctaagaaccactgctctaactacacttggaggccacctgcaccagcttttcagatggggttgccttaggttctcattggccaactcctgctatttatagctacttaggtcagagtcatcctgtcgcctctattgagactttttttccactgcagtttccgcttgtagagaagaagctttcccaagtcctccatcagtgttttcattctcacattctgatcattttaacatgagaaactgtcactccaggtctgggagtcaggagtctaaatgttctgggaaggatggccagttatcccattccttgagtgggtaggataggaagttcatcagcaaaagaaaaaagagagaaagcctttaccactccagaaaccatttgtctccctacctatcataatccatccccgcaattataaaccatttcctctcaactagatccccacctaattgctaattccaaattctcgcttcagaccaatcgaagtttgtgcttccaggcgtctcagtaggctgcgacaaaaccttttgactccaaacacattcctgcctaggaagctcagggcacattcccctggacaggaaagagcaatgggcaaaggaacatctatgaatacagtcatttatggctctgaaatgagcacatacagttcttttacatgttttattagtaattatgaaatgcccagtgaatgttttgatggaaaattgtctcctgggcaccagaaagaattccacaaataagcatttcccacttgatttgtacacaccccaattctttgaaatgcctataataaagagtttctacagcagagatctgatgaaccttctgacagtctgacaagtgggacttgatccaaatgtagacttagaggagaggggaggcatggaatgagtcctgggaagagagatgcctgtctgactttactgggtccaggacactgccaccaccttaagccttcgtgactttcctatcttgaggcagcaagatgctttttggcttacaggaggccaaattatttcagcatctgggagaacctaactattggtgagaa

SEQ ID NO: 51565 - DNA, 1050 bp, Homo sapiens
aaccccagcatcccagctacttgggaggctgaggcaagagaatcacttgaacccgggaggtggagactgcagtgagccaagatcacaccactgcactccagcctgggtgacagagtgagactgtgtctcagaagaaaaaaaaaaggtagatccccagttatgtcctcttgagatgcaagaacccatgattcggttttacagcccacattcccatgcccttgccacctaagattttgtgtgttaccttagatagatgttaaagttttggatgccatacatttctgtcttcgatgagaaattggataatacctcctctcaagccattcagttctgggaaaatgcccttcttcagcgaatttctcttttcatccctggaatttaagtgagacagataacttctgtagctagttggggtgccctaaaataaccctaagctcccaagtccagagctcagtcccaagggttgtttctcttctagtgcattgacaaggccagggacctgctggatgctgaattaactgcgatggcaggagagagttacagtcgggcatatggggtaagtgtcaactattctgcacattgtcatttttgaggcttatttccatacttttttcagaatgggctattgagaacttacaggctgctggaaacatgcctgttttctctgatcggcagataccctgacaccagaaggaatgatttaaattaatcctgtcttttggattgttcgtgcagtaattagtttggaatgcgatttgcttccatcaggccatggtttcttgccacatgctgtccgagctggaggaggttatccagtacaaacttgtccccgagcgacgagagatcatccgccagatctggtgggagagactgcaggtgagcttggtagaaagccccagttcacccacctacccctaccccttccaggacctgggtgagtgcccccctccaccctggctcttactcaacttgcttttcctgcctcctccaccagtgtattgcttggcttgcatacaaagcagaatactcaaaggctcctcacctaaactt

SEQ ID NO: 51566 - DNA, 1050 bp, Homo sapiens
catctgggtttcatttcagactgaaaccattggtataatacttttaggagccagttctccctatagctttgagcccaaaatgaatgtccagatgcgtctcttcagattgctttctctgtaggcctgccaaagggaaagagcccagaattctttggcataggagagaagttatttaatatttatgaagggagccagatgttcaggacatttcatatcacagagttaggcatggttcctatccttgataaactcacccagaaaaattacgagcaccgggtcatagaaacaacaaatagcccattgattctctattatgtgacctagtagaatgtgcttttttattaaaggtgtccagttcctgtgtagtcctcacctaacccaaggggcaggagaggaagattggtagtttaaggagatttggattaatctgactatataattcattttcttcaggggtcaactccaccagcagtgctgtgaaaagtggaccctggttaatgatgagacccaagccaagatggcccggatggctgctgcagctgcatggggtttaggtaaagcttccctcacaggcaccctgtgaaggatggggtgagtgaggctaggggctcgcatcagaagagtaaggtgctggctctaggtggagatccaggtctatggaagggtaaaaatggtctgtatccacctacttctacaccttccatctgtcctttctacctgatgatttttattaacttgttagacatggggaaaattggatcttcgtggggaggccaaggaaaacggtgcacaaaatcaaaattgagatttagtgggtgagaaatacacacttagcacactcacacagagtactgatgccagatgcttttccccatacaccaagccattgtcagcagacaccagtggggtgtcaagtagttcatttctgaccctatctacttggaaatagcatcagatcccacaggttaagggctcgtcccaaaatatcgccccacttcagatgccaatcacaagttccaggttgtgatttgtgtttctcactgaccagct

SEQ ID NO: 51567 - DNA, 1041 bp, Homo sapiens
ggcctggtctttctggccccatcaggaaagcagctgccatccctgtcaagtagcccagtgtcagcactccagcagatcggagcgatggcacctttgaaacagctctggtgctctggtcgacgttttcttctatccctaaatgatttcccctgtcctcgtgtccgcacatcctggtgtgttctgatgacccatgtgtctgggaaggaaataatgggggaggagtatggcctgacgtctgctctcagataatcccaggatcattccatccatgtgccaaggaaccagtatttccaccttccccaagcagcactcctccagattgtctgaagttgtttttaatccaagcccagacgtaactgtgataggtgaagtgtcatgcgtacagcagcacattaggaaagagagtatgtggattaaacaatgtgatcccttcttctgtgtacctcacagcagtctttctttcccatgtaacaggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggtgagcttcctagaatgatggcatgtgtggctgcaagagacttcgtctctttgatctttggatttgaaaggaaggcttcccccacacggagttctcacttcagactcattttgttccacttgatacttctcaggaatcatctttcacttttggtgtttttctctctccattctatctcagctgctaagtaggaaggccttcacttaaactttataatgctctaggacaggacagccttgggggtgctcctgggatctacttctcctgtctactctcctgatctttactgacccagtgaagagctcatattcttacttggcaaccttgatttttaaaattagctcttgcagatgtttttaggaaagaagaacagtgactgccctcttcaggtgcttcacctatatcggatgcttactgtgtgtccagc

SEQ ID NO: 51568 - DNA, 1025 bp, Homo sapiens
tcagagctctttgtttctctctggatgtgaagaagcagaaagggggagaagaacctgcaggcatcacaagaaaaggagcagtgctcattgttgtagaataaaaagataatggccaatttgtcaagaagtgttgacaagtaagataaagttggaagtaattaactggctgacatgctgggagcggtgtgcctgccaatagctccctaaatcagccagagccttggaaatgtgacagccattcatcatttttacaacacgcctctgacaggctcctcagttgcaaacctggccagcaaaagtcgtgtgctttgacattctggggttgtgcacctctctctgccttattctgggttgtgctaaggtacctgggccctatatccaaccaggagatgcctggagacggtgagtcaaatgggccagcttgccagctcatcgctgggcagtattcctctccgaggctgggcactaggattcccagagctgactttgtaaacttctgcaggacagttcacttagcatagagagtgctgaatgggagccatcagcagcactcctggtggcctggtatctaacaagtgctgctgctaaccagccatgggatctatcagtgggaggaaacgggtatgcagccagtaaaagcaattatgaagactgaatggagtggaaaatacctgtgttagtgaaaaggcagcatacaaaattgtatctatactttcatcaccagtatgtataaaatatgcatttatgcagaatatgcgcaggtaaaagtatcttggaaaggtgattatattacaatcaacttccctcctccatttttttctttttaaaaagtggtacttccactcaccaatcttgaaaagatgagtttttttgcacacgcgcccccattcccccacgcacttcctaatctcaaaaactgttaacattctaccctctttattctaagggctcacactttctcacatacagatttagcgtgtcctctaggcattgtgacagacaaaccatttaaactgtgaccagac

SEQ ID NO: 51569 - DNA, 1126 bp, Homo sapiens
aaatattgtttgctgcctgtacctccacccctaccatggctgcaccaggctttagcccctcccagctcatctgggagggtcaggtgcctgttgggtgaagtcagcggcaacttaggccagaggaggggaggagggagatggggcgagtctttctttccttgcctgtacagtctctgggctaagacaagaggactgtgaatttgtgtgtttccagtttcgcctattagattatgcccctgccagccactggctcaactctatcagcaagcaggacagggtcagaagaatttccaaattccgttcaaaaggttatataaccatggggtgagcgtaaggtaggcgaaagagacgctactcacccagggaggcctgttaatgtaatccatgctgtttatatgaggatctggtatattttgacatcctgctgaatatgcttttatctaggctgattattcccatctctgatcattatttagtattttataaaatccttactcaacctggatctaacactatctcacatttgaaatcttccaacttagaaaagttctagaaatagaagaatagagtaaatctcttaggaagccaaaaaaagactttgtagccacagggtttggacagttgtctttttacatgctttctccttcaacaaagagagggccagtattagcatataacacttgatattttgcaaggaggtgtcagaagattacaacagagatgaaaactcagcagtgccaagcatgtctgggattggtcacccatgcttctgtcagtttctaggcaggacagagaacaggcccatccttagcccgtggttcaaaacttggaaaatatattaaaatatagagaaaagaatccctgtcacctaataaatccatatctagagtctcatttccctctttctttgctggtatggtttgcaatttgaaattattcctcctctatttgtatatgactttgtatctaaaaaacatgaatattgtaatttttcatgtactatatatgaaggacaatgctcttttgaaaagaaatgtgaaaaacatggagtttcagcaaacatccttaaaataagcttttcactaagaatctatacaaaggttcctctgtccttaaaacagtaact

SEQ ID NO: 51570 - DNA, 1036 bp, Homo sapiens
gcagatttgtagcagaaaaatatagtcagaggcctggaaaagtgctctagaaggttatttagctttgtaagcaaatataattgaaagtaaatcctcagaattccctggagattgatcttgtcctttgtttaaaacgctgttccaggccgggcggggtagttcacacctgtaatcccagcactctgggaggccaaggtgggtggatcacttgatgtcaggagttcgagaccagcctggccaacatggtgaaacacccatctctactaaaaatacaaaaattagctgggtgtggtggcgcacatctgtattcccagctccttgagaggctaaggcaggagaattgcttgaacctgggaggtggaggttgcaatgagccaagattgcgtcactgtactctagcctggatgacagcgagattctgtctcaataaaaaagtgaatgaatgagtgaatgaatgaatgctgttactggggaaagccagtgtgctcggctctttgggtgtcctcagctaagtcagctcagcttgcatttctgcctcccttctgctggtctcctgtgtcttcccatcacctttctttttttgcttccaattgcagtttttacttctgattttgtaaagctgcttttcctaagcccggttgtggtggtatactgtcgtctttactgaaggaagttttaagaaacagccttagacaaagttgctcatagcactacccctagttctgtgggtgagcctcatggaaattcttctcaggggtcttttcccactgttggttttatgtccctgagccactacttggatctggccttggagacatcgctttgcagtaagggattgaattccttcctcacagtggctgctagagagcttgaagctaaattcctggtctacctccaacaaattccagacatcttacctgtttttactactaaccctcccccaacccccacaggctttgttttatttttcctactcttattttcccttcaccaagttgtctgctttttcagagcttattttagtatatacatttga

SEQ ID NO: 51571 - DNA, 1064 bp, Homo sapiens
tcagttaaagaataccaagaatcttatcagttgcaggaaagtgctgtccttacaagaggtaagagttaatgcttcaggcacatcatcgcagatgtttggaaaggagaagtaggtagatagtagcataaaatagctcgcccaaaatgaggaaaaaatgagcttgaaaatctgaaacaaccttcaaatctcaacacattagagtcacgtgaagtcctttataatgtatgttaatctggatgaacaatcactgagactcggtttagaggagacatgagaaatactttcacattatggtgcttcccagctctctcacatgtcagacttagacttcatatggagaaaagtttgagaatttacattccagagaaatcttggattcataaagcctagaaggaatttctttatgactgagatggtctcttgggtgaattttacttatataaaagaaaggtttctagtagagtctaatctgcattcattttctcataacttctttctctaggcattaattttgaaactgaaagatccagaccctgatccaaacccaggtgtgatcaataatgtcctggcaacaataggagaattggcacaggtaaaggggcagctactttttccatagcggagatagggtggaaaagaaactaacctctaaggaagtcaaaatactatttttttttttaaatgaaaggtctcacatatttattgcggaacccagccaacaatgcattcataacagattcagagagaaataatatattctcaataaaacatgtccaactctccagatagtggtgacattttcagcttgatatggtaatatcattgtgaccttcagacagcataaatgtgtgtgccatctcatgtgcaattccttatagaccctgcttggttcttctccagtgtctttttttggagttgtacctggttttattaccagttttcatccgaatccactggggaatgggacgattttacttttgtttcttggccaggaattgcttaattctgaaagtcttgtgagaagaatggcaagaatcagagtcaggcacacaccatgatggtgg

SEQ ID NO: 51572 - DNA, 1049 bp, Homo sapiens
acagcactttgggaggctgagatgggtggatcacttgaggtcaggagtttgagaccagcctggttaacatggtgaagccctgtctctactaaaaatacaaaaattagccaggcgtggtagtgtgtgcctgtaatctcagctactcagggggctgaggcaggagaatcacttgaacccaggaggtggaggttgtggagagccgagattgcgccactgcactccagcctgggcaatagagcaagactccatctcaaaaaaaaaaaattgaagctgaattaaataaaagagattgatcagttagttttgttgatgactggcactaggcactgagcaggcgtggtagcacctcagaacccccagtgtagatgggatgggcctgtattctttctgggtttgtactctgtctctaatgaaggcaccctgtctctctacatagcacacatttgaagaagcagagaagggatttgatgagaccttggccaaagagaagggcatgaatcgggatgatcggatccatggagccttgttgatccttaacgagctggtccgaatcagcagcatggagggagaggtgagaagccacggcagaggggagtccaggctccccgtgtaccattctgtgagcgaggcaaggcgagatccatgtcctcatggagctgacattttgtggcaggaaacataataaataagtaaataagataatttcagatagcagcaagttctatgaagaaagtcaaaccagaatagaatagagagtgatggggagggggtgagtggagggtcaaggaaggccctccctgaggtggtgttatttgacgggggtccacatgacacgaaggagctaccttgcagcaggccgggggactgtgttccaggctgaggctttgaggtggaagagtgtgagacattgatgaaacagaagaaagggaagtatggctggtgtaccgggagcaagggagagggaaggaggggccaaattaataggcccacggttcacagtaaacacgagctttcacaggggtaaacattggaagtatgcacacaggcga

SEQ ID NO: 51573 - DNA, 1021 bp, Homo sapiens
ctcctgggtgacacatgccaccacgcccagctaatttttgtatttttcatagagatgggttttcaccatgttgggcaggctggtctcaaattcctgacctcaggtggtcctccaggctcagcctcccaaactgctcaaggtatataacccaaggattcaaacccaagtaggctaggccgatagcccacaatttaacctccctactacactgcctcttttaaacatcagtcattgtttaatgaatctaggctttctaaatgttcctcaatcagatctctcaacctttttagaatcccctgcctgacaagggctagggggagatctgtgttgggtgaccagggccataagtaaatttatcatcatactttcttatccagaatattaaaggaaacttctctctaaagaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagaggtgcttctgggatctggggccagtcattgtgggatgtgtgggctaaatgtaccatcactggtttacatttttttttgtacagctaagtgaggatttggaaaacagagattattttataaaggcacccaacctgtcacatccataaaacatgcaggttcttttgcagcagttgcacatttttgtagcatttttcttgtttgtggtcacattttaggggccagaatagacttagctgtttcttttaactttttattttttccttaccacataccacaccctcaaatgctttctgtctgataacagtgattgggatgggtttggagagttgagagctaggggctttctaaatagagaccagacttgaggtcagagacagtatcttgtttctccttttatccctggtactagaaagaacctaggacaggacattttctgccacag

SEQ ID NO: 51574 - DNA, 1037 bp, Homo sapiens
ttgttaggagatttaatagacattaagatgtccaaagttggccaggcgcagtggctcatgcctgtaatcccagcactttggtaggccaaggtgggtggatcacctgaggtcaggagtttgagaccagtctggacaacatggtgaaacaccgtctctgctaaaaatacaaaattagccaggcatggtggcagacgcctgtaatcccagctacttgggaggctgagaatcacttgaacccgggaggcagaggctgcagtgagccgagatcatgccactgcactccagcctgggagacggagtgagactctgtctcaaaacaaacaaaaaacaaaacaaaaaaccacgaagtcaattgcttgcttttcccccaaaacttgttctatccccagccttgcccttctcacatgatgacatcactccagatggtatcttccagttctcaggtcaaaacctttgagttatgcttatgcagctattgataggcaatggtatgattaactggggccttaaagatgatgaagatatgacatttacaaggtggacaggcatgattattgggccaccaaggacaaattatgaaaagagaatataggccgggcatggcagttcacacctataatcccagaactttgggaggccaaggagggcagatcacgaggtcaggagtttgagactagtctgcccaacatagtgaaacctcatctctactaaaaatacaaaaaattagctgggtgtggtggtgtgcacctgtaatcccagctactcgggaagctgaggcaggagaatcacatgaacctaggaagcagaggttgcagtgagccgagatcacgccactgcgctcccgtgtgggccacagcgcgagcctctgtctcaaaaataaaaaaaaagaatatatagcctgaaaatagaaagtggacccaaatacccagaagctcccccatcagttagatttgtaacaagaattaatatgaatggaataaataactccagtgggatggtggatgaccgcagcacaccagtgttagcaaaatgacaaa

SEQ ID NO: 51575 - DNA, 1068 bp, Homo sapiens
atccttcctgggctctcccattgaactaagagtatagtgggtgcctagtgtgctatgttgcagagctctgttgggggacagtaggaagggaaacttgggtatgaacctgggaagagggacttgaggcctcactgggcattctctctgcacctgtggcattggagaagaaatcagaatttgctctgtggggttaagggatgaaatgagtgcccacctgcacagtctaaggatttaccattttcagccggaagtggcctgcctcttcactggtgaacagtccctaaatttccagccttggtctcacaccaactctctggattttctggccgcaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgtt

SEQ ID NO: 51576 - DNA, 1045 bp, Homo sapiens
gggcacctggtctttggtgatgagtttgggtagggtttgaccagattcgacaggcctttagaaaaggcagcagggactgggcatggtggctcacgcttgtaatcacagtaatttgtgaggccaaggtgagaggattgcttgagcccaggagtttgagaccagcctaagtaacgtagtaagaccccatctctacaaaaaaaattttaaaaagttagctgggcgtggtggtgcatgcctgtagtctcagctactcaggaggctgaggtggaaggatcgcttgaacctagcaggtcgaggctgcagtgaggtatgatcacgccactgcacatccgcctgggcgacagagcgagacactgtctcaaaaaaaaaaacaaaacaaaaaacgttgagggctgcatgtagctacagtggatttgccaagagccagtcagcagtcaggccagattaacctcgtttcatttttctttttcttgatagggtcactgtgctgctagatggagaacatgaggtagattgagtacatgtgggtttcagctaggcattggacaatatatcctatgaacaaggcagagagacgtgggatggataacagtggagttagataaattcctgagagactgagcaggcggtgggagagagctaactgatcagcatgtcagtggcagctgggaaggagcccttagtagcagttggagccctgtcctctgccctttgctccgctggattcaacacctgttattaatgacgcggatgaggcagccaaaatgaaaggtttcatgaaccttggaggaagagcttacaaaatgacaattaggagcctcataaatcaaaaggctgctttgatgggtcaaaagaaaaatgtagtgtgaataaatacaaagcaatacactaaggtcccaaaatcaacagcataaacatcagagagggggagagccatgatgtgacagccatggagataggggggtatgagttttctcagtgactggaatctgacatcacttgtctttatttatttatttattattttttttgagactatgtctca

SEQ ID NO: 51577 - DNA, 1140 bp, Homo sapiens
atcctatgttgtcttactaacgcttccgttactcctgtattaaaaccaccaggccaggtgtggtggcttacgcctgtaatcccagcactttgggagaccgagatgggtggatcacttgaggtcaggaattcaagaccagcctggccaacatggtgaaaccctgtctttacaaagaaatacaaaaattagcacctgtaatcccagctacttgggaggctgaggtggcagaatctcttgaacccaggaagcggaggttgcagtgagccgagatcacgccactgcactccagcctggacaacagagcaagactgtgtctcctaaataaacaaataaataaaataaccaacacctgagcctttgacctgggccaaagcttagtctgagtcagtaatgagctccaacttccatgcagattaatatgatctgagctagaatttaatatgatctgagctagaattaacaggagaattagcgtccagaataaggaaggcagaaattctgcccatccctgtcattcttctcatgctgggctggggccagtcctgggcactttcttgccttctttcttttctctagatattaatagaatcagtgtggtgagagatcaagaacatgctgtggatataatatacttggatttcagcaaggcatttgacaacatgctatgaaatatggaatggggccaatcacggtggctcatgcctgttatcccagcactttgggaggtcaaggtgggtggatcacttgagttcaggagttctaggccagcctggccaatatggcaaaaccctgtctctacaaaaatacaaaaattagctgggcgtggtggtgcacaactgtaatcccagcgactcgggaggctgaggcaggagaactacctgaacccgggaggcagagattgcagtcagctaagatcgtgccactgcactccagcctgggtgacagagcgagacttcatctcaaaaaaaaaaaaaaaaaaagaaatatggaatggatgaaaagacaattacaggagcttgctttctatatgcatgtgtgtgcacgcgtgtgtgtttgcattggtaacggctgcagtagagatttccatttctcagtgtaagaaccacactttgaagatgttatcaacaaagtggatcttgt

SEQ ID NO: 51578 - DNA, 1048 bp, Homo sapiens
ttttttctttttttttttgagacggagtttcgctcttgtcgcccaggctggagtgcaatggtgcaatctcagctcgctgcaacctctgcctccagggttcaagcgattctcctgcctcagcctcctgagtagctgggattaacaggtgtgtgccaccatgtccagctaatttttgtgtttttagtatagatggggtttcaccatgttggccaggctggttttgaactcctgacctcaggtgatccacctgcctcggcctcccaaagtactgggattacaggcttgagccaccacacctggccagatcaggaaggtttcttagccattagaggaatcagcgagggggatgttcagaatgtctcagttgggggtgagttccttgtgactagaggcattcaagcgaaaagatgattcctcgtcaggaacatgggtgtgaagagtcgcatcagagaggcgttggatgagaagacctctaagggtcttccaatcctgtgattcagttgttctgttattacgggatagtctttcagacctgccccacgggttgggaggacagagtacaagagccgtgttgacatttcttcttgatgtcagactgttgactgtctggccatcttaacaggaacagctgtgattgatattctttttttaaaagattttatgtatacacacacacacacacacacacacacacacacacacacacacactcacagagttgatttcacctcgaaagcccttgaagtgagagggatgacagctcctctctgagccctgcggaccactctgctgctaatggactgtcagcctctttcattatgggctccagactgtgcaggctggtgtaaaaggaatgcctctggcaagaacctggcacttgggttccagccagttgacatttgtgacctgcccttcttcaaactgggacagccctcccactgtgagtgactaagctaggatggcaaatggtggtataaaccaagttgggttcctgcctgaggagggggcaaaggctgagtctgggctcatcaggaggcttgcaaacggc

SEQ ID NO: 51579 - DNA, 1046 bp, Homo sapiens
aggaggcagagggacctggggccgggagggcacagagcggcctgagtcacaatctccatcctggccaagagccctgaggaaaccgggtggcacggtggctgggacattgatcagaggctggagtttgggtcctctcctgtcgggggcatctggccacgttctctgatctggactttggccacctaaaaagtaacagtcatgaccatgatggcagctgccagttaccagcccctcctaggtgcctaggctccgggctgagggcctgacctgtgttctcttcaactccaaacaaggccggtagggtaggtcctgttatgaccccattttacagactgggagtcggagtctcagagaggtcaagggctcaccccagcagcacagcttgctgcgaccgcccacacagcagcgcactgaggccctgtcctcccttgcaggggtgcagagcgccctgtgcggcctggtgctatccctgctcatctgcgtggccgcggtggccgtgttcaccacccacatcctgctcctgctgcccgtgctcctcagcatcttgggtacgtgggcgaggggctggcaggcaccctgctggtagggacgggaacagacagtctccccggtggccccaggtagcctccaggcctctgaacctttcactgtcacatctcagcggaggctcataggactgtctctcctgcatgtctgtgctcctgagcagagccggggtacccaggtagtagccctcagctcagtgatgtgttactgcacctgtcccctccctcaggggtcccctcggtgtgccttgtttctcctgtcacctgagggtgggggctggactccagacctccctgttcctctgaggcctccagggcgggggatccgagctgccccccctgctgtctccttgcaggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaa

SEQ ID NO: 51580 - DNA, 1050 bp, Homo sapiens
tgactcattctccttccagccacgacccagaggccacaagtctgctccagcccctggtggcttggtgaggacatgttcacatactcagtgccaaaaccggctctgggcctagtaacgatttttttctttagtttggaattgcgttggtgtgaaaacattcacaaatgtgtaaagatcaactcagttacacaggacctactgtgcagaccctcgcgtcctgttgccatagcaacacctacctggttcctaccctcccaaccctgggaggccacttgcagctctcatcccagtaacagagcaggaacctggcgtggggtgggggtgcgtgattccccaggtgctggccagaggggtcccgcaggcaggctgggctcccagctctcctcttgcccccaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtca

SEQ ID NO: 51581 - DNA, 1072 bp, Homo sapiens
gcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctctcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaacctgtgccctgtggtttctggaaggaaaggcagactttaggtggtcctgcctggacctgcagatggtacaatggcatggcttctgtctaaggtacagaggggttggcatttcaggaaccaggccatcacagaaacaggttcatgggcagacccctcagtgagctgcaggtatctcacctggcagccgtccagtactgctggcttcctctggaggcccagccacaggctggggttggggtgtgtggacatctctgggcagctcttgagtccaccttgtgccagatcagcagtgccacccaggctctgcctcctggtgttactctttgc

SEQ ID NO: 51582 - DNA, 1061 bp, Homo sapiens
catcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcagcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcgcacacgctgatcttcaggatgaaggcccggagcagctgctccacatgagacaacagcgagtctgagctgggagtgagaggaggtcttcccatcacactggcgccctcccctccaccacaggcatcaagcctggatgcagacctggggtacaagaccccctccagtgcctgtgagagtgctgcatgcctaggacccagctccctatccggtccacacaattaaaccagcaagggagtttaaaagaaatgcccagccccaccccagataaagtcagaattcggcggggggtaggggacaggggaggtaggggcagcctgaggaggcctccctaggtggttttaatgtgcagccaggacccagaaccaggacaccaagccaggaggggaaagggcttgcctaaggccacacaggccgtggggacaggttggtgccagattccagtgccctgacctcaccattggaagcatgcagttgaccaactaacgcatgtgccagaggtcaacttcgagttgactggacacttgcctggggagtcagaaaactgcttctgtgtcctgggctctgcccccacccaggtgaccctgggtagctcatg

SEQ ID NO: 51583 - DNA, 1071 bp, Homo sapiens
ctggtttaacaacagtcccaataacgttttctttaacaacagcagttagctcatttaatcctcataaggatcatatgaggtaggtagcctaaatagcccatttacacagggaagtgggaaggagagagggtgcccccaaggatgagacacaagctgttgccacatcagcactttgcgcctggacggtcccccagttgtcctggctgcaggcagtccgaacagtccgcttcctggaatattagccaggcaggatacgccctgggcgacagaaactccaactttcgccagcggcccccaagtactgcctgggcggtggcgggagtctggagcttggctgaaggcgcgagctgccgacgccgtctcctagcaaccaagcggcggtcacgtgacccgctccagcccgtttcacgtggtcttgagctgcgctggggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggtggcgacgggctggggggagggtcccctttgcgggaggaagtgggacatttgcattttcccggaaggtgggaggaaggaccggagttttggggaaagagggatggtagggaggaagggaaggtacagaccccacgcaagaaggagatgggcaggcaggccacagcagggagagtgatccaggcacaggccagcagggcgacactgaggggccgtgggaggtggcagcggagggcaagggccgccccctcccggactcagaccctcccagcgggcagcgccggtcccagcattgctgttgcctgcacgcccagaattcccctggaggaggaggaaggtgcgcgggaggggcttgtaggcggctcacctcccccgcgcggggtcagggactgggcttgccccccgggtcccagcaccgtttcaggagcctccttgtttgctaagtcgggttaaggaaatcagatgttcccaagcagttggttttataaagtttacacatcc

SEQ ID NO: 51584 - DNA, 2017 bp, Homo sapiens
tcccttcttaatcatacttgcttcagcaaaccttcctgaagcttccagtcaaaggtggtggggagacatggctggagcaagggaatgggcttggatggaacgttcagctgggaagaaatttacgtgacagcagccgaggcttgttggtatcaatatgcactctattccaggcaatgtggggttaacaccaactgccttttctctgatgagggatttgcttaaaataattgctgacagaggatcaggtgagggcagtgggagggacagagctctaatttatgggcttctgtggtgtgccaggttatttaatcaaggcagccttatgagaaagctgatatggtcatctttttacagatgagcaaacttcagcttagactgggtaaattgccaaggtcccacggggagtaagtggcaatatcaggatttgaacccatagggatcagactccagggccaggtcctttctggggtaccagcttagggctgactttaacgttggctgtttctgtcctttgggagggcttagtctctttggggctttttttgagcaactttttgggcctgacaggctaagagcatccacaggtatgagctatgctggctttcggtacccaggatgaaaaggctggtcctccccttgacttggcaaacgagaccccagtctccaagggtgttagccgctaccagtcagagacaacaaagtgctggaaggccctgaggggtcagggttgtcaggtcgtgtacaggagatccaggtgaatttgaatttcagatcaacaacgaacagttttttagtatgagtaagtctcaggcaatatgtgggacatattaacaaattattcatgatctgatattggaaattaactgggtgttctgtatttttgtttgctggatctggccaccctgtggagggcagctgttgactccttgcttataggcacttaggggatgttctgagttcagagcccttcaggaggtggggaactgctccctgtggcctgcactccctccccactccctcgttttgtatattccttgggcaagggctgagtgcctgcttctgcccagctcagccagagtgggcagtggtgccaggtgagaagaaacaactgccccaggccctttgcacaaagggcagctcctgaccaagccctgtccatgtctcttgaagccaggtcctgagctgcaagaatgacattgtgatgagcttagaaaggactggactagggtacagaggtcttgtgggaagaagaccttgggaggaggatctggtggtctaggaggtagtcgtgtagcatttgggttaaaaactcagtaatgaggactgctgggatggagggctgaattcctcacaggcactgtgtggagcgcttcccacacctctccacctccctgtaccactggatccacacaacaacactgaatcaggcagtattgcccttctttgcagaagagccaacagctgttctgagaggtcaggtgacttgcctaaggtcactaggttctaaagtcatggagccaggatcagatccacctgtttgcctccagtacccacgaagttaaccgctgcacaactctgcctcccatccttggcagccctgactggtgtccctgggccccggccaccctgggggatctcactagcacgtgtaacaggccaccaagtgtttgcacaggactggtaggagtttattccatttctgggaagtcctaccccgccatgggtcctctagtggcaaacaaagggtttaagtcttggtctgcatgccctgctggtttctcttcagcctttccttctccaggttagacttcctcatttccatctgccctctacggctcttcgagatcctgacggtgtagcacagtggacagagcacaggctttgggggcaggcaggtctgcattcaaggtcttgagtaggtttctgtgtgaccttgagtaggtttctgaactctctcagtatctatttcttcattgtaaaaagaagttaaatacagtccctacctcctaggatgatg

SEQ ID NO: 51585 - DNA, 2727 bp, Homo sapiens
tgaggacaaccagaggttactctcgtggccatcttgatttgggtgggttttagccggcttctttactgtaacccgttttgtcagcaaggtctttatgacctgtaccttgtgctgacctcctgtctcatcctgtgacttagaatgccttaaccatctgggaatgcagcccactaggtttcagccttattttacccagctcctattcaagatggaattgctctggttcatacgcctctgacgcttggaaggggtgtgggtgtcagctgccccatgggaggggtgaaggcatgaagcggcccctccctggcctggcctgctttcttcctcctccttcactcctgggccacctgcagttgctggtgtgccttttcaacagacattactgaggccctcagaggtgccaggcgcaggggcgtcctgtgttttctgcacccgacgctttcctgcccctgtggtggtcatgttcacagacctcttctctcccccttgttgtgccacaggtgattctcctaggtcactggctgctgacaacctggtaagtgactctgtgggtatcttgtgtgtctcctgcggtctcagggtctgtgtcagccgggtcaggtcctggttctgccgtgttttaaccaggtcactttgggccagacagctctgcctctccgggtcttgatttccgtctgtacaataggcataaggattgcacaccctgcaggagctgggagggagacgtggaagtgctcatcagagctccccagggcctgccccacagtgaggcctcagcactgcagcttgattttcacctttaccatctcttttaatctgttgagcttctggagacatttctctgccaaaccaagactggaaaccattgagctcacctgtgcactttgcaaacttcgaagtgcagcgcacagggcaacagctgtgagtaatgtgaactgtaaccatcatgattcacgaccttgagaagcagggccaaaatacagatttcttagtcacacttccccaagattctgagttggtgattctgggctgggacccaggcacctgctttcttaaaagcaaaagataagatggtttattcaaagacctattgaaccgaatggcactccacacctgccttgcacatgtcttctgcatgttacactttagtgaatgtcctataaatctaggaagcgcccgctgcatgcaggggaaggcaaggcccagtgggtttggtaataaatgaggtagactcagtccctgtccccctgagtcttccttgcagcacagcagggtgagcaagagcatggcctctccagccagactccaaatcccagccccactgctcagcaactgtgtgaccttgggcgagttacttaacctcattgtgtctcagtttcctcatctctaaagtgagggtaacaataatacttccttcctatggttattaacataaatgtacatgaatgagttaatttaaaacagaaccatgctaggtactagcaagtgatcggtgttcactatgattttgattggattgacaagtaagtcaacaatgtcagtatcagtaccctaaaaatagaatagggcgggccttgtgttaggaaagtgacgaacttgtacttagcaccggtgggcaagggaaggagtctcagggtgaacattcgagtctcagggtgaatgacaaaaggagggccaggtgtcagggtagagggcgcccgccgcacagggcagtggctgggaggtcagtagggcgaggctgtgtccgggatcccacaggccccttaggccctggtgaagagtctgcattttattccaaatgggacagaaaactgttggaggatttttagcagaggagtgacagcatctgactacgttaccggttgctgtttagagaacagagtggcagtcaggacgctggcacagggtggctgcggctgtcatctgccaggagagggaggtgctttggatctacagggacacagccagatccagggtctgggtgggaggcggagcccatgggatttgctggcacacagccgggtggcctcgaagactatggcatgttctgggaggaggccctgagacgccggagcaggagggaggtgacctgcggggtggtggcctcctgacgggactgagctacctcttcctacaggggctgcattgtattctcaggctcctatgcctgggccaacttcaccatcctggccttgggcgtgtgggctgtggctcagcgggactccatcgacgccataagcatggtgagccagggtgggggagaggcggcaaggcggggagccgcagcacagggcaagacatagcctggctctgctaccccgtcccatcccaatcttccccctcttccttgggccaccacttcccattgtctaaagcctgttcatcagcctcctgggctccggcccatgcctgtgttcaggagcccagcctgctgctcttcttgtctggcttagagaaccccaagtctgccattatctccctgaggaaagccatggggtgggtcccaccagtgcctcggattagccacttcgcaagagcagtggaacatcccctgtaacctccctctgcggctctcttttaggggaggggatatggctgggagacccggccaagagggcatttcactactttaggaagtagaggtgaccctgccccaccgaaacctcccacagggggagcttctcagcacccacggagccccgtggggcagtgagcactcccgcacgg

SEQ ID NO: 51586 - DNA, 1036 bp, Homo sapiens
gagccacggagcgtggtgggggtgttgtgctcatcagtgtggtgtgtcttgcagtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtgaggccaccacctccagccagctcctcaccgctcccttctctcccttgcctggcctccagcctctccctcagtgagccagccttgccccatggggccagggctcaaggtgcagggagagcgtggcatgggcgctctgtactaggctggacaggtccaagctcctagtctctgctgcaggagcccaggggtcccctggttgtcctggtctgccgtgaccttcttctgctgtgaagctgaggctgggcccttctctcagcccagaacacaggcacagctgggggtaccatttagttcccaggggcagccctgggctgtctccatcctgagggccacgggcacctacaggtctcctctctgttctcaccggggcccatcactggaaccccatttcctgccacatggggtcttccctctcctgctgcagagactgctaggtggccagggcagagcccgtgccagtgtaggctgtgggagcctcagtgaagacagccctgaacagggggcactttccctgcccaccggcccctccccactcacccagccttacacctgccctctcccacgccctctctgaactcctgtactccttctcctggtggccgagccatttgcctgctctctgacacctctctctctcttcctttctctctctctttgagaggagtggagggaggtggtagggtgtggccttctgcctttcactcctgagatgagatgccccacgtggcctgtgactgccaccagctggttgagggtgggaatggcctggggctgcccacagtg

SEQ ID NO: 51587 - DNA, 1621 bp, Homo sapiens
gcccccaggtgaggggtgccagaatgtttctcccattggacagatgaggaaactgaggcccacatcctttgggacttgttcagggtcccgggatgaatgtacagagtaggggatgggagtgaggcatgtggcgtactcggagccctacggccctgccttggacccagccccagcctccgaggccatctggatatggtaatgtggtgtccttgtacctgggaggggagctggagaggagtgcgtgggcccggggctgatgtccctctgcccaggttcctaagcacgtgctgcctggggaagcccatggcacaggggccaggagcctggctttggactcggctgcctaggcgtgggtcccagcatcatcagctttgagctgtgtgatctcgggcaagtcacttcatccctttgacccacagtctcctcatctgtaaagtggggacaataaaaatacccgtcgcacagggatacggcaggattgaatgaataatacacgctaaaggtttagggcctggggctgctgcctctgtctctgtgcatggtgtcaggatgcccagcccgagggtggcgggggtggatcttgggttggactcagctgaacatcccgagttctcacccttcatttttctttcccaccatgtcccctgtcacctaggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgtcccaccacaacctccagcctcccttttcagagcacagcattaaagtttggggaattctgtagatgggctgtgttttgaaccaccttcaatctcctggctgggctggggcctggccttgttcctgggaagatgtctcctgccagttcccaggtggagcctgtgctgtgctgccccattctgtcatggcaggaggaaacaggcatgtgcgttggctgagctgggcttgagcctggctctggcctagcagaggccacaggagagagagacactggtgggtgtggtgcgtgggcatccgtttctctgaaccagatgacccaggcactctttggaatcc

SEQ ID NO: 51588 - DNA, 1026 bp, Homo sapiens
catgcgccaccacgcccagctaattttgtatttttagtagagatggggtttctccatgttggtcaggatggtcttgatctcctgaccttgtgatccacctgcctcggcctcccaaagtgctgggattacaggcgtgagccactgcgcctggcgttttgttttgttttgttttgttttgagacagagtttcgctcttgttgcccaggctggcgtgcaatggtgcaatcttggctcactgcagctgggttcaagcgattctcctgcctcagccttccaaatagctgggataacaggtgcctaccaacatgcccagctaatttttgtatttttagtagagatggggttcaccatgttggccaggctgctcttggactcctagcctcaagtgatctgcccaccttggcttcccaaagtgctgggattacaggcataagccactgcacctggcttgcattctaaaaggaccatgttggtggcttggatgggggcagtggtgggggtggtgacaagtggtcaactcttggacactctctgaaggcaaagcagcaggacctgtgatgggctggatagaggatgcagagacaagcccgggactgtgaggtgtgggcctgactggaaggctggagctgccgctagccaggagggaggacgtgggagggcaggtccaggatgagggcaggtccaggataagcccaggacttcagccatggacgggctgcactgtgctaacgaggctttccaactggacattctcaccactgtgcaacttttaaaaggcccatgtctgtagggacttggaagtagggcaccctgcaggtttatatagtgtctgacattcttgaggctgtcaaccacaggaagcaaattcctcttgcctctggtctcctgctggagagggcttgtatcagtctgttctcatgctgctgataaagacatacaagacggggtaatttataaaggaaagaggtttaatggactcaaagttccacatggctgggaaggcctcaccattatggtggaaggtga

SEQ ID NO: 51589 - DNA, 1086 bp, Homo sapiens
aggaaacttagacctcccctagcccagtggttttaaaaatattttatttcaaggccaggcgcagtggctcatgcctgtaatcccagcactttgggaggctgagttgggaggatcacctggggtcaggagttcgagaacagcctggtcaacatggcgaaaccacgtctttactaaaagtacaaagactagccaggcgtggtggctcgtgcctgtggtcctagctacttgggaggctgaggtgggagaatcacttgaacatgagaggcagaggttgcagtgagctgagactgcgtcactgcactccagcctgggcgacagagtgagactgtctcaaaaaaaaattatttcaaatcccttgtttaaaagaaatattcaatatataagaggcagcaggtctgatcaagtaccctctcatcagtaccagggaacccagggatccccagagcacaacgtgaaagctgatctcctagttcctaaatctcctagacacaggcccagaagggacagccttggacaagggcacacggagacttgatttcagagctggaatgtggcaatgcagagatcaggattgccagtggagttttaaaagaatgaaacagaagtataaatgaaaaacacatgattgaaatcagaaactcaatgcctaggttaattcatagaatagatttatctgaagagagaaatggtagcctgggagatagatttgaagaaatcacccagaatgcagtagaaagagacagaaaatacaaaaaagaagttaagacacaggttgggcatggtggctcatgcctgtaatcccagcactttgggaggcccaggtgagcagatcacgaggttagaagttcgagaccagcctggccaaaatggtgaaaccccgtctctactaaaaatacagaaattagctgggcatggtggcagatgcctgtaatcccagctactcgggaggctgaggcagaagaattgcttgaacccgggaggtggaggttgcagtgagctgagatcacaccactgcactccagcctgggtgatagagcaagattccatctcgggggggaaaaaaagaagacacaaaggatagagtga

SEQ ID NO: 51590 - DNA, 1015 bp, Homo sapiens
gtgctcaacttccctgaacccactttcctcacgtggggctcactgtgcccagcctcccgtattatcagcattctagcaaatgagtttgagtaaacccagcttaatccctgataggcactggttctagaggagatgtcaatgtcattgtcagcttgcactggggaggatggaatgtgtggggcctctctcccatgactcggcctgtcaaaccagttgctgctgttcagaaatggcttcttcgtggagtcttccctgactgattgggagaggggtggctgatagccctcagacctgtccagactgagaaactcacgtccccactcccctcaccctttgcttatggacgtgccaacgccacagttcattattccgcccacatggctgccagtagtcctgataccttaggtgtctgcgaaagggcgtctggcagggctggggttggtgacaggcacctgtctctcccacaggcctacttagagtttttcacttcccgcgagacagcggaagcacttctgcaagtgctgaagaagtacgagctccgggttaattaccaccttgtcaatgtgaaggtaggccaggccccagggttcccacagagtaccaggcccttcgttgagcaaacacccagcacctagcctgggctaggcattgtgcaagacagagagatacaggcagaactggggccctgctcttaaggagctcccagcctagagtgagggaggcagatcaatgtgtgaccaccagccagtgtaagtgggaaaatcaagttcaggagaggatgctgtcgggtccagaggagggatatctcacctgggaggccagggaaggcttctcagagggtcatctgtgggaatcactgaggacaaagaggagttggccaacaggagagaagggtattcctgggacagggcagaggacaggcagaggcagtgagctgcaccatctggggaaacggggaacatgagcaggaggaggcgggagtgttaagcaggggccaggcccgcagagatcatgg

SEQ ID NO: 51591 - DNA, 1727 bp, Homo sapiens
aagaaaacatcactttcttcagttcttccttgtgtaacttggtttttagcttttcactatcttggacccctgagtaatttcagtgttacattaaaaacaatgtttaatccggtgcctagagaaaagtcaagcttactaccccagatgctgcccagccagtgctaactgtagcattttctcttttctatggccaccaagtgcaggcctgatttgcttggctgctcaaggcaggacagtgtgggagtttggagcaatccacccccactcttggaactgggctctgagccacctcccctgagagtcatctctggggtcagaagcatatcagtcatgagcccagccactcactgttttagttcaggctgtgctgtgctgttggaaggtgcaagatcagagcccccaaagcagaggactctctctgcccagtccctgtggtctcttcatccctcgccttgaacaggtggaggccagcctctcctgactgtcatccctattggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccaggtgaggggcccaggagagcccataagctccctccaccccactctcaccgcaccgtcctcgcacaggctgggggctctgggtggagtgctgagttcgctgagttcttcccagatctcctctcaggtccagaacttgcacagcgttgcttggccaccccattttggttacctctaattttccccccaaaacccagcaacagtgtctgttgaggggtttgttgtactttggccaacaagcatcaccaaaagggattctaattctcattacaaatcctgcttaaatcagtgtttcccaaaggtggctgtcatcagaaccacttgataagctttttcaaaaagtggatctccaggtcccacccctggaggttctcactcagtaaatctgagggaggtcctcggaatgtgtgttttacttcttgagcttggcaggtgattcggatgatcagtgcagcatgggaacagctgggttagatgacaccatgttaccaacagacacatctagggctaaaaggctggctcaacccaaggctggaatgcttagggcagctgctctactctgtaaaaagtgggaaagctgggcatagtggcacgtgcctgtagtcccggctacttgagaagctgaggcaggaggatggcttgagccctggcgtttgagagcagtgagactcagtctctaaaaacagaaaaaagaggagaaaacggcaggccaagcccaggtgtgctcctagaatatgatcggactttcgtgggtccctctgcctgacactgtggttggcatggatgatggaagggggagaagtatttagggtgggagacgggctggccagcagccgccacagcccctcatgtcttggacagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctcca

SEQ ID NO: 51592 - DNA, 1027 bp, Homo sapiens
ggatcctatggcctcgtgctccctaccacaagaccccttcacttgagatgagtagaaaattctcccaggaggcaggagccccaaggccgtgggatgggagagggtggcaggcatgcccaggtagaagtagggaagggctctccaatcctccaggcacggtgagaagcagcggtggtctcctattctccaccgccagcacagggtcagcatgcagtgaatattgaactggtgggctgcttttttccctcctgctgtcttaccaagtgctagaaagagacgaaccaaacctaaataatatgaagtttctgccttccagggactcgcagtcctgggtgtcggggctaggtagagggaacagaaagggtctctggaggttgggtgagacccagtgactatgacctccaccaaccctgcagacccaataggtgaccagtgggaagaggaggagggaggcttcaactacgcagtggacctggtgaagcacatccgaagtgagtttggtgactactttgacatctgtgtggcaggtgagtggctggatcatcctggtggcggggatggagctagggaggctgagatgcccagagagcctgtcggtgttcggttcaggacacagtgatcaggggcactcatgggtccatgctggatgaaggacatgcagaggtgaactgcaccatgtccttgctccttttgtatcacccactcccctcctgggcctgccaccatcgacccctagctttttgttcctctgcctggctgtgcccttagcctgcttggccttattcttttctttaaaacgaaagaggggtctgggcgcggtggctcacacctgtaaccccaacactttgggaggccgaggcaggcagatcacctgaggtcaggagtttgagacctgcctggccaacatagcgaaaccccgtctctactaaaaatacaaaaattagccaggtgtggtggtgcacggctgtagtcccagctactcaggaggctgagccaggagaatctcttggacccaagaggcggaggt

SEQ ID NO: 51593 - DNA, 1034 bp, Homo sapiens
ccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcacccctgaaaggttttttttgagggctggttcctatttgataatggctccagatgatttagaagctagccactgatttcagtaaatacttctgcctccttccactcctaaccactaaaaaaggctccctctgcggatctgtttttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttctt

SEQ ID NO: 51594 - DNA, 1826 bp, Homo sapiens
ttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgcctggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccccagtaaacatctttacaccttgttttttgaaccttttcatgcgatacaggcagacctcactttatgcgctttgctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgcaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctgtgtgaacagaaaggtcgaagatatgaggcggtgaagtggatggtggtgtttgccattggagtctgcactggcctggtgaggaggcagggcctggagggatggtgggccatagggctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggact

SEQ ID NO: 51595 - DNA, 1027 bp, Homo sapiens
caggagggagctggtggtctgggctcacaggctctcatttgctgacacacaatttagaatgtagagtgttttctcttctagcaagacttgaaatggagcttatttggtgggaatttggctctttctcttataaagtcttaggatcatctctgttcagttgtcacgaggaaggtttttgtagccaaggtctcctgacccaggggcgtttctgcactgactgttggtctttcctttttcaccctgcccagggctcttcgtggagaaggaaggccccatgatccacagtggttcggtggtgggagctggcctccctcaggtaagatgggctgagagggtgtgggcctctgggcaggcctagtgggaggtctggttacactgggccaaatccattgggacaccctgacatcacattggaacctggtgccattctggcttcacgtgtaaaccatgtgtctatctctcaggaaagggcataacttatacttggaagttttaatgatgccctaccgagccctaggagcaaaaatgagacatagagaaaaactgtgacgtggcggatgaaagtcactgggtgcttccatagccatcaccaggcgcctctatatagggtggctgggtggatcatctcagtgctgccagatccaagaggctcgaagcatcgactgacatggttttaggcacagttccgtgctgattctagttggcgtggtacagtcataataactgctgctaattatggtctgtgtgccagacgccatgtatactaactgctttctccttatagccaccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaaga

SEQ ID NO: 51596 - DNA, 1389 bp, Homo sapiens
agccaccacgcctggccttgttatcctttcttgatgaaccacctgacatgaaaatgtgaaactggctgttgtcataaagcaggaagtgatggggcttggactggagccggtcttctccctcagagcaggctgtccttccctttgcattgatccttccttttggtgcaaggtctggtctgtaaaggctgtaaataggctctcatagtagagtaggctgctggaacggaaacttcttaaagcccaatctagagttggtcatacctggggtgtatctactgtaagggtgactagatctctgtacccggatgtagattccggaggtctctgcgtagagcagtgggtaccaggaggaagggttgggagagagtaggacatgccactcctgaaccttcttgtcttttgtcacctctcccctagctcttttgttccatgtctgccaccttcaccctcaacttcttccgttctgggattcagtttggaagctggggttccttccagctccctggattgctgaactttggcgagtttaaggtatgttttgtcctttccccaaggatttttaatttgacccatgaaaatttcctctcaagtgaaggaccagagagaaatgagcagagggctaggtacaacttccagggacacatctcacccattagcctctgccgtgcgggaaagcagccccactcttgcttctgtcttctcttctgtctcttccggttctcatggctgctatggtttttctctccctctccctttccccttctctcagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcaggtatctgcacagtcgcctcccccccgagcctgctgcggctccctgagcttggtgtgggccgcgccatctctcccgaggagcggaccctgcctccacggctttgatttctcatctaagactgagaatctaaacacggccatgcatcttccctacttgacaggccaaagggctgagccagcttaattgatgtcagagttgctggttgactccctgcctgtcctgacttggccactcggacacatgacaaggttagaagggtcaccgtggccctgccgagcagcttgctctcaggaggcttctcgccccaggacttattataatggaaagccattcattccttggagagagatgatgtggacgtagcagcccactttaactgtccactttttacaaacaaattgctggaatacagcaaatcacggatcaattctgcacacatgttgactgaccagg

SEQ ID NO: 51597 - DNA, 1683 bp, Homo sapiens
gcccacccagacaaaagattggtttctgcctcctgtgttggaaggggaactggtatggggtgtggtcgggcccggtaggtctactgggccttggcaggcatccggtagtgggactcaggttggctcttcccttgcaggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaaggtactctgtgtgtgtgcgtgtgtgtgcgcatgtgcatgtgtgtgcacgtgtgcgtgtgtatgcatgtgtgtgcgtgtgcgtgcgttgatgtgtctgtgcccatgcatgcacatatgtgcataggcacaagagtatgagctgtaggtcctccccacagcctatcagtgtggttcaaagccatgttctcggtgttttccttcactagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtgagcacactccctccaggcccctgtcaggctcagggccacgtccgccccacaggacctatttttaggtctttgctttgtgtttcaggtggccaaatggacaggggactttttcaataagggcatttatgatatccacgtgggcctgcgaggcgtgccgcttctggaatgggagacagaggtggaaatggacaagtaaggccatgattttgctcatgtcctagtttcagaatgtataagctctgaggcctaaggaatgttgttattagggtaggaaacagtaactcacttttcttgggctgaaagaagcaacacacccattcctgagcatgtgtgagaatgtggagcagcccatgggctgggggctgcgggggcagggcaggggacacgggcactgtgggactgcagtgggcagggcctcttcgtggtggtttgactcccatggcattctggttagatatgaggtgaggtctctggatcaagttcgtgatgtgattgaatgtttaagggtatgccaagccccaggagtgagaatagcctgtttcacatgtgcccaccagaatgccctactgccagccgggattgttctgggcataatcacctcataacccacctgctaatccacaggtacctgggcttcctgtgtctagatagcaggcaaggcccttacgggctaacacgggggccagcaagccgtttctgtggagggccagacaggagtttattttcaactttccgggctgtatggtctctgtcacgactactcgactctgtcattgcagcaggaaagcagtaagcgtgacggacttgatcagtgggctacagtttgctgtgccctgatctaaagggggacccaagtgctgtgtttattttattattattgtttttcttttttgggacaggatctcactctgtcgcctaggctggagtagggtggcatgattatagctcactgcaacctatgcctcccaggctcaagcgatcctccacctcagcctcctgagtagctgggatcacaggcgcgtgc

SEQ ID NO: 51598 - DNA, 1040 bp, Homo sapiens
atttggggcccgccctaatccagcatgggttcatctgaactcggtcacatctgtagagaccttgtttccagaaaggtcgcattcataggtactagggcttaggacttggccatatcttttggtggggggacacattcaccccccagccactttacttagtgctttctcacttaaacttcctaataagccatttgcatctcatgaatcaggaagaaagggagtgcagacagatcaggggacttgcccagggtgccacagctaggacttggccaaggacttggtttgactggagagctctcactctggagcgcttgctgctgctgcaccacctgcctcagcagcctggagctgggcatattcaggcatcaaggggaggggctctaaggtgaccctgctggccactgctgcctgagcacggacagtgtctgggttggaattgcagagcgccagccagccgcgcctctcctatgccgagatggccgaggactacccgcggtaccccgacatccacgacctggacctgacgctgctcaacccgcgcatgatcgtggtgagaagggctgccccggcctgtcccatgcggagctgcctcttcatgccgttggcgtctcaggcagtcagtgacacgtggtctctttgcaggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctctt

SEQ ID NO: 51599 - DNA, 3537 bp, Homo sapiens
gtgcgtacttacacaggttttgttgcagtaggttaacttatgtcccttgaaatgtaattgccaactacactgacagagtcctaacatagtttatgacgtggctttggagttcccaacaacagtgacacgtgggaaccactgtaacgacctgtaacaaatgactcccataggtcactttgcaaggtggtgagtatgaggcatggcaggggtcataatctcaggagacttcaagggccccaccgcttgcacatctgtgaagcaggctggtcatgatgggagctgagcgctgagcatgtgccctgtggaaggacattttagttcagatgccagctggcccaagccctttttggagctaaccttgtccccttggcctccagtgtgtgagccctcgttagctgtttatcccaatcaagctgtgtctggctgtgcactatccaggcctccacattctgtgacaaactaacagggccggctcctgtcactcctgttctcgccagcgggttttaccctgaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtct

SEQ ID NO: 51600 - DNA, 1069 bp, Homo sapiens
gctgtagaacctaactctctcgaaatgtaccagagaaaatctaattaatactctcattttctgaatgttcccccctaaaaacaacaaaaaccccactaggagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacaaatgcagcagagaccccaggggacaggagcctcttgcagtctgtccctaggcccagccctgcttgtcctccctggctgttatcttcagtactgcaaagagaacacagacatatctggcttggtgacctggctgtcctggaaaagtcagcttcatgtatgagtgtgcccatcctctgaacttgattactgaccacctgcttcccaccggcccccaccccagcctgatgaccctctgagcttcatgaattgataagcaagttactcatcagagtaaatttcacttaagcccttcaggatcttgcaattctggggaggaatatgaactgctaatcagccatgcaaagataacttggctctatgaatattttaatttcccagtgctagtggcagttgctttttttttttttttttttgagacggagtcttgctctgtcgcccaggctggagtgcagtggtgccatctctgctcactgcaagctccgcctcccgggttcacgccattctcctgcctcagcctccggagtagctaggacttacaggcgcctgccaccacgcctggctaattttttgtatttttagtagagacggggtt

SEQ ID NO: 51601 - DNA, 1052 bp, Homo sapiens
agcattgtccttgcttacaagggaacagaactgagcccgagaggctatgccacttgcccaaggccactaggtgcctaagtggcggaaccaggactggatccccaggtctgacgctgatgtctgtatcctagcctatttcacgtagagagctgccaccttacctcttagctgcattccccaattaaacccccattccccatctttcagatgccccaagggagctccttcaccttccccatgcccctggggctgtagcttttttgtgcacttaccaagtctgtgtgtgttggctgctctcctgatctatttctacaccgaatgtgttttaatccactccttagaagctcagaaaatgtgtgttgagtgaccagctctgtcctggctggccagatctgtccccaggtgtgctgacctcatgactgaccaggtgaacaggacgttgtgcagccataaggttggaaatcagggcagcaagtgactagaggtcacaagaggtatccagggtgatattattctaagataagataaaagggaccctctttggcaagccttggggtttgtctgtaggtggggatctaatatttcatggggtggttagaagcagcctgtaggagtgagagagaagaaaagtaacaggcacagaaagccaggcccacctccatccccacctcttccacggctgaaaaatcaaaagccttttatttccttatcactggaaagaagtcatcttagtcatacaacgggtggagcactgcaaacgggtgggagaatccagaatccgggtgttgccagattccagcccagagtttggcttcacgattctctgggggtatgccttgggctgctgcagggagccccagagtgtgcagtgtcacccgcgtgcagagctggcacgaaatccccaacacattcgtggcatgattctgcgggacccagatggtctaaagcagaagccccagttgggaaaaattggttcatacttagggatgatcgttgctgactttgaaaatgatgttttgtttctttggtttaatatggaggtcactaagggc

SEQ ID NO: 51602 - DNA, 1374 bp, Homo sapiens
ccatgccagagtggagccagtgaacactcagctccagaagggcccaggccactgagtccgtggtaattctgcaaggctgggtcagagccagggtgtggtgccactagggttgtctccgtagcctatttctatagctggccactggggttggcagtgaacagtaatcacacttgttttgtgaattgaacaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccatctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaactttcacgaccggtttgtgtgtggttgaaacctggagacatgcaccacgtctgccctcagcactagatctgtcagaagcaggacacccacccggccctgctgtcacaatgctattcctttctggtatgttctacctctcttcaaaggagtctgcccagaagatgtgttgtttgccacctttctgctcgccagggggttgctgagtggccctgctgagtgggttgcttctggcattaccctagctccttccctgctaagatgccctctcccccacctgccctaaagagccagggttctcctgccctgggttttgctggctataggacgtcagcaagacaaaccctgagtggttcttctccaggttgtctgctgaagccaccatcagatgcctcccctctgtggggaggagaagggtccactctggggaccaaaaaggggccgagccggg

SEQ ID NO: 51603 - DNA, 1827 bp, Homo sapiens
acgggagaatcacttgaacccgggaggcggaggctgtagtaacctgagatcgttccactgcactcaagcctgggcaacacagtgagactctgtctcaataaacaaataaatacatacatacataaagctacaagactggagagagaaaggacagagaggagaagtggcctgagactggcctcagcactggtgactgatctggcgcaggatgtctgaccatagggttggtgccaagtcctggctaagtctgtgttcctctgggctctggcaccaggccccgctgctttttaacaggattctagatttcaggcccacaggctcaagttggtcgtgtaaacaagacaggctgactttcttctatactttagggagatgggcaccactgtctttatcattaaggcacaacacctcactcttctgctgcccttggtctttatttcgtatgctctgcctcccagctgtccttcccccttaacatgccgctttcatggtgttgcaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgccatctggtcgaaacccgaggccttggccttgctctcagccctgtgtctcggaaggggctagcctggcgagggggggtgaggcctgggcaggaatgggtgtcctgatgccctcagcccttgacaccagagagcgcgcacaagtgttttgagaggagacgacgaggaagggaaagctggaaatccaggtgtgaattgatggtcttctggctttccagggcagccctcccctcctcccgcatcataaatctcagcatttaaaaataactgcaagctgggtgtggtggcttgtgcctgtagtcccagctacttgggaggctgagatgggagaatcccttgagcccaggagtttgaggctgcagtgaactatgattgtgtcattgcactctagctggggcaacagagcaagaccctgtctcaaaaaagcaaaaaacaaaaaagcaaataaaagtaaaaaaaaaaaaa

SEQ ID NO: 51604 - DNA, 1024 bp, Homo sapiens
gcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggtgagtcctggccagcgcttggtccaccctagatatgtccctcccaagtctgcagaggtgacactgaaggtgatggtggggtggttgaaacttgggcttggcgtttcaccagtggttgaatctgctcaactgcttagtgtctgtgcgacctttggattcgtcgcctaatctctctgggcctgtatttaataacaataacgcctacctcagaaggtttttatgagactgtagtggacaattgagtgtaaaggtcaattctttctgttacttgttttggtagatggggcctgatgtgagcagagtgaagtgttttagagtcagtttgcagaggtgaaaccagcaggtggatcccctgattctttgctcagcaccgcagtcggcctggtgacagacgtgggcttcttgacataacccctgctaggctgaggtgcgtcctggcagttgtggctgcaactggttcacagggaggttggagaatcccttttagcaggttgagatgc

SEQ ID NO: 51605 - DNA, 1023 bp, Homo sapiens
cttcccttccttccttccttcctctctctctctctctctctttctttctctctctctttctctttctctgtctctttttctttcttttctttcgcacttgtcacccaggctggagtgcagtggcgcaatcttggctcactacaatctccgcctcccagattcaagcgattctccggcctcagcctcccaagtagctgcgattacagacgcccaccaccatgtctggctaattttttgtaatttcagtagagatggggtttcaccatgttggccaggctggtctcaaactcctgacctcaggtgatccgcccaccttggcctcccaaagtgctggaattacaggcgtgagtaccatgtccggcctccttccctttcatttcttctcttccctttcatttcttctcttcccttttcctcccttcctccctccctcccttcctttcttccttcccctctgttctcttccttccctccctctctcccctctgtccatacatttttgttgagaaccttttctgtgccaggtagttgcaggcactcgagcatagagccccatgtagacctggcccctgtaagctgacctgcagcaggccagaccaggccccatgtgtgcaccctcctctcctggcctttgtgtcctccttaactaacacgggctctcttgtccccctgccttggtacaggcccagtttgacctggcctttgtcgtccgctacaagcctgatgagcagccctcactgatgccacaccatgatgcctccaccttcaccatcaacatcgccctgaaccgagtcggggtggattacgaggtgagcaggagccagccggggtcaaggggccggcaatggggatgaggagggctagctgaggagaggcttcagggtggttgaggcagaggggccccaggtaaccagtgccagagaaccagaaaaaaaaggatgtgggtctgtgggagggcttcctggaagggttcacagtctagcaggaggaggggccaggctcttaagctactattttaagaga

SEQ ID NO: 51606 - DNA, 1109 bp, Homo sapiens
tttggcttgaaacctgattagacatgttttgtacaccagtgttttttttttttggacaccggatccatctcccttttcttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaagtaagtagtagctgtgacttctggcaccctggatttgagctgagtggacaggggtgtgctctcctggacctctggtggcaagtctcttgaatggcatcctctttgtatagagccacagctttctaacttgtgttgaaaaactaccgtatcttttacttccgtgaaggatttcgctggttgcttagagagcctgtttaaaagttgacagttcagaagtggctgggatctcttgggctccctgaagagttagtctctgtctccctcatttggtctctgctgtgctggctcttccccatctcggcccagcacaggttggctccttgtcactgctcttttaagactctgctctgtcccctttaccctgtatactctttttgtttcgatttctcagcttctcctcttttccagttgtgccagcagacgatccgtggatccattttattttccctgctaggagttgctgtacataacactgggtaaggaggtggtgtggattcagggactgtgcttgggatccaaacacaccttgcagtgaattttgctactgctgtctctacacccaagatacctaatactcctcaacgaatagcctaggttgaggcaaagctgttgaccaccttggagggctaatagcagtttccatttagaactgggttcatttctggtcttaggttaatatttattaatactgtgccctggcactttttaggggtaggggcaggagagtaccagaaagagtgggcttttccctaaagtgtgatcctcgggattttaaaagctattacacagaagggttttttcattgattatatttgtgaaatgctgaattcaacacagttaaactagtgtctttacaacaaggcttccttcccaa

SEQ ID NO: 51607 - DNA, 1101 bp, Homo sapiens
aaactcagagtgtcggtccctgactgataggtcagagacacacagcaaatgcaggaattcctctctggcaatatcccaaggaagaacacagcacatactgtcttccttaattagtgaagagaggtcagtggccactcagagctgtatgaggaacagcagggtcctcattcttggtgatccacgtttctgaaaaccacctccgccagcccccaaaagctcttacatccttcaaaaagttcatctaaaatagggtctcccattcacctccacagggtggtgctgccccctccctagaggtgaggtcagccgtgtcacaacggaggacttgctcccccagcaggcacagggctgacagccagcctggcaccctcaccttggcactcctcttttcctctgagccctcggtaaggagaaaggcctcatggccatctgtgccctctacccgcaggaagcaattggtggtgtggccaatcccagagggcagaactttgtcccagagcatggcattgatcacggtgctcttcccattgctcgtcctagaaggaagtaacagctgtcagcaaagccaccagtatctgacctgaattactttcacaacgcagataccagcctggaaggccaaagccctattcagtgcaatgttgccagtgcccagacagtgctgagagacaaagagtaggcactgtttattaaaatgaataaacacccccaggcccaaacctctgacatgcccctggttcatcatttcagatcaatctacaagaggctcactgcgtgctgtctgccccttgaatcacacagccaccctcagcaacacttatagagactgtctgtctgtctccaaagtttaattcaggcctacctgaaacaccgactaacccccagagtgtcttcctcagtctaaatgaccccagtgtttcctacacagggcatgtttcgctgcttttctcccatcacgctcctccttacacatgaagctccaccttgtgagtcccagctgacaactgccaggctaaagggaaggttactttctcattctttttttttttattgttatttgagacagagtctcactctgtcgcccaggctggagtgcagtgg

SEQ ID NO: 51608 - DNA, 1102 bp, Homo sapiens
acaagtaattctgtttttataaaagcaatagatatatgtgtttaaaaacactcatttctgccaggcacggtggctcatgcctgtaatcctagcactttgggaagctgaggcgggcagatcaggaggtcaagagatcgagaccagcctgaccaacatggtgaaaccctgtctctactaaaaatacaaaaaaattagctgggcatggtggtgcgtgcctgtagtgccagctacttgggaggctgaggcaggaggatcgcttgaacctgggaggcggaggttgcagtgagccgagatcgtgccattgcactccagcccgggcgacagagcaagactctatatccaaaaacaaaacaaaacaaaacaaaacactcatttccaggcaatctggaaggataggaaatgggaagtaaaatccgttaatgagggccaggcctgatttctctcccgtccctggctttctcctccatgacctgcctgcctcacaagtcccaggtctgttctcagcaggaagaatagggctcctgctctgcctgatgatttggtttacccctgtcacctttagccctggtattgatgtcaccacagagctggacagctggattgacaagttttgtctggatgctgatgtgtttgtgctggtggccaactcagagtccaccctgatgcagacggtaactcctcctctgccttctcccaagctcccagcaccccctgggcaggcagctgatggggccttggctgtcaagctcctgctccaccgaggtcttaccctttatctaggaaaagcacttcttccacaaggtgagtgagcgtctctcccggccaaacatcttcatcctgaacaaccgctgggatgcatctgcctcagagcccgagtacatggaggaggttcgtgcttctgtttggcagtttggggaatgcaaccccgagggagcactgcctgccactggggccacttcctgcacccctggatctagtgacttccctgaattaattttattgccaaagaattctccaaatactcttctgtggtatcttctggtggtctttcccctctcccatccactttgctggatgcaccccctcttcaagccactctccc

SEQ ID NO: 51609 - DNA, 1055 bp, Homo sapiens
cggctgatgagcagcagagtcaggatctcttgtgcccaaaccagggtgcacagctctgtgctgttgcttctcaggccgtggtgatgctgagtgtgtttggttgttatgattattcagtctcagcagggtgtaggagattctgccaaaccaggcctggctcagggcagagctgctggcagggatatagacaggcccagctgctccctactgtgggtgggctaagccaccagtggcatcttgctccacacaccccaactgggtcccttctctctcctccccagggaactgtctgggacctttgctcatctgtgtcagcaagttgacgtcacccgggagaacctggagcaggaaattgccgccatgaacaagaaaattgaggttcttgactcacttcagagcaaagcaaagctgctcaggtgaggctggcccgtgtggccaaaggttagggctccagggtgcagcccaggcacactggggctcagctgctgggcttgcgtcttgggtgtggacacaaatttttctggtggggatttagctcattcgtgttagatgtgtaccatgggctgggcacggtggctgacgcctataatcccagcactttgggaggctgaggcaggtagatcacctgaggtcaggagtttgagactagcctgaccaacatggtgaaaccccgtctctactaaaaatacaaagattagctggtcgtggtggtgtgtgcttgtaatcccagccactcgacaggctgaggcaggagaatggcttgaacccagaaggcggaggttgcagtgagccgagattatgccattgcactccagcctgggcgacaagagcaaaactctgtctcaaaaagaaaaaaaaaatggatgtgtaccacgtacctcatggatgccagatggtgctggaggctcaacaagacacagcgtcgctgccttcaaggcacttgcagttgaaggcatgatggcatcacagtactgcgagactgcagttcacagcgccctgtgctgaaccgcagggcctacagcgcttaacatgtgctatttcactcagtcttccct

SEQ ID NO: 51610 - DNA, 1022 bp, Homo sapiens
gggcacctcaagcctgagggacccagagccctcagggaggctgggtgatccaggaccccaggaggcacagaccccgaggtccatcctggctcaacagagcaagctgtccaaggtaacgtgggagagcgggacatctgctgatgggaggagcttccttgggcctcagtttccctatctgacacatgtgcttgtgggtagcctcccttgcagaataagaggctcctgggagatactgtgagttgggtcttgctcagcctaaatgctcgctaggtggtagctgtgagtatctcatacagtgctttgagaagaggccaggatttgttcacagccacacataaagtggggccaaacgtttcccttcttgctcttgtgcccttggctgagccctgggctgcaagtcagggtgtaagttaagacacagtctctctgtccctcgaattgcggcttcctctgggccaggcctcttggcttagtccttgtccctctgtgcttccttcctcagcccagggtgaccttctctgaggagtctgcagttcctaagaggagctggcgcctcaggccatacctgggctatgactggattgcaggtaaggcgtgctgttgccctgcacacactttgcctgggagtgggaggtggaggcctgggatcctccatgctcctgtctgagcctccacccggtgctgttgcttgtttctctgaccgtgccatcctccgtggggagcaccctcttttttttttttttttttttttgagacggagtctcactctgtcccccaggctggagtgcagtagtgtgatgttggctcacagcaacctccacctcccaggttcaagtgattctcatcccttggcctcccgagtagctgggattacaggcgagcaccaccacgcccggctaatttttgtattttaagtagagatggggtttccctgtattggccaggctggtctcaagctactgagctcaagatatccacctaccttggtctcccaaagtgctaggattacgggagtgagccac

SEQ ID NO: 51611 - DNA, 1157 bp, Homo sapiens
agtctttcctgtctccataaatggcaactccaaatactaaataggtcaggccataaacttgctggatttaccatccagctacatcctgatacacccaacataagttgaaaatactgtttaggccgggtgcggtggctcacgcctgtaatcccagcactttgggaggccgaggcaggtggatcaggccaggagtttgagaacagcctggccaagatggtgaaaccccgtctctactaaaaatacaaaaattagctgggtgtggtggcgcacgcctgtaattccagctctgtaggtggctgagacatgagaatcgcttgaacctgggaggcagaggttgcagtgagccgaggtcgctccactgcactgcaccctgggcaacacggtgagattctgtctcaaaaaataaaaaaagaaacatcctaagtcgaatcatggtaagttgggggctgcccctacctctccccagctgaatcctaaccgatgcctctgcttcccctcaacttgaagcagccagaggaggagttctgtaaaaatatgtggctgatgtggttgtgtccctcccattccccagaccctccctgggcttcttaacctcatctcctccaccctcgctgccttcctgccactttcccctcctggctgttcctcagctgaaccatgcacatgcccaccccggggcctttgcgcttgctctttcatctccctgcgatgtccttcctgggaggtctctgtggcttctccatgtctctgctcagggtcatctcactcggagaggccttccctggtatggctgcccggccatactaggctctgacgctgctctcttgctttctggcaggtatcagcattcagtcttgtatcacgggtttttttttttttggtggctagttcatctcttgccaccttacagtgtaagcctcattaaggccaggggctttgtctgtctagttcctggcacatgaaacagcatctagccctgtcataagggctctgtcgatattttttccatggatggttggctatgcatcagggtagacagacactgaaaccaaccaacagtcccagtgactggaggggccctcctggcctgtttgaggcacagtagggatgaagcaggtggcctggggtgccagggctgatcgtctctccaagccttg

SEQ ID NO: 51612 - DNA, 1033 bp, Homo sapiens
ctgcgtgagagcagtggcagcggcgtggaggaagaccatgaatgtgagtgcgggccctcggctaggccgctgagtagtccagcctcgcgctgccctggcctcccctgccccagagcagtcccatttgaggtttggggcctggggaggcccctgagatgttgagactcatggagggaggcctgcagtctggacagggtggccaagccctggtaggggtggagtgagctaaggcctggccaccgaattaggggctgccctgtgtggcaccatcccaccctccccagcagtgcccctgtgctggtgggactccatcccagctcctgagggccccaggaggatgtccctccccaccccttagggcgtgggccccaggttctgggaggaaaggggttaggaggaaatgggccgaagggcttcccagagggattggcagcttgtgtggttgggggccgctgagggcagcacggagcctggggacctgggttcctggctcagggagagctgtggcttctcatgggcctcgcaggcgtgtactgttaccgtgtcaaccggcgcctgttcccggtgcctgtggatcccggtaccccctgccgcctgtgcaggacaccgcgagaccagcagggccctgggaccctggcgcagccagcgcacgtcaggtgagtgaccagagtattgggacaccttgggggacagagcctgaaccactggttttaagaaaagatgggcctgggcgtgggcccccaaccgctgggaggctcctcaggggtcccccactgcccccctgcgcagggtgagcatcccgctgtcgatcctggagcccccgcaccggtaccacatccaccggcgaaagagctttgacgcctctgacacactggccctgccccgggtgagcagccacgtggggctggatggtgatgagggcggggctggctcagactggcccagatccccagggagggtcacagagcgagactgggctcgacaagggtgagcgcccaagtctctggagcacagcctgggcctcttccatcac

SEQ ID NO: 51613 - DNA, 1034 bp, Homo sapiens
gcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttacctagtggcccttcacacaacttttgaatctctaaaaatccataaaatccttaaagaactgtaaggctgaggacatgatcatcgaaattgagagtatgttattaatagaacccctgagcagaagtggctttgggagtctcccagcagggcaggaattcccactgaacccccag

SEQ ID NO: 51614 - DNA, 1088 bp, Homo sapiens
ataaccccatttttgttttactgtctccatggtttggtaagataagataaaccattttttagagaaggaaaactgaggctcagagaacttgtatttcatggaagggtctggggggaactcttcctccaaagggggcctctcctgccttcggcccctgtgccctgaggctgcggggaaggtgggcgttcatccttcctcagagccgcccctgatggacacatggcccatctgcccccatctgacatcttgaccgaggaggaaggtgggaggtggcactggcttctgtggtgacataaggtgacttgttgatctgaggccagagagtccagttcttgtgggtggaagatgggggctgtcagactagaattgactcaccgacagtgggtgtcaggagtgggtcctggagaactgccccagagtaagtcctgggtggcctttgggtcaggagagtccccactctagggccgagtgtgaatggggacgaccgtggtccccagcttgactttggggtcatgccatatactctggcctcagagggggtcttcctgccgctgagcttgggcctgcctgggtgaactctggggtcatgtgagcccctggatgggagaggggtgtcaggcacagggctcagcaggacaccaggctgcagtcctggagtagctggaggaggttccctcccacttccttcccttcctgaccagctcctgcggcagctcatattccctcctccctcatccctgctccccacgaccccacccggactattgccgcagccttgtagctggtctcccggccctgccccctctcccgctgatccttggcagagagacccttctcaagcatgaggcacctctctgtttgcctggggagcctcctgtggctcccaatggttgaggcagaaactcccctggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgca

SEQ ID NO: 51615 - DNA, 1010 bp, Homo sapiens
ctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgattttcaatttttcacttgaggcccccatattttggaagattgtagtttgctgaacacgctgactgaatcaagtactatccaacttatttcctcattttaacatgtcaaagatcccctgtggggtgagtggggtgtgaattggagcctccccaatccaaggcacaggaactggaagcttctgtagccctgcatttcctagagaatgcttgccatgttttggggacctcctggggggcccctgtactgaccagaggccggctcccagggctgtggtttgggcccagccccctgctcctggggactgctgctgtggagggagtgaccttttgttctgctttgccaaggggctttctgttcctcattgtttagccatgacaaggctgtggatttttttttttttttctgtccaagagaataaacaggcctgagattgctcaagggagccgaccccctctgccagctactgggggctggaggctcacagagccagggaggaagtcctaccccctctgc

SEQ ID NO: 51616 - DNA, 1042 bp, Homo sapiens
ggaggccatgaggagagccatgagggaggaaggtggggactctgggcctgagtgactccttcagggtggggtgcgggcagggagccttcaggagggagggtactgcctgagcagggctcttaagggacacgtggaatttgttacaggaagcaccaggccattccaggcatagaaatcagctggggtgcaaaggcctgggggtcagaagagtggcagattgctccatggcaggaagccccagctcctctgggtcgttcccgctgagggattccagctgttggcaccgaggggtgcagccagggcagggtggtgctgcctgccaggctgaggtgggagacagctgggtttctagccctgcttgtcactcgctataggtgcagccaaacgctcagcaggcccaaactctgggcagtcctgactcccaggcagtgctgtgaggaaggggaggaggaggcacactgaacccacctgctacgttggctggtggaaatttggccaggtctgcactggcccagcggtgctgggtgtcgtgactggtgtctgctctgactggcttgctgacagctgaagtccaggataggtccatggccacgttgtgctggtttgttaaatatttttagtatctcccctgctcctatatgttaggtactggagtccagagaggttaaggcacttgcctaaggccacacagccgctaagtggtggagtgaggatttgaaaccagttctttctgactccctgtatccttatctatggagaggccccatgactcgttcactaaaggttatggatctcgatcttgtactggccacatgactgcagctggcagtacagtggggagtgcgccagccctggctctgacctcctagaactgccctttgttcatttccaggtgacgcatctgtgggggcccctgaaggacttggggtgtgtgtgtacaccctctttgcttgtacagatgtgttcacacccatgtttgcctacatgtgaatgtctccattctgagcttgctctcagcctggtagaggtggctaattaatgc

SEQ ID NO: 51617 - DNA, 1057 bp, Homo sapiens
tctcccatggttttactgagagcccacggggggctggaccctgtgccctgtcctgggatacaggtggcagtgagactgctttctccccacacctggtgctatcattcaaaatccctaagtgcgtgggctggatgcagtggctcaagcctgtaatcccagtgctttgggaggccaaggaggctggaggattgcttgaggctaagagtttgaggtcagtctgggtaacacagcgagactccatctctataaaaaaattaaaaaattatttgggtgggatggtgcctattgtcccagctactcaggaggctgaggtgggaggatcacatgagcccaggaatttgaggctgcattgagctctgatcgtgccactgcactccagcctgggcaatgagtgaggtcctatctcaaaaacaaaacaaaaccaaacaaaacccctggataggggagaggtggggtcagcaattcacctgaatatgcagatggtctccttgctgctgtttctgatgagcccattaggctaagaagacagcgggctgggccaggtcacctccaggggcttccattctggggtagaactgcatcaggccagaggtctcaaactagtggcccttaggctgaatgaggcacacagacatgattgctttgtaattggatttgagaatctccggcctagactcgcccctcatttgcaatgacccgaagcaccttgggtccctggcttgcctggctggcccctggtacatttgagtttgttttctgtagctgtctgagcttctcttttctttctaggactgattgtgggtgtgacagccttgggtctactaataataggagtggtgaactgtgtcatcatgacccaggtgaaaagtaagagtccatccttccttccttcatccacttgttcaggaagcttttgtggggtgcctcctgtgagtccagcactgggcacagccttaggggtcagacagagctggatatgggggtccttgttctgtaggagcttaaggcctggggtgaaggtacctctgctaacttaattactaaaaggcaagaggtg

SEQ ID NO: 51618 - DNA, 1049 bp, Homo sapiens
tccaggcatgtaccaccataggtccggctatttgttttattttttgtagagatggggttttaccatgttgccaaggctggtcttgaattcttgggctcaagcaatcctcctgccttggcctcccaaagttctgggattataggcgtgagccactgcgcccagccttaagtggattttagcaggatttccataggtggcactgggcaggtccccacattcgaggtggaatgcaccctgtgagcagaggctgaaaacttgcagggtgtttttgaaatggtttggggccagaaggtagaggctgccagtgccatgtcaaggaatctgaacttcagcctgggggcctatcgtatatttgtaacccaaaacatccatttcccctcctttttgtttttataagctccgaaccttaggttgactctttaaataacctggagcagcgggaagagagttcagtagccattagaaattactgagaaatgacctacctctaaattactcccagtttagtgagtagatttcttgctagcctgagatgaggagtttttggatgagacatccgtgagtaagtctgtaatgtctgcctggagtgagtgacccgcattatcatttataaagcactcagtacattggggtctgtctggagtgagtgacctgcattatcatttataaagcactcagtactttgggtgtttttctgcttggctctttggagggacctttccctgcagggccagtgggtgcatatttgagtgggtggggactaggaaaccttcagtcttaaactacggccatgctgttttgccagattcatttgcttttggcttggtgtaggctgttgtttcttctcattttttcctttacattctctctctcctttctagatctcctcctttgccctcttatgcttcagctttaatttttcgtggtgcgagttgcctgcaattccctttactttcccaaggttgtacagctgccagggaagcccagagctcacctgcctttgtgacagatttgggtattgaaaaataaggtggttcgggctgggtgcg

SEQ ID NO: 51619 - DNA, 1002 bp, Homo sapiens
gttttatagtgtttttggattttgatataatacactattgattagataacataccaacatgtaacttgatcctaaaaacatttgctgttggccaggcacagtgactcatgcctgtaatctcagcactttgggaggtgggaggatcacttgagccttggggttcaagaccagacagggcaatatagtgagatcctgtccctatataaaaagaataaaaatgaataaaaacaaaacagacaaaaatatttgccgctgtgacacagcctatggctgagctccactgtttgtcataaaaccccaacattgtaaaagagtgactaccagaaggaaagccattcggagcagagcaggtgttcttgtgacacacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcaggtatgccctttcttctcagtggcatctacttactgtcaaactggtgactgcagtgaaagtcttgatattaacgtatcctcagcaggaaagaaagttcatgtgagaccatttccctccagactaaagttgtgttaggtataaaactcaccgtctgttacatagttaaattgggttgatctcaggttagttttttttttttttttttttaattagttggtggtatggattggaaaggaggctagttttgttttggtatttttaagagctgaacaaaaaatacaagagatacggcaatgtataggcttaactgtcagggttcagagaaacatgtcacttgatgctgatattttggtctttcagtttgcactgggtttcaattcagtggatcaactaatgtgaattgttcttgttagatataggtcttaactgagtaaaagaaacaaacctattctaacctagtat

SEQ ID NO: 51620 - DNA, 1173 bp, Homo sapiens
gttgagggactgtcagcagagcaacaggagcagtggattcctgaagagatcctgggtacggtgggagctggccttcacttgattcaaacaaattcgtctgttatttgtgcaacagcttgtggtatttttcaaatttaacaaaagtagatatttggagaacagtttatgttcatagaggctgagagaagaagtattttgggagatactccatttgtaactctgtgactaaatgtgcgtattaatgcagtttcagaaagagctgagaggcagagcgtgtaaaagaactaaatttgagcaagttcaacaattttaaactctgaagtttgaataccagtctagagcctctcttaaacctgcagtgtccgatatctagccataggcacaaatggctaactaaaatttaattcgaattgaatacaagtaaaaatttagtttcttaattgcactagcacattagccacgtgtgctcccagtgctcagtagccacatgtggttagtggccactgtactggatatcgcagatgcggaccatttcaccatgctgggcagcactgctttataccatcccttatcatgaatcttatcctccctggtttgataataagttgataagatcccttaaaaaacaattagggttgttttacattaggaaatattataaaatagtcacccatgactttggagttctttcttaacaaagggaaaaatagttaaataacatcatcataactgtgatcagtctgcttgctggtgcttttttattcttccacgttttttcttacagtcttttctcccttaccatttaggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcaggtacactgcccccaagaaactacctgccactgttgtctctctgtgggccaatgtccaggcgattctcattatttgctgtggggatagtctagaaagtcagtgcgaaaactgtattagctaatgtggaaccattgctcttaggggaaatactgggttaggttcatgtgaacctctggtcataacattc

SEQ ID NO: 51621 - DNA, 1043 bp, Homo sapiens
catcatgtaggcaaggccttccatcagcaaaaagattacaacttgctgaagattcacaggattgttagcactttctagcaataaaatattttaaaattaaggtatctatattgtagtttcaggcataatgctattgcacactcagtacactactgtatagtgtcaacatcacttttctatgcactgggaaaccaaaacatttgtgtgacttgctttattgtgatcctcactttattgcagtggtctggaaccaaacccgcaatatctccaatatgtgcctgtagatagatagggtttttttgtttgtttgtttaatttcaaggaaaaatagttcatctataataatcttctgtaaaatagaatatctaatattttcaaaaacacattaggctctcataagcattgtatcaactattttatttatcttttatagatgtaaaacttctagcagagtctcttcctcgaagaaattcctcgttgctttcagtccggttgggtggactgtttcttcgagacctggctacagaaggaactatgtttcctcttctagtcttccctaatccagtatgtacaacagttggatagttaatgtatctaaggtgttggtaaattgtagtctgttttaggcaaatgataactgattcattctgacatttgatcatcttgagactgatgggctgggattagaaaagtttcttgaaattgttaaagagcaaatgttggtgacattaatggctatgccttcttgcactcctgtattgtagccaccatggtatattttgctctgatttggaagaaaatgctataagaccactattttctgcatttcaaggtcaatgtttgggtttcctctgtatctgacagtcattttcatgccttctgacccttagttactgacatgaaatctcgtctcgccagggtcccaaaacagaaacatctcaagttttctatatatatgtaatttttaaaatataatatacgttattaacgataagatctttgatcttaagttggcaacaagctgtctaaatggctgagtagtt

SEQ ID NO: 51622 - DNA, 2256 bp, Homo sapiens
gctcatgtcagggggcctccagcttttttcgtgtccatacttttttatatttgtgttttgatttccaaatttataggtaaattcacacttagaaaatggtaaacaaagatattatgcttaagagttttcctcagttttcttaaacaaactggggttggttgattctctacctttcataattattacattaagggaaagaggagggaaatagcagacatatatttgaatcttcttttttttatcttcagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatga

SEQ ID NO: 51623 - DNA, 1078 bp, Homo sapiens
aaaagatagctttctctgcttggataaaagttgtttacttagaacttgtattgtcctagattctgatttaggcctaataagagggatacatctgtatctgaaagctaggtaaggatgaataattcggtttggaaaatgccagcttgggtggctcagagaagcataatgtagtctctggactggaataatgttcaccacatcgtgctttgaagctaccaagtggagcatgtgatgaaaatattgtttctttttttgtgtaaatgtatcttgtacctcagcttgctatgagttttggcctcaggatagctgtcaaggtttgctctcaatcatagaccccgggtgccaggctaacctgccctcctggtctaagtgtaactcatgggctgtattttgtatattctacgtttaatcagcagtaatgaagtaaatattaaggtttatggtctatcatttcatctcttttatgccagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtaaattcatgtcagggcagttgaagtcatatgtttatattagtactctataaatatgatatatatttatgtatattacatgttggaaggaatatatattttcaaagatatatcacccatgcataataccattgttgaaaccttgttccaataattgtggaatccttttgtcatggggaatccgtcttgtcagcctttttcatatggaggaggggtgggttatctagaggaagacggcagattcttaattccattgacattcagaaatggggaaatgattgcttacaaagtcagagtctcctttcccaggaggatatcattcttgtcacacttagacatacttaacacagccagtgaaacattgtgatcatctgagctgtggacagatcctttcaacagagaattagtcctgccctctctgaaatgaaatgggccaggatagggatttcttttttt

SEQ ID NO: 51624 - DNA, 1215 bp, Homo sapiens
gcctcctgggtagctgtgattacaggcattcgccaccacactggctaatttttgtatttttagtagagacggggtttcaccacattggccaggctggtcttgaactccttgcttcaagtgatcctcctgccttggcccccgaaagtgctgggattacaggtgtgtgccaccatgcccggcctatgttgacttatttttatggttaccattgacttaactgttgttttgatgaaaatcttaaaaacgttattgtagataattctttctttaaaaataattaagataattatttgaattctttaataattgattagtaattaatttaataatttaattttttaaaaagttgattatgaaagaatgtaagcctatacaaaagtggaatagtctaatgagctttatgtgcccatcactctgattccacttatgaagattttgccacatttgttttatctattttttttttttttggtgaaatattttaaggtaaatcccagatgtcatgccattatcacccctatgtatttagagtgtatttccaaaaactaggtgcttcttcttacataaccacagtggtatttcatgccttacaaaattaatgagcattctttgatactatctagtcgattttcagatttcagaaatattttggatcatttcaaaaatgtctttgttttgggtttgttggaatcaggatacagacaattggaagcattgcatttgggtgatacattgtgtaggtctctgttcatctagtttccctctcttttttgtccccccatgtcgtattttgttgtggaactaagtcagttgtcctgtggaatgtcccactttctggatttggctgttcgtgtgccacttaatttgttctcccacatatttcctgtaaaatctatagaacaggtttagttctataggtttgactggattcgggtttcttttttggcaggggagttgggaggtagacttcaggtaggtggtgctgtatacttcatattactttatatcaggaggcacataatcaggtcttttttctctcttattgatgttaaagtggataattgtatttaggtggcaagagccttgatttctccattgcaaaattccctgtcagtcattcacataatggtttattccactaatgaacttcgatggcacacattatttaattaggggttacaaaatggtcactttttctaattccatcattatttc

SEQ ID NO: 51625 - DNA, 2032 bp, Homo sapiens
ctcaatcctgtggtgtatccacgccagacttttgtcaacactcttcagtttctgcattcatttttgtggggtcagaaaaagtgactttgttgattcaggcataatccgcagtacttattgaactcttattgtatgtagattattgtgtagggtgctgagggagggccttgtgaacagaagtgggtcataaagaggtaaggacaaaataaatgaaaagagatagtctttgctatcaggtaacttacagcctcatgtaggaatcatgtggcaactgtagacatttatgggcattacatctacgtgcatttaataataagagtaactgaatttttctcttttcaatacaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggtatcctcagttccctttggctcccttaagctctaaaaatggatttgggcttgttgatttaaatacaagcactttacatttactttggaaaatatctcttgttggcaggggagctatctagtcttctaggtgtttgctacgaaaggtagacatgaatattttgggaaaggttttactgtaaatcccatctggaggcagggaaaataagtggtttaagaatcttacctttcctttgagctctataattcagtggagttactttgcttctctgaaccgtagtttcctcatcttccatcatctaagatgactaaatgaggtgatgtgtggaaggcacctagcaaagtgtgtaatctgtaatagcaactttaaagtgtggcttttgtttctgtctccccattctctcagaacattatttgcttgcattgagggcaacagcgtaactgttaagaatggtctcaaaagttggactccgtgagtttgagtcctggtactttcactgtacccatatagctatgtgacctggggcaaaccacttggcctcttttgcccttaatgttttcatgagtaaactgaggatgttcagtggtgcccccatcatagggttgttgtaaggccctccacacagtgtgtggcacacaataaggatttaatga

SEQ ID NO: 51626 - DNA, 1719 bp, Homo sapiens
gacactaagattcgtgggaagagctggttcaagtggtggtggtggtggttggattcctccaaacaaagcatttttagacccagtgtacatgttcttttggtaaaattaaatgactagaggttttcattatttttattttatctttttgagacagggtcttgccctatcacccaggctgtagtgcagtggtgcgatcttggcccactgcaacctctacctcctgggttcaagccattcttgtgcttctgccttccaaatagctggaattacagacacctgccaccatgcccagctagtttttctgtttttagtagagacggggtttcatcatgttggccaggctggtcttgaactcctgacctcaagtgatcatcctgcctctgcctcccaaagtgctgggattacaggtgtgagccactgcatccagctgactagaggtttttaatttccccatgatgatctcgccttgagattccttctgtgcctgggtcagtgtcagaaatcatactgcaagggaactggagttccccccacaaagtcattgctccagctatagtaacccattgctttttctctgtcttcttctgtaaatgattttttttcttcctttccttctattacattccttttttcttttcccatctttttatcctcctgattattcatgcaccagacatttcttgagtacctactttgtggcaggcactgaagacaaaggggtgaaggcatggtccttgctgttaaggagtggagggtgtgaattgaagattaaatctgctctcagtcttttcctcactccttccttctcttccatcagtgttttgtcccctgtgatgttactcaaagcaaaaaaggttgttgggaactgactcaacaaatcctagacatataagatctttttaatagttacaattacaatattgcattatgaaatttatttgttacaaagaatgctacttccaagacaggggattttttcttctatttgtagttgtccctaggaaagaaaatctttgattatggcttttaggtgaagtctcagttggttaatggtgggcttctattaaatatttgttcagaggcagtaaatgggattctaaatcatatttatcattttgttttgaaaaatttatcaaaatgagatttaatggatctgtttgagttactatagaattgtataatattaatgatgaatgccaaaatgagaaaaattatttttataatgtaaagcatctcatgaacagaaaatagacaaggcaagcatagagaaggcaccacagaaactgaaatttagactgtccagtctccgccctgtcctcaggtcgtggtttctctggcttaagaaagctgaagtgaaattggcattgttaaaagcattaccttcaagtttcccaagcctttttgcattttccttgattgctctgccgttttcctgaaagataccttttctccccagtaatattggccttgctttatcttgtctgttcctaggttcattcactttctctagtgctgaataagaccaccagtgagcttgccaaagcaaatgtgtccaaattagtagcacacctggaaatgattggtaagtggtggggggtggagggaagcaaacttgcaaaatctggtcagcatttgaacattgtgatcacaaattgattgtcctcacgtgctgagtaaggtgtggcagtggcttgattgtggttattagtctggccagga

SEQ ID NO: 51627 - DNA, 1165 bp, Homo sapiens
tgcatgccaccatgcccaactaatttttgtatttttggtagagacagtgtttcactgtgttggccaggctattctcgaactcctgacctcaagtcatcctcctgcctctgcctcccaaagtgctgggattacaggtgtgagccacagcacctggccagcattctctctaatgggactttgtaagttaaaattcttagttgaatacaagtgatcaactacatcaggttctaaatagtaggattttaaaaaaataatattttaacttatttttttaaactatagagacagggtttcgccatgttggccagactggtttcaaactcctggactcaaaccatccatccactttggcctcccaaagtgctgggattacaggcgtgagccaccgtacccagcctttagtagagatttatgaaatgtgaagtaaaacatttttcctttcctaattatcaaagattacaaagctcatgttgatgctgtagtaaaaacaagaatgtcttttggggaaggaatgaactgaggctgaggtttcatgccttgtgcaattattttagaaaagcttcttagaggagattggcttttttttttttttccttcttacagcgtattcctgttaatggcctttaagattggtaaaagcttggttatttttgttagaagacattaggtatctaaaataagtatgtggctgggcacggtggctcacgcctgtaatcctagcactttgggaggctgaggtcaggagtttgagacaagcctgggcaacatagtgagacctcatctctacaaaaatagtaaaaattaaccagttgtgatggccagtgcctgtagtcccagcgactcaggaggctgaggtggttggattgcttgagcctggaaggtcaaggctgcagtgagccatgattgtgccactgcactgtagcctgggcgacagagtgagaccctgtctcaaaaaataaaaaaaaaaattgtgttttcaattcattgggagctgaactagcatgccaaatataccttagtaattgttttatcacgataattatgataataaattttgttttacagaggcaacggttcagaatattcctttttagtatccatacagtgttaataatgactcattatagattcacattctagtcgtacatgtttcagtcacgtcttc

SEQ ID NO: 51628 - DNA, 1164 bp, Homo sapiens
caaatatttggggattttccattatcttcttgttactgacttccagtttaactccatggtggtcatagaatatgctctgtatgattttaattgttttataaactcacgaaacttttgggaacctgaggttatttggtggtaaaattagggaattaattatcctctgagtcagttttccttcctctttcaggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggtgagcaatcagtatccatttccttttccgttcagctagtatttgatcactaattgaaaaatttgtatgctgctgtaagatgatccataattgctattacttttgtagggtatgtggcttgaagaattttttttggcattttattgatatttcagttaaccttatgaattgaggtagtgtaaattataactcttagtaaatgtaggtagtagaattttttttgacattttattgatatttcaattaaccttatgaattgaggtagtgtaaattataactcttagtaaatgtaggtagtaacttgttttagcaaacaaaccaatggaatcaaccttccatctttttataatgctttctttatataaaagcattccttctataatataaacgttttagactctgtggcttttttcagaggacgtgattggcccgtggtttacttgaagccatttaaaaatgtcttaataataacatctgtacagtatattgctttacagttttaaattactgtggcacctttttttttttttcaacttttgttttagatacagggggtacatgtgcaggtttcttagatgggtatattgcacccagatagcatagtacccaataggtagttttccgacccattccccccaaccccccgactccgctctagtagttgatgttaaacaagtaaacgtgtttccctgagttttgtgagctctcttagcaaattatagaaccttaggagggtatctgttgttctcatatttatgaccatccatggatactcaatgtttagctcccac

SEQ ID NO: 51629 - DNA, 1325 bp, Homo sapiens
gggttcctattttttaagtcaaataatagcacagagtttgtagtgttttaatgaaaaaaatttccctgtatttgtttttgaggatttgattttaagtggcagtgcatacaaggagcgctttttcttcaaggtataatgtgctttttttgcaacctgactattctgaaaaaccttatgggattcagcagtcaatccacattcacatgctttaaaaagaaaattaaaaccaaccctttaaaatatctcattacttgagaaagcctgcttattaacttttttttttaagtgtttgaattactttcatactatgtaaagatgttgttcttaaggcccattgaaaagaattcctttttttttttttttttttagccttcactagtacgttcttggtgatcttattttatatccttaaatcttagaaaaactatcttactgggtaccagtgattgttctgtagaattccataagggctgtttggagtgtgttgcttgttcaagtatttgtaagcagataaacacatctgtgaagttcacctccccatgcatacagttaaatataattgattacagtctatatgaaatgaataattaccttcttcaccagccatcattttgtatttgcatttgcctttgaatacatttgcatgtgtgaggtttgtctaatatgcattccagtggttaaagaacaggaaataatcctgaaatcaaagcttggagacgggttatttgcccttgagttccaggactcctgtgtgtttggaattgttttacataaatccatgtcttaatgagtacaagattgagtttttttgcatatgcttttatttcacttttctcaaccatagcttatgcttaaaccacaatttctaagtcaaaatctttgaaaagctttgggttaatcttctcaagccactgatttatttaaaccaactacagagaggatgtagagatgaatcaaatgaaagggcaacaaacactttacagagtttaaataaactaagtgagagggaaaggttttaatgttgaaatacttaaataatgacatttacctagtaatctgccttgcaaaaaaataaaaaaattgcagaaagcaagaactagtttcttttacttgtaattactacttgagagaactgtgaaagggagcagtgtttttgtattcttttccaaagctgagaggagtcaacataaaggcagccctagagggagagccatccttcctctcttcccagattcggttgagaatggcaagatgggaaccatgatgctacgggagctgtgcagacatgtagctccgaggcctccatgaagaagccctgggaagct

SEQ ID NO: 51630 - DNA, 1056 bp, Homo sapiens
ctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccaggtaaaagaggagaaaagcaacataatactgaaggtggggaaattcacaggactgttgaggaaactgaggggggtgggcattgtgttcaagcaaatgttaacgaagagatagcatttctttaacgatgatgagattctgattttgctttacaaggtttaagagttttgggtgtagatttatcattggatgacttgtaaagtagggttaaattagcacgatatagtgtaattaaagagatttttagatagcctattaggacttttttcttataggtgaaaatagttgccaccagatagtgatagtataagtagaaagagtcctgcattctgcaagccactacccagacactgtccttgcaaaccactaagtctaaaaaatataaaagaacacattaaaaaatattagcgtaaattaggcaacaacagaaatgctgtagcacagagtttaaaagacatgaaccatctggttattggtgttcttctctccaatataagaattagtcattccaaatgagaacattattttggaggcttttctggttttatgtattttttttttcccctcaagacagggtctctcactgtctcccaggctagagtgcagtgttgtgatgatggcttactgcagcactgacctcctgagctcactcgatcctcccacctcagcctcctgagtagctgggactacaggcatgtgtcatcacgctcagctaatttttgtgtgtgtgtgtttgtgtgttttgtagagatggggttttgctatgttgctcaggctgggtcttaaactcccgagctcaagtgatcctcctgcctcagcctcccgaagtgctggggttacaggcatgagcccccgggcctggcctcttttctgttgttaaa

SEQ ID NO: 51631 - DNA, 1319 bp, Homo sapiens
ggatttgggggagttttacagaaataattttgtttcttttttgttttgagatggagtcttgttctgcccaggctggagtgcagtggcgtgatcttggctcactgcaacctctgcctcccgagttcaagccattctcctgcctcagcctcctgagtagcttggatttgggcgcccaacaccacccctggctaatttttatatttttagtagagactggtttcaccatgttggccaggctggtcttgaactcctgacctcaggtgatccacctgcctcagcctcccaaagtgctgggattacaggtgtgagccaccgctcccggcttacagaaagaattttggattaaccgtagccagtaagtgtataaaataagtgaatgttatggactgtttatttttttaaggattactcaggtatttggtggggagagtggttttgtgagggctagaatggaattatgtaggcctaatggaggagagttctttttggtctaggcaagaatgaaggtggtttggatctggtcagtggaaatggacgtggttacatgtggcagtatttgtttgaaaaaataattttagtgctggagaaagtttgtaaaccttttggtagcattgtgcgtggggagggattgcctatggagtcagatttcgtcatcaatcccccagcctcagttgttgtcacagcatgggcatgagacaccgtagaactgtgacgcggtctgtgcttggagtggaggcgggtgggcagggtgtgtcgagcacatggagctttgcataaggaggtctggctgccatagtggagactcctggacagccagttttctgagtagtggacagtgtggggaagcaggcagctgtaaacattttcaaagacagaatgagctttgcattttttatttgtttagtgcaacccctttttgggtccccttttcttcattacctctctttccttgggtccttgtagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaagtgagtgtttttttttttttttgagatggagtctcgctctgttcaccaggcagggtggagtgcagtggcgcaatcttggctcactgcaacctccacctctgaggttcaagtgattctcctcagcctcagcctcccaagtagctgg

SEQ ID NO: 51632 - DNA, 1454 bp, Homo sapiens
tggaactaaaatatggtcccacacagggtgatggagtcagaaagtcctgtcttgctgtgtgtctgagtagttacggggtgggagatgcagaaccacttgatgtgcagcattgatgccttgctggccaacattttcaaagttaggggctaggcgcagtggctcaggcctgtagtcccagcactttaggaagccaaggaaggaggattgcttgaggccaggaattccagactggcctgggcaacatagtgagagaccctgtctctacaaaaaattaaaaaactagctgcgcatggtggtgcatgcctgtagtcccagctactcaaggcgttaaggtgagagaatcacttgaaccaggagattgaggctgcagtgagccatgatcacaccactgcactccagcctaggtgacagctgaaacctggtccctcccgccccaaaaagttgcaggattttatataaaaggtttgtatttagcttcttttgaaaaactggaagctttggcaatactaggtccatgttctcacttggaagcatctggaagcggagtagcaattgctcccttgaaatggggcatatgcttacctagtccttcgcttatttctgtcacttccttagtcagtgtaaatgtatgaattcgtgattactggtgtggaactttaaaaagtgcatttcacacttaataaccttttcatgttgatctcttatcagtcctgtaagctgggcgtacatcactcttttccagatagagtttctgactagcttaaggtcgtatgactgggaaagtggtttggcatttgaaaacaggacttcaaggccagtgattccctgctgaagcactctgtcttctagttagtctttctgttgaaagtccgccacggtctgtacctaactcagctggtgagagcgttgcatactgaaactgtggtcccacattggtggtcttgtgagctagcaattttattctttccttttttttttttttttttttttttttaagacagaatctctctctgttgcccaggcgggactgcagtggtgccatctcggctcactgcaacctccacatccctggctcaagtgatcctcccacctcagccccaccgagtagctgggactacaggcatgagccacgtcacccagcgattttctgtgatgattggctgtgcccttagtttttctcaatatggaataattctgtatgtattgtcataatggtaccgagtaattatgaattcctcattgcagctttctcggttatgaaaaaacgatggttccaaatgcatttcctgttggtagattagttgaattattctccatgtgaagagtattatttgttcccagtacactacagcagtttcacataaacagttggacagaccctggagagtgaaacatccaggcaagctagaagctgacagatgaaggcccagagggacccttgacatcctttgggg

SEQ ID NO: 51633 - DNA, 1614 bp, Homo sapiens
gaggtaagaagtctatgtgttgatcacagcactgcgtgttggctcacgagcaaagcatctggaagagaattttccctcttaaactttcatgaggggaaggaattaatgaaattggaagacccttgccctcttttcctctttgttttctccccaaatctacctggctattctaatgcatggattcagtctcccagtgttagtctataaatatgcagaggacatttgcctctttctcttacaccctttcttcctcaagaagttcaaggagacttttccagtccccactgccctgtcaggcaccttgttgtgccctctcgttctgcagacctcgtccatgaaggtgaggccgtgggtctcatttcccctgcatccctctcctcacctggagtgcagccctgtgaagagctagggctttgggaagggaaacctatttatacagagtgctaaggatcttatatgttatcctttcaggaatacctgatccataaaagggcagctctgcagagtcctgcctggctgaaaggagcgcatggataatagtggtgctttaggctctcatgtcatctcatgaagaagataatttgtgttggagtggcctttgtagctcggaaatgtcattatgcaatattaggccaaaagtgctttgtctcttgttaagccatggggtgtggagacagaaggggaatcgtggcaggttcttgtttctatcagatgtttgtacttgactcatctcagctcacattccccatgccacactgttaggatatttggtcggggttccttttgctttacgatcggccttttcatgcccctttctttccagtggtattgctcaaagtttgaaggaataaaacttattttcactgttaggagtatatggtttatggttttgagacaaacatagtggaataaagcctgtagggactctacttcttgaccacttgtttctgtcttgtaaagaaacctccgtttgagaggaaggatttgcatgctggtgtgatgtgagttgatcatgaaattgcaattcatctgccttccaagccaccacaatactagctttgaatggagaatcttgctgattgattaatgaactgtcaggtacaattgggttttgtgtagcagaaacccctgaaggaaaaaggaaaatgaaactgttctgctctgaagtcttaggacaactacatggcaaaatatttgagatcgctggaaactcctttcagtcctgcctttgaggcagcacaattggatctgaattttaagaccagcttgataaatcatcaggggagaatttataaagtatgaattttgaatatggcaaaggaccttgctgtcacatgtttttcacagcactaggataggtcccaaaaaggtggtggagggggtgaagagggtaagaaggacccaaatgattggtcttttctttccgctgtgctcttcctgagcatgcaaaataatttggtcctagaactggagtcctttctctctctctcccttctttctctctcccaatgaatgtatttattttttaaccttttattatagaacatttcaaacatatacaaagtaaacagaataatataatgaactccatatatacctatcacccagttttaa

SEQ ID NO: 51634 - DNA, 1078 bp, Homo sapiens
gttggccagactggtctcgaactcctgacttcaagtgatctgcccgctttggcctcccaaaatgccgggatgacaggcagcagtctttagtagtggataagaatttgggttctgaggccaggtgcggtggctcatgcctataatcccaacactctgggagcagaggcagatggatcgcctgaggtcaggagttcaagaccagcctgaccaacatggcgaaaccgcatctctactaaaaatacaaaattagctggcgtggtggctcatgcctgtaatccagctactcaggaggctgaggcaggagaatcgattgaacctgggaggcggaggttgcagtgagccaagatcatgcccctgcactacagcctaggcaacagagcgagactctgtctcaaaaaaaaaggggctctggagctggctgactgggttcagatccttactgtctgccactacctattaatgactttgggaagtggctttaacctctgtgaaccagtgcttccttatctgtagaaagaagataagaggctgtctccctcagagatttgatgtaagtaaatgactatatgcaaagcactaagaaagtgctagcacacagcaagtgctctataaatgttaaccactgttactagtggttgtgctaatggcggtgatattgataattatgaccatttattgaagtcctgtatgcctatctttgtgttttctttttgcatcctcttcacagcccttggaggcagacattattattcccacttgaaatgaggaaaccagctcagattggttaggtaaaacttcttaagtaaacttggtggaggtcacatcttagtcccctacgatggacttaaagccaggtctacctgcctcctaaatctgtgttctttctactccatctcacttcctttccatctccatgtttccctttctcttcaaaaagagaagtacagcacaggctgcatttccttccatcttttttttcccccttttttaaaagacagggtgtcactctgttgcccaggctggaatgcaatcatagctgtggcgcaatcatagctcactgcagcctccaactcctggg

SEQ ID NO: 51635 - DNA, 1470 bp, Homo sapiens
atagccaagcgagggcttgctttattttcctgttttaagaacttccttgtacatcaattttttttttaatgagtgggagttgaattgggggtattccatgtcgtgagtactttagtaataggaaagaacatttccaactgatgaacagagtggtgcatattatcagctgattcttatattgtttcccttccatctcccttaactttggtggaaatggaataaactccacagtgtatgatgcagaaatatgttaatacaatgtcagttagaggtgatttctcatattgaagagcaagtggattgaggagcaccatgcttcatcaagcagtggtgccacaagtcttaagtttataaaatacccactgaaaattctcatgggaaggcatggggctctgcaacaggcactataataatagggatagcggaaaaaaaattctcagtaaataattgcttagacacaaaccttaatttctttggatgtcagtttttgtgtttaggagataaaaaagaaaattttctttatttctatctctgatctttgaaagtttcttgagaaattcactggtaagtgaatgtggtagaaaacaccataatcattgaggaattggagtcccaagatgttcagtttttgttttagggagtgcagtttaatctgaatgatttatgtgtgtacatggcaaattccagattattcgtcatgatttttttaaatagaaagagaccacaggaactccctctaccaggaatatagaacagggatgttaatactcagggtacattgccctgggttttttttttctggacaattttaccagggtggatgtttgagggagggctcacaaagaaagcccagagctgaatcttaatttatttgtgtattcctgcttctaagctttctatatgttacttaatctttcaggcttagccaagcattattcctatttagctgataaggacagtgaggttcagagacactaggtgatttgcctttattcacttgacctcctagtagcaaacctagtattttaatctgcttcttatgatttacaaaccaggtcctttctgatggactgagctgcttacatagcatgacaacctacactgtttataatggcaaaattactgtgtgaaacaagtccgaaggggtagaaatttccttagctggagctgtttgaagctgaacttggatacgggtagctttagactctctctcagcccatgaagaaattgggtttggtcactaggggcagattttctgaggccattagggaataatgttctctttgatggacttgggaacttttgtctctggtgctgtgccaaaggcaagtacatagtttatttggaccctggtgcagaagatgtcagatttgttgcctgatgttgggcttggatttgcgtgcatgctgtgtatttttatcctcagagaaatgggttattgaagcctgtgccattatgtctcatcaatgc

SEQ ID NO: 51636 - DNA, 1039 bp, Homo sapiens
gaaagcctgctttgggtttcttacaatgtttatagtcaggtcaccgctctttagaatttggttacttacagttttgtattgattgttgtttctttccacattccctgattagaagctttttgtgcaatgaagccatattttatgttccttttatggcttccatggtacccaccttataatagatggtggtggtatctatgtttaaaaaatgggctaacaattttgtttgaaaagctttgagatggtctacttctgcctttccagggagacaaaaacaactattagtataaaagaataggaaagaatgtttttattttattttgttacaaaatgcatactatgactgtagggtaacttatgtaaagggagacttccttaaggtaaaggctttttggacaaagtttaaataagtacatatgatatatcttgctacattttaggttacccacttagaatatagttcttggcagcactggggaggtccatttttatttctttcgtgattcccaccaagttaggtcctgatgccttcttctgagagataaggcctgtaagagttgtggaagaattgggggctgggaatagtcaggcagggaccaaattctcccatagcagccagcaaatacgtggagcttccatttgtcctgttccttctttcttgcttccaccttcagcccctttgcacaagagacaaatttgggcactgtctccaggttgggggagggtctctgccatgcagataggggcgtctgctcatagccttcttctgtttgtcgtagcagaggtgaaaacccccaagcgccggcagccatttgtcccctttgctctgaggaaccacacggggtgcactttgtggtttgccaccctgaccaccacacccaccaggtaagcagtcagtttatattaccccgagtcatctctgccaccaaagccttcttgtgccagcccagtagagcaaggtgggccccctcttgaggctcttgggatgatatttgaatgaataacttgctgtcttgctgagatttatgatggaggttct

SEQ ID NO: 51637 - DNA, 1050 bp, Homo sapiens
ctgtctgtagtcacgtagggctggagccaaacaactgcatgtggttctgagcgaattaggatttcaacaaaggaaccaagaataattttttatgcatttccaagagtatggttatatgattaaatcgctactgcatttttaccaccccagtgacatcattatataggttggggtgagggttggtgggggaaagaccttggctcgtgtttaggttttgcgtggtttgtacaatggaggataaatgccactcttactcagtcaagctttacagatcttgcagtttgtgttgtaagtgtaaaacccagttaaactgtgctcctgatttcccttgcattaggtaatctccaaaaggtttagccaactgggtttttacatcatatgtactaaatcagatttgtgtctttgcttctacttttcatcccttctggagattgtgcctaatatctttttctttgttctgcctgacagacacacccatgacctccggattcatcaactgcaagtgagagtaaatggctgggagcaagtgagcccagtgtctgtggacaaagtcgggaccttttttcgatatgcagcaccagataaaaattcatcttcctctacggtgtgtgacattcaggaagtcagatggttaagcgactgtcaggaagtcagatggttaagcctgtaataagcttactctaatgaaactttcttgttctttctttcccctaattctaggactgactgggtcagtcataggcattggtaatcaatatgtagataagccagccaatggttagtttcagtagaaaaacaagatttaaaatcagcagtaacacatttcctcacctctgtagatccatttcatgctagctggcctgactggcagtttactagtctgctgaacctgagtcttgtttttatttcacatattgttatgctgtccatatacactgtgtttttaatatttcttataatgcagcaccttgatccttttactctgtgtctccaaatctttctctgtggcacaaagagagatgtccactgtcgtttattttctgatcacac

SEQ ID NO: 51638 - DNA, 1827 bp, Homo sapiens
acagaaggtaaatcatttaatgttttgcaaagtcctacctcattatttctaattttaattgtgttggatgttctttatttaattccctgccagtagagtagaagacaagcctttttcagtttcgttgtaaggaactcaggggctttatgaatcaaggataatttccagcagatactttcttaccaaattacaggaagtttggaaaattggataggttattatcacagtctcaggtgaatgtttttaataatgtttctagaggcttaggactgatttttcttagtgacacactttgtgatatcacatctgagtggattatctgtttttgtagaactttttagaatttttttttttaacagtgtataggatgtttactccctttaaagttgaatggctttagggttttatgactgatttcactgaagaactatagtagtaataagacacttttaaggtagacattctgatcgatattattgtattttatatgttttttcagaaacataactattttgtctttatcgctctttcacagttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacagtatgttttgattgtctagcatatagtaaatgctgataaatacttcttgactgttgtcaagtctctttttccccagtggtatcttccccagcagtcagtatatatggtctgtcttcttttgtcctgagatggtcaatctttggggtggaggaccattgcctgaaagtgttaacccttatttctgtggcagagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggtatgtagcaccactgcagtgacatgtcacttttgccttttttttttcttttggaatgactattaccattctttctctaaagacccttagagattcagttatctttatttaaactctaaagttcttattccttgagttttagttagagttcatgagaactcaagtgctaacggttggtggggtctggggaggctttattacatgggagagacagccaacacacatgctatttacacatacaagattagaagtttgtgttgtacaacagcataaagagaggacatatagagacgggaaggaaaacaaacagaaaataacgagttctcattccaaaattggaaagcaaaatcctggggtttggagttttttgaatgagagatttcaaaataatttgaaggtttatgtacctcatactgactttcttgagaactttgacaaaattgcctaaccatttaaactcctgttttcccattatacgggagtatgttactagattcagtgttggaaataatactggattgctatgttacaccctaacaaatttagactttcaacttatttaatgaggattagctttagtttcttttatagtgaagacaggcattcatttagtctaaacttagagaaaagatacaagaatagtgtaaagaatttcattatactctttacccagatctgcaaattgttaacagactaaaggaagaaatacatcaaatacatagctggagttggtgatttta

SEQ ID NO: 51639 - DNA, 1019 bp, Homo sapiens
catgagggaactttctggggtgagggaaatagcctataatttattttggatggtgtttatagaggtgtgtataattgtcagagctcatcaaactgaacatttaaaatctatacatattattgtgcatttatatcttaataaatgtatttggattgaaaactgcaaataattttactcattgaaccatcttaatgttattctttctcatacttagctaaggagaaaaaatttaagttcttcattaagtctgatgatttttacaccattttatcttcataggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggtaagaatgtagtcagatgatcatttgtcataatcctatgaaaatatcaatgagtattttgtgattatttatttggtaagcatcttggagaaattggggcacatataatatctcaataagccagctcaaaggaatcagtgcagttaaaaaaaaataacctttagctagaggtggcggcagtacatgcctgtagtcccagcttctcaggaggctgaggcgggaagattacttgagtctagaagttcgaggcttcagtgagctatgttcacgctactgcccaccagcctgagcaacaaagtaagaccctgtctcttaaaaaaaaagaacttatagaaaaggatgagaaaaaacttatcaagccgaaaggtttacagaggaggcactcaacagagccttttttcttacattgctacatgatgtatgattgtaggaagtcatttcatctttttaaactatgcttttcccaagcaaaatcttatgcctcttctcttt

SEQ ID NO: 51640 - DNA, 1035 bp, Homo sapiens
tatttcataagagctagaagagaggatttttagtattctaattagaaacgatgaatgtttgagatgatgaaaatgctaaataccctaatttgatcatttcacaatgtgtatatgtattgagacatctcactgtacccccaaaatatgtacagttattattatgtgtcgattaaaaatttaatttttttttgagatggagtctcactctgtcacccagggttagaatatcaaaatatctaatttatatctaatcatatgggttaggatatctaacccatatgattatgcaatttaggctctctagtgtgattccaggccttctggtttgcttatattgatccctaccctagctagagagaaagagccattctaatgaagatttttgcagttagatacttagttattggtttttccaaaaggaatccaatttacttttgctgtgagctattttgacaaatagtgagaactctgaaagttaatagtttgtatcttctttaggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacaggtacatacaggggctgctcaagtaggtctttggcgttagtcatgggaattcagatttatttgcttagctaactaaatggagccaatgcaaatagattacttcaacagtctgagctgctgaaacattcctgcttccatcataaatgcttaatcatgctcaaaactgtctttttaggcaagaaactgagcccactaaatagattcagttttcactcttttcccgcttgatggttttattcattcaccatttgcatctctttcagatagactgggtggtattgatgtaaacttttctctccttcctaaagggttgccactgatcttcagacaggacaatgccaagaca

SEQ ID NO: 51641 - DNA, 1088 bp, Homo sapiens
ctcctggggatctgaggagccacctaaacactgcccttttgaggtctgtggctctgtttaatttcagactcacctgtgtcaggaaagtatcagtttggcttgaatccttgtttttcgggggaataataggaacacttagcatgcctttcatcctccaagtattcccacgcattcattaaaatttgcaagccctaagagggtaagaagcattgttctccttgaaactgaaggagagaggttaagtgacctgcctagatgcaaaggggaagtctgggtcagaagtaggatcaggattgggggatacaaataaaatgcacttggtggttgtagtaattaaagcaatctccagactcactttgcttatggagatgggaagggtggaaaggggaggggaggatactgtacccatatgcctcatagccacttgagaacgctcaaaagattctctaaagggttaagataatttgattgaaatatgaatcagggtgaaaattgtagcagcgcatcctttcagtatataatttcccagcctctcaaagcaatgtttagttttgaacattggaacaccatctatgactgcatggtcctgtagaactttctgtgatgatggagatgttctattttgcactatctagtagtagccactagccacatgtggctgctgagccctggagagcacattagtgagaagtaaggcaagtatggctgaggaattgaatttttatttaattttaatgaatttagctttaaatagccacatatggctactggcaccgtattggacagtatgcacatagtgtcatagttccttcctagagcaaggaaaaactgatgtgatatcatttacatatttatcctgagtcccatggagaatcaaagatatgtttaaatgtctgaggatttattaataaaagaatcttccaagtatagtttcctctttggatttttaatcataggtttgtattcattctcccttgacatgtgaactgtcttcttaaagttgacattaagatttttaaaagaaagaaacttgatttgatcttgcagcacaggatagttatcttaacttgttctcactttcgtttgct

SEQ ID NO: 51642 - DNA, 1100 bp, Homo sapiens
tttaacgggcagtcctaaactactgcgaacagacctatgccatctatttcatttactttcctcaccttttcatttggaaacaatttaaactataggaaagttacaaaagtagtaaatgaatatccctatatcttgtacctagatttaaccagttttcagcatcttgctacatgttgcttctctcttcacatacatgaacacacattttcctttctgaactatttgaaagtaaattaaagtcatcatgatacttaagccataaaaacctcacttatcacccaaaaatagggacatttttctaattaaatataatactattgtcacatactgatgaaatttaaccttgatatgttttctaataaatagttttcatagactgaatgaatgactagaatgtccttcatagcaactcccttcccattgatctaggatccagtcaaggatcatttattttagttgccacgtgtattctcttgtcttctttaatctagagtagtcccgctttgcccattttgtctttagtgacattgacatttttgaagactccaagcaagtttcttgtagaatgtcctattttctgcatttgggcagtgatttcctgtctgtagatttgggtcaaatattttcgatagctatactttctatgtgatgctgtgtgtttcccaccatgtcacatcaggatgcctgtgatgtctgttggtctcattattgttggtgataagttgttcttcacctggttaaggtggtatccagcaggcctcttttttgtgaagtttcctttgttctttgtaaataagaataatcccattgagggaataatttaagacaaagtgaatattctgtttcccaaaaacctttcattcaatggtttaatggttcttgaatcacttattacattggtggttgcgatgaaatttatttatttatttatttatttatttatttatttttggaaacagagtctcgctcagtcgcccaggctggagtgcagtggcacaatctcggctccctggagtgcagtggcgcgatctcggagcttctcgggaagctccgcctcccaggttcacaccattctcctgcttcagcctcctgagtagctg

SEQ ID NO: 51643 - DNA, 1015 bp, Homo sapiens
gctagaaagatgccattggaaggatggaattgctccccttagatatttgacttggcaaagcgtttaaagcctttcattcaataggatatatgtatatatgtgtgtgtgtatctgtgtgtgtgtgtgtgtgtgtgtgtagcacatgtcttttaattggtgagtttttttggaatgtgcaagatgattagaaacattcgaaaggtgagatgatgaatttcactggggcttatttcctgtgtaagattcatttaggaaggatttggaacttaaacctacaaagcactgactcacttttcagtaaccccactctgaatgaaagtcctctttgtcctctctgccatcactctaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctgggtaattcttgattaaattactgttcctataaagcagaaggttctaattattaacaggttttaaatgttaagcagtttcttaggagaccaaagtacaaaggaagattctttcattctttaccaaaccctgggctcagtgtctatcttaagaggtcatgtaatttaaactcttgacttttggctagattaaaatttatccaaagagtcaagacccttcttgtgttaaagatctctcccaagaattcattctagtatttaaattttctttttgctatttattagtctgttttgcctgtttcctcttttgaaactgactaatcttcatcataattattcaagtcatcattctgactctcctcccaccatcccattgagaatactggttaagcagacacctaagggtctgtcttaatattcacctaaagccaaat

SEQ ID NO: 51644 - DNA, 1019 bp, Homo sapiens
ttaatagagacgggattttgccgtgttggtcaggctggtttcgaactcctggcttcagcagatccacctgccttggcctcccaaagtgctgggattacaggcaggagccaccgtgcctggccaaattttttgcctttttttttggtgggggggcctctaaagatatatggttatacttttgcatctgaattttaagtcactaaaattatgaagagaagaaaaatgtcagagtatgtcttctgagagatgaatcttggaactgtgtagggaaaaaaatgcaaccctgatctttctgctcttgcatcagactttttcttctatcctttaaaaaattttctttttaataaaagttttgggcatttgcttattaatacttgaatacatgtgtgagtatgtgtgtgtatacctgtatatatatttttatgtaatatatatattttttaaattctagcttgcaggagggaacaggcaggcctgtggcttccaacaaggccattacctgtgcggagctcgttttggatgtctcacccaagacacaaagagtcattttaaaaaagaaggtaagagagcttacaatcagagtttagaatacaaggtttttagcactggacgggactcaggatcacccagtgcagagtccttatttcatgatgaggccatagggacttgtgtggaacccaggcctcttggcatttccaggtcagtgttagggcggatgagtaccagctcaggagtaagatgacttctggagtgggatgtgatcaccaggtgtgatcagcagaacgtgaataataaatatatgtggaattactaagggctgggtgactgttaagcagacaagaacaaatttctaagattaagtagcaataattgtaacattttatataacattttataacttatagaacattttcagttattatttcacttgataaggatgacagctagtaaataggtaataaaagagttacattgacattgaaaattaggttaaagtgtatgaactggcatgaagaaat

SEQ ID NO: 51645 - DNA, 1017 bp, Homo sapiens
aaacccctccccaacctcccaacttggcttcagcccctgctctgggctgccccatcgcttaggtggatgcctttcttgttccacatgcgctttaacaattccacactgggccaccccaacccccatccccaccacacacacaagccccatggagttctgccttccacagtcccatctaaagattttagaactaaattattagggaagggaggaagggaactggaaggagaatggtgcatctcagattttcaagtggaaattttggtagtttccaaattatgatgagcctggacaaatgggcaggcagtagaggaatcccagtatggaaacttgatctcacctgggtatgtctgtgttgattcccagtctgcagcatctacaggataaccgagatgcttttcctgttgtttctggtgctgtgcagagatgctttctgtttctgtgaacagagaagcaagcatgtgggaattggagatgggaagcacagcttagcttcatctctttttgcagacagaggaggcagtagcacacagcagagacagcatgatgtgtttttaggtttgagttctggctttgccacttaaagatatatagtatctggtatttcccatttctctcagtttcatttttcaactgacctcccagatttgctggaaggattagctaagataatgtacataaagtgctctgtaaagagatgtaatgataataacacaacaaacatttattgaggctctaccctgtgccaggcatgtactaataagcgtgttacatttattacacttatcacaaaaaccatgaggcaatttttctcgttgacagatcaggaaacggaggctctaagagattaagtaacttgtccaaggtcattcagcttgtaaattgtgtagctggatctcagatcctggcattttgactccaatgttcatgctactttgttagtttttaccttgtagaatgtgataaaaagctatctgtccggccaggggtagcatgtaaatgagtttgtggtaccct

SEQ ID NO: 51646 - DNA, 1085 bp, Homo sapiens
aggccaggagcctttaaacggtttcatgaggtggcctacagcagtcctttttccatttagagcattggggtattacaaaagaagggctttaattgagcaatctagtttggaagaaaacccacattttaatggtcagagtgagagggtgggggttagggggagtttcgaacaaagacactatttaaaaagcctaaaactgtcttctcaaaggcttgaaataatttgttgggaaacttcagaccctttacttttttcctcccctccctaaataaaaaccagatttgttaaaaggaaaaaagatccagtattgttaattgtatttcagaaagtgccagagagggaaatatctctgtagttttaaacattgtcccaagagggaaataggcaaataccctgcttcacataaacagtctctatgtaccataaataaacctttaaagaatgaattccagacagttttgtttagtgcaggataaactaagaaaggaaaggacatggccgagggaatagcttgggatctgagaccttatggtatatagacaggtatttcttctttcaactctatgaagtttctggaagacttcagcagttttcgcgtggggaggtagaaatagacagtttcctatttttattaggagcttatgaacacaagattgccttctccaaaatccattttataacaggaaactgtctgctgcttgagtaaataagcatcaactttgtatactactgtatttgattagtcatttagttactacaagaataagccctgtttggctcgttccctcatctcgactttgactgtccagattaacctgaaggtggcagaataattcataccactgggctgtatctcagctttttcaaatgtggagtcccaaaagcagtaaatgactaggtaaggataacttttacttaagggccagaatatttcctcgattcagaccaagcaccttagtcattcggaaaggtaatagtgtctatgatgaaggttttgacatttcagtagaggtttcaaagtctttgctactttgtgtggttcttctttaatatttggttgcaaggacaaagttggggtataaaag

SEQ ID NO: 51647 - DNA, 1042 bp, Homo sapiens
gagggagggagggagggagagaaagaaaacattaactactgtatcattatctattattgtgtaacaaatgacgccaaattgcagtggtttaaaacaaccaccatcttatttgtttacaattctgtgggttaataatttggactagacctagctgggtgtttcttctgctggtctcaccagtggttgttcatatggctgcactcacctggcagttaaacgcgattaaatggtatgagatgacctcagtctcatgtccagcggattggtgctggctgtcagcagaacccctttccacatggtctcccatcttcaaggaagctactcccagcttcttcacgtggtggaagcatcaaaacaggcagtgcagaagctccaagctctcttgaggctcaggctcaaaggtcacacattattatatctctcgcatcctattggctgaagcaaatcacaaggctagtgaagattcaggtggagggaacatagacttcaccacttgacagaagatgcaaagaatatgtggtcattttaaatctaccacagtatctaagaataaacccaaccaaagacgtataagacctctacacagaaaacaattaaacattattgtgaaaaattaaagacccacatagatgaagggacataccatgtcgataagttggaagattcggtaaagttgtcgttgctcctcaaattgatctgtagattcagtacagtcctgatgaaaattccagcagtttttttggaagcaaattgacaagctgattctaaaatttctctgcagttgaaaagcgcaaagagcagctaaggtaaccctggagaaaaagtacaaagttggggagagcttacactattcgatttcagaaattattacaagactacagtaattaagacagtgtggcattagtagaaagcagagcaaagtgaaacagaagagagaatccagaaatggatgtataataccatcacgtgacttttgacagcatttatgccatactgcggtagtggaacggatgaccttttcagtaaatattacttagttcaa

SEQ ID NO: 51648 - DNA, 1073 bp, Homo sapiens
actttgataacttttaggaaaactgtctgaagataaatataagcaagttgagaccgagaaaacgagaaattcagacagttcagatagttcagtagaaaatctagctaggactttaaataccattttgttccatttctttggtttctgtttgggacagcagtgtggaggagctgcttcttttcgaagcaaacctttcaccagccctttgtcccaggacaccagatttggtgcctagccatgatccagtggaaactgactttcctgtccctgcacagagactctcagccagcccctgccatcagccagccttctatcatatatactatgaccttgttgaggagagaggggcccatctgccttttgtttaagaaacagcattttttgttgttgtttactttgcagtcactgtatttataaggctcagacaaaactaagagcaatgtttattcaaggtgaaaattttatctttgcacaaaagaatgcactgagtgagtccctgcatggattctgaaggcgaaaaggcaatttatgacttgtatctgtttttgtcattatgtatgactgctccattttatagttgagctgattatccccataatagcttttccatgtacctataagcaagtaataggtgaatgccttctcataagcattggggttttagtgtatttaagttggcacaaaacttcagggtaaatgaaattcacttcagacagtgatctttcccttagagaatgtaaggctttctattttcaaaaagactttgatcctaaataagtcacccgagggatttcttttccagtcaagaggaggtaccttcgagttgttgtacatagggaaatgactcaaatttttggcatcagaatttttgttttattttcctctgataattttgagtactaaaatcattcccttagtctgagctctttttggttagaagcaaattttagatgctgaatgactcaccctaacttgggcaactgtcaaccatcttgggggatctaataaaagtgtatttgtgggggccggggtagagtggtgtcatgagaactgcaagtgaccaaaattcacag

SEQ ID NO: 51649 - DNA, 1065 bp, Homo sapiens
gaattaaaataatatttatgggaaatatttgctttattccaggaaaatgtttgaagtaaacatttcctgcaagctgttgaatttatataataaaacattggtttggaaaccttaattgttttcactgaagtgaaaattaagcagaacatgcttcccaaacagccccttgtctcagttttgttgccattgtaatgttcaaagcaggatattgtggccattgaggtaattttctctttattggtaacttggaaatgagcaaggatcatgccaaagttagttataaaagaggaggcactcatggctccttgtagttttatagcaattcaacctttgtagcgtcctcctgttactatttgatcttcacaaacttatgcattaaagagtcaagtttatccccatttgacggataaagaaattgagtcacagtgaaggtaattaacttctggagggtcaaacagggagtttgtggaagaggaccaggctctttacagccccaagctcttttcaaagaccatactgctgctctagaaagcactctttcctccttcaggaattaaagcactttcacgtctgtgagataatttaaccttgcaacatcccagtggggccagcaggttaggtatgattatcatttcccttccagtgatgggaaattaagttacacaggttaaatggttttgccaagaccgtgcagtcagtgttggaaccaggggatggtgcccaggcttcacaaacactgagcccactcttttcctaccacactaagccttctcagaggagagccagaggagcttctgatgccttgaagacagctgtgaaacatcttgcttccaagagggccttgctttcctagcacccacgccagattgtgtgaatgcttggttctatagtctcagcgggtcatgcaaatctccagtcctacgatcactaagaaacaaagcaaaagggggcaaagccagatagattttaccagcctgtttggattttgtgtccagtagaattagcaagtgaaagttgtaggattgctacagaagagttgcttagaaatcaattaacgtgacaaac

SEQ ID NO: 51650 - DNA, 1026 bp, Homo sapiens
cacacaggacatgggcacgcgtcacttaactgtggttctcacagcgtctggggcaccagagagacacgtttttgtctggaacctgaagaacgctggcagcctacataattctaaacatagcaggcactcttattgattctttccaaaacaaaggtcacatttcctttctgtgtagtttgtgtcctgggttcctgctgactgttttgtgtatacgattgttaccttctcaaagagactgtcagttcttgagggcagggttcaaggctgctgtttgtttgtgttcttcagcagtacctaaatctgtcctgggctcagaggaagtatttagtaaagacattctaccttgggttgtaggtcacacagtgccagagctggaaaggattttggaaatcgtagagtccaacactctaattttgtaagtggtaccactccaaaaacttacttgggaggctggtgtttatctgctggaaagagaggattttattatgttaaactatagtgcaaatgaccataattctaaacctttgacaggcttccctcaaacgctgcaggcatgttcctccttggactagtagcagagtaataagaacagtaagaatgctaactagataccaggcccccgagccattgtcatgaatgcttccagccacatgacaaagtaggtactctggctattctccagatgcagaggaggctcagaggtaggtgacctcgctcagggtcatgtagttaccagaatggtcgagggaggactgaagtttggtcagatgccccagcttgtggcccttctcctatactgtggtaactctcagatggggtctctgactgaagccactccttagtgattcacggtgctagctttgcagcgtcgtgtggtgtttccagttgtcctaaaggaagttattaattttcattaactttaattctctcattagacaggcagtgatatggaaggcaaggcagaaagcaaacaaataatgataggggttacatctccagaaaggtcaggaatcactgccctaggtt

SEQ ID NO: 51651 - DNA, 1165 bp, Homo sapiens
gctgtttgcttgaatggcctattttagcctcccttttccagagtgactaattggggattcttatcaacaaagggtataatgaatgttaagggcccagccaagctagactcgacttaagcccagaaggattttgctgctgcttggataatagattttccctgagtgaattagtacgcccttttagaatgcctagggcctggcccacatccacaccctatcactccctcaaataggatgtgaagtgaaattgtccccaattgaagtgaatccatttgtctgtcaccaggaaaacttactgaagacacattactgcagtaggggaaatgctccgattgtggactggggccatgcagtgtgctgtgccagaatgccttccatctggaagcagctgagtaaactctgtatggtttactttagttaagttacattctattctcagatacaaaactaaaacaatccttgagtatattttgaagcatttatgaagttgtggggaggggcaggcagtgaggaggcttcgaaagtatttccagttagtttttccatctctgctcgaagcccaagaagtccacctccagtatttgttaagataataagacttaatgaagtgtaaagctgaagacgcctaagagttcccaaagaagcatgtgtattcttaaaatgtcaaaatagccaagggattggttgattaaaaagggttcaaggtatatgtgataaattttttaaagatgattttgtgctgtgaagttttaataatgttgacgagaaagaaacggcttgaattttatacattgtcagcttgcaagtcttcatgggggtttttcattctttttaggagcacaagtaatgtagccacagtcactgcagaaagaatgtctttgagagggacattcttgtcatttttattagttgttcaacattgccacagaagtttgattttctgtcagccagtacatagctgccatttattcattgcctgtcagtaaatagtgattgaaaatttcctatgaactcagggttgggaatagcagaaaccaaaactgtctctggtctcaaagagcttataatcaagcagggcagcaaacataaaaaattatataaacacttatttgctgaaattgtgacaaatgacatcgaggacacttagagggtgccgtgagactat

SEQ ID NO: 51652 - DNA, 1048 bp, Homo sapiens
acaaggaaagagaacacttgatctggaaaacaacaggccagagtcccagccaccttacttattagctttgggccctgggtcaagtcaagacatctatgtaagactcagttttagttttttcatctataaagtggggataaatttatctctctgtttattctgcttctcaggggtttgaagcccaaccagagttattttaatgtggaagctataaagaactataaaaatgctgggtgatattattttaaagtcctattaaaggagcgcagagatccttgcaggtggagaaatgtttcagtgccagtttgttctgatgacactgtatctcttaggaacatactggctctaacactatcaccgagggataaatcaccctggtttcttggaagtgagttataaccatctccaaccatcccggttgattgaacaggatccaggggtgttactcagggtttttccccactgtttagacaacagggactaacaaatgatttgaagggattagaagtgagattctgaccgagggttgacctgagcccagggaccaagccaggaatagaacccaagagtccaagagttctgcctctgagcctgcaattggaatgagactttctgcttcctttgtaatatttcatccaagtaaaggcttagatcttagcatctatgttttaaaagacccaaattttaagcagatgataggaaagtaagccataaaactgtgaaagagtactccttccagtaatccatctgaaaagtggccttacaggaaacattggctcttttttgtgtttatttgaacatgattttatttatagggaaccccccctccttatgttcttttagattaaaatacttccaagttcctctccttgttggagtgcgctggcattccaagcgacagccacctaactttcctctgaaatttccaggcaacccaatagttctcaggaaggcaggtgggggtggggagagaagagggcggaggactgcagagcctttggcctcaacatgagtgttgtggaccaatatcccccactgcatttgttca

SEQ ID NO: 51653 - DNA, 1085 bp, Homo sapiens
tctgcaaagagaacttaggaaatgcttccattaactttttcatcctagctgggtaatactgcttttaattactctgctctgagagcagccatttcttatacttggtattacacataggacatcaaacagaattggcttgaattgagcctttagggaacttccaaaggtaaagattgagtaaagattcaaatgtttattaggatataccagtgttcatttttttcccactaatattccattcaaggcaggagactaggctgatatcccatgtatctagagtggatcaagtccaatatttctttcagagttcctgttccttaaaactgtaaatgggttttatattttattccatgtttggcttaataagaaaatatttttaattgctacctggtaaaattaacatttcagaaagatctgatatgttatcctgtggctcctgcctcatacttatctaggaagttccagcacgctccttccagatgagtccggtacgctgtagtagcatccatatagaggcatgtatatggtagaggtgaaaagctggaacttgtacctgtttgaccctaaggctctggttctaatctttgggcatatctgtcttttggcttggtgtaacatctgctgcttgggacagccattgtgttagttaacatgtcagtttcatcacgaaaaaggcattacatttcagtgaaactgaaaaattattgctatatccagctgaagggaagggactgtcaaatatctcctctgttgtccaaacatggcacagtagatatagtgacagtccctttatcttctactcacccttgcgtatatatttgtgaggtgagagccatatattctcacttcctgatcttgccaaaccaggtccttccagagaatgcttgaaggtagatgggtcattttctcattcctccctctacgtgagcaaccccagaagaacactaagacctgtgttgatgacattggatgtctcacttggctctgaaattaagctgatgaaattataggatcggatattttattttattttttttcaagacagagtcttgctctgtcgcccaggctggaatgcagtggcacaa

SEQ ID NO: 51654 - DNA, 1016 bp, Homo sapiens
aaagttgctggagtaggataaacccacagtatttggataagctcctttgaactccttgtagaaagcagtttttatgaggcagttgttctgtgttaacaccagagacaattcctagcagatttccccaaacatacttcaaacatcgataatggcaggggtgacccaaactgtatcataaaatcccagggactgcaggagacttcaaaggggagacagagcaaaacctcacttctcgttatgaggagtatgggtcacaggaatcctggctagaatccatggtaacctcgcggagtaatgccaggatggacagaggccagggctcatcagttccctagactttactaattgaccccagcagcacagttagagtggtaataactggcacctgcccacctcctgaggtgttagaggccaaattaccacatgtgaagtgcttttctatcctttagtgagaagatgcaaaccttgaagtgtgtttctatttttgtttgaactatcgagggcccagttaattcagttgagccaattctgaccttgggatattcagatccatcacttagtatgtacaggcaaattgacagtagaaatttattgagtcttgaactcctactatatttcaggcatttaataagtattaaatactgggaatatttaaataattgaggacaaactgctctgaagaatcaccaagctgtttggtttgtgtgttaatattcttaagccactcttacgtgttcattaaagcaagtttccctatagttttcttgaagaactcattttttagtgatttgacttactctttattcttgaaaacaacaaaattgcatttgtgcatatggtatgtgttgaggggggtaattacaggcattttttccctcattaccgggtccgttacagctccttgaaaacaaatagttatagttttactaattgtttataaaattagctaatgatcctttgattttttagtttttttataccttagctgtatttaataaatatttagtatcttctgt

SEQ ID NO: 51655 - DNA, 2483 bp, Homo sapiens
gccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctcttcttagaacatatgataagtacaacgcactgtagtgacagattttttaaaaaccctattaaagcccaatatactaatgcagattttttttttttaagttttagagagattcatgggattttattctttttcccaaaggcagtggtggagctgacagagtagcatggagcctcgtcctgatgtattgtgcggaagtggcagcagttcacattcattcagtttgtcagcataggatcagttccttcttgactcaactctctgtgatcaaaataagctattggatgttccctttgggtactggaagcagcttggccccttggcaagagaacaggattgcaaatcacaagagcagagccctgactccagctctgatgctactgtgctttgtgaccttgtgcagacagctttatatccccatctcaggtcattctcccccatacaaagggggagagggtcatccttgccctggtcatgtctgcatggctgaggtgaataactagttgtgtaacttcctggaggagtggcacagaggaagctcccttcctagggctggctctgccatcagggaggaagctggatattagaatgaagaaaaagcccatgcagaatatatggcagcccgataatggattctaaaaataaaaaagcactaggttaatctgcagctgtagtgtacctaaagtattctttggcaggttgtggccctagcctaatccccagctggacttagcaccatttaagtgagttacatctcatccccgcaagggattgagtctgtagccaatttggccttgtcaccacttcagccctccctctgatttcacctttgggaaaactacaaagtggccccagacatacatagcaggcttgatcacatgggtggagtctgtcaggacagcatacatcaaataaaatgtccagggaacctgttgtaaataaaccacttcccgcatgctcagtcatcgtggaggtacttgaatgtttagtttcttttagctgatggccaagaaatcaatgtttaaaaaaaaaaaaacaaaaaacaaaaaaacaccttgacagaggcattttgtacaagaatggtgtgtgggtgtgaaaaagtaaattccaaaacatatttccttttagttcccaaacccatattagatgagtacttcttagccttggccacagtgctagagtaaatagcagtgtcacatagctcgtggaacaggcaaaccacagaatgtacaagagagaagcgtgcacaccagtgagtctgctatggcagctctctttgtcctggtttctacatctcatttgtaagcaacttgtgttcctgcattttcagagtttggccagtttatttacttagaattgcatgttcctggaatattgtcataaaagtgatcctgagatagaaaaagtcaacaggaagcaggggcattgagtttataagttctcagtctgtcttggcccatattaaagtctcattctcaggggtaggtccagctttccaaattttaatatatcagagactcctgatgcatctgggctcatgatgggccaaagtaggccttcaggagtcctcgtgttacacactcaacgcctaatggagactggattcatttacgtgtattaatgtaacctgcgtgatcatgtgagtgcaagtgctttgtagattgtcctgggagatgtggcatattatgactaaagacttaattgaaccctgaacatgtatatgaataactggagacagattgactggattacacatttttcttgaaaatttcctaaatttagcctacctctttgttgccttttatttcccagcttaagtggttctctataacactatattttaaacaaaccagaacaaatagtatacaaaagcatagacaagagggatataacaagagatggttttctgtgatccgtggcacctcctctctaccctgcctccaccaccaaaaggggctttaaattaagattcggaatggcaaattcacttaccagctccaaacacagtagacaaggaaaccttgtgaggaaaatccgagagtatatttacagtttctgttcagaaatacatagcttaacttcgaaggaggaagcgtgacttttcacctgcagatagaactagggtctgatttgaaacagaccactggcttcactgaaccccatcaaagaagtctgcttctgcccggaattggaaagtgccagtgggcatgtagttgctagtatgggatttctgtttttatttttaacaagcttgggcccaactcttagtatcaa

SEQ ID NO: 51656 - DNA, 1109 bp, Homo sapiens
agccagtttgtcatccatgtaagtacatatctttcttccagatattaacaaagtttatatcagtctcttggtgaattccgttcctgtaagttagaatctgcatcatgactttataaaagaccatcactgtgcctacagttctttaggaatcgctttggcattaagaatgaggcttcagccaggcacggtggctcacgcctgtaatcccagcactttgggaggccgaggtgggcggatcacgaggtcaggagttcgagaccagcctgaccaacatggtgaaaccccgtctctactaaaaatacaaaaattacctgggtgtggtggcgcacccctgtaatcccagctactcaggaggctgaggcaggagaatcacttgaacccgggatgtggaggttgcagtgagccgagatggtgccactgcactccagctgggcaacagagtgggactccctctcaaaaaaaaaaaaataaaaataagaatgaggcttcagccagatgtttttggattatatgtggcgtggcctattacatggtttttatttttgtttcctcctatttcttagtatttctttccaccagttcctgttgtaaaacgtgaccagttggtactgatgctgtacatccttgtattagtaaaaatcctgctgtgcctggaggcagggacctgcttgggccaggccttcccaggaagcccgtcctaccctctgtagcatatagtgccggaccaccccagcgctcccacttacctccttcactctttcattgttgatacatgggctaggtttcctacagagtcacttcaaggatgtagatcttatcctcccaattggattgtgagtttgttgttattgccttttttggtattcctcaaggatgttcagaatacctcacatagtgatggactcagagtacctattaaagagattttcattaaaatcacaccattcagtaagttgaccaagtacatcaagagagtcagaaagacccaagatctagtttggctttgccaggcatagcttcctcatccataaaatgaaatactagtaagatacttccttatgtgaatcttgggaggctcggagtgtccagtacacattcagcactcagtc

SEQ ID NO: 51657 - DNA, 1062 bp, Homo sapiens
aagctggttgaggaggtgttgatagcacagagtgtttttacggagtgtcctcggagggttacatgctcctttttgttgaatccgaatctttttttttttctaatatggagcctcataatcattcaaggactcagtgtgatgccacaggtttcaaacttgccagttcgtctcttatgttctgccaattttttaaaagtgggaatatgagtgcatgtgcacgtgtacacacacgtgtgtgtgtgtgtgtctttgtgtatgtaaaatgcttgggataaaaaaagatggatcaaattttgtctggcatggcatagcaactctcacctctagtatcctctaaacatttaaccaaatggactttaactggtttacttcaattctatttttattttcgtagtcatttaaatgtatggggagccaactctttcaaatgagacattttgtcattaaaacatgttatttagtttaaccgcatgggcccggcttcagcaacattgaggactgtgaagagggttctgagcggctgttctctcctgacctgaccgcagcagtgacccaccagcttgcaatgcacgcaaactgaaacaggcaggatggccagcccagggttgtctgcacggtggtcttggcatctgtaccttaggttgccagctcctggccctccttgcctgcatttggtggcccttggccctgccgtgtcatatggcacaagagcccttctggcccgcatcaccctgtgtactgattaggcaggaatcagcaaatccgttgagtgcatgtttaatgtgacacagatgtgggacatactacagatctttctgctttacaaattttcagctttttgcatttcatcagtgttgcttattatttacagaatgtaacttgagacatcagaacagattgtaatttttaaaaaggttgttgggggggtgggcccgcaggggatctgggagaaaaaatccagtagtgtggaatgttgtttgctgtccagaccaaacaaaccagtttgccaagggttgatggactatgacaatcagtccaattcatgttaacactgggggcact

SEQ ID NO: 51658 - DNA, 1171 bp, Homo sapiens
gagattataaattattgcatgttttcttttcactttcctccccaactcacctctattcaagtcgaactatctctggtcactgtgaaatttgtttgcaatagaagaaattgcgtggtacagccaacataggactgctcccagtgagatacacacattgaaaaacagagccagagagagctaaaaactggaatcgaaatgaaatcagtaaaatagctttcatgaaactcatgaaattcatatgaactaggaagagatattggcatgaatgaattttgactttaaagatgaaaaccatgtgtctccacccaagttgtgggttaaatcttgccaatgaatgctgaaggaggcacgtgaccacggccttcccaagtgtacaaggaagaagccatcagggagtgtgtcgcatgttcctctgaagtgtcctcagttgtcagcctgggtcttcgcggtggagtgaacattacactcatcactctgcaagaaaggagttttcaggaaaagcccacgagcgccaaattatacctctgacttttatcctagatttgtaattaaaaacatgtttaaagacctaattatttgcgtatttcccttcagagttaacccctttaaaggatctttaataccttgctctactgttctgactaaatgtttccacatttttttccagttaggctcactgtttcacttctggaaaatattgtgtaattatttcccgatggagtgaaaaccccacgaagtccccagtgccttggtgacttcaactttattctcccagatcgagttgcatttaattttgtcattctatttaattaattaatattaaaaagatagttaccaacgtatgatttctggtctggccagctgaaaagtcttcactttcaaattaatcatatattcctctgataagttgcacaattgtcattgcttcccatctttctcagttttggttttgaaacaggatctggattaagatgatgttaaagtaaaatttgtcctatatggtgaaattaatttttctttctaactcatgtctcatttgtagccagaaactcattttcttttttttaaggtacctattttatttctaatactgcatcacctataacggtgcacaccaggctggtgagcagtagggtggctcctgccttttaaaaaatgctcatgagcaacc

SEQ ID NO: 51659 - DNA, 1056 bp, Homo sapiens
taagaaagcgttttctgactctttgagttttctgaacatgaagtggatgggggggtgccctgtccctggaggtgctgagcttagagagggaggaagcggatggggaggtgcaggtgttttaacgccaggctgtctcttcatggcgtgccatttggtgaacctgtttaattctgcttttcccccctcagctttcagcgcccccagctgcgtcttctcgccccttcatgtttccctctcctctgccaggcagtgaactttctcagctgctccttcagtttcacattgaaaggcatcgtgttttctgttttgtccaatagagtattgttacagttttctgtaagctttaagctatccaaaaatgctcacagaaaaacaacaaacacccacaagatagaatttcaggatttagaagtatttcccggcaagggggccgggattcgcactcaggccctggggccacagagcccgcagtgggcctccccctgatgctgggcgaagccccaggtgtcactcctgtgttcccgtctcgctttgcagcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtgagtgcctggctgttctcaggctcctgaggggcggggccagggcctcgatgcctctgccctgcttccccgtcctcagcaggaactcatttaggaggttgaggctgggcccttcccaggagtgctgcctctcagtcctgaacatgggaggggcccagggtatgttcacggggcgatgctgccctcccagctggcccatgggtgaccctgggaacattaactgcctcacaacgtttgtgcctcagttacccgtagatgtagtgagggtaacaatactt

SEQ ID NO: 51660 - DNA, 1049 bp, Homo sapiens
tggatctgattcctggatttccccatcctggggacaggtgacccatcctgttctcctccttaggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaac

SEQ ID NO: 51661 - DNA, 1070 bp, Homo sapiens
tctgatgttggagggatgtgatgctctctgaggaccacggaaaatcactttctgtggggctggtgcttgggaaaattcccgcctcaactggccctttgggccaagggcctggcttttctcccagcatcctggtctttgcagggtgtgctggcctggccatttcccattgaatgtcccgcttcctctgaatcccctggccctctgggcccagagccacagcctgatagcatgagaccagtcagccggaagggttaactccaaggcagttgaccttcgtcctagcagagattaaaccgattcctaattaatagcctgtaggatagctaccttggcacagcttgcaagtaatttaaggcttgtccttagaggctggtccataaattacgtttaattagctgaaggtctccctgggacacatcagcctggtgtgtgattgagcctaccagctcagtgacctctgaatttcatgttggagtatgagggagatgctgagatactccagtaaaatgtttatttccttttccaaaacaagagctgaattctttcttctgctagcagctctgaggggtaccgccaaccggtttgggggtctctgctcagctagttcctggctttgctcttgactaattacttatatttccagggtctcagtgccttgtctctaaaaagaagccgagttcaagtctacagacccttatctgaaacccttaaggctagctgtgtctcataggtctgatgttttggactttagaaatgcaatccagcagataggccatatacctagtgatgcccacagcaaggtctagggcagccacccgtaatcacagtgatagttaccacagtgggataaagagaccagaactagcctcatgatggttccaattagggcttgctctaaacgcgtgtgtcaaaaataaatgtaggattttagagctttttggattctagaacggaggataaggggccgtaaacctcactgttgaactcagagaagctcctaaataaatgctaattatgatgagtactgttgttattttttttgttttattttacttgccgagacagagtct

SEQ ID NO: 51662 - DNA, 1049 bp, Homo sapiens
ctagctggcgcctcgtattttccttggcaacccgctacccagccccaacctgggcggctgcagctctgaagacacgagagagggtacttggtttgggtttgaaaagggaagagcggtcttgtatgcagtagtctggccggaccgacactgagaggcccaggtgtttggaaagcaggaaagaggaggccagggtaagcagctactgataaagagcccttgttctcaccttcaaccctgtcccctcccccccagtacaccccccagggatccctccccatttagctggaaggtggtgctgcaaggagggtcctgcccaccaaacacggcctttaactttttggtggtcctggcaccccttgctccaggttttggagacctggtgccagagtggggagagtgggcaggctgtcacccaactcccagcccaggccaggctgactcacgcggtgaccagagccatcaggagagggaggcaggccaggctgtctccagccagccctgtgaagaggaagagcgaaaacagggaattagtttgaaacttaaactgttgtgaactaggggggtgaaagggccgcaaagccagctgatctgacatggagccgcataccttggggattaagtaaatatgtactgtagaaaaccaaacctgcatgtaattccaggttgcttttgttttgttaaatactgccctgagatttacaattcctccggggtggctctgactgggactgaactttggagcctgaactatcagccaaagccgatccgattaactcttccctagccgggctggccggagcctgtggtggccaagctagcaggggtctggctgtccaggactccctcttctccttgggtggtttggacagccgcttgaccttgcatttggagggggagttgggaagcgtttttaacccttggacacaacgaataaggggaagtcagagttgttctcagcagtttcatttccttgaggcgatgccccataaaagggctcctgaagctctttgtgaaggggactgaaaagggcagatgagggtgtcctttgg

SEQ ID NO: 51663 - DNA, 1054 bp, Homo sapiens
cacgcgcgctccacacccggaccctctccaagttggaaaggacaaaaagaaggcaataaatgctaaaaagggagagaaggggagctggatcgagcggcaactcccagcctctgctggaacagagagggagggagggagccggagcgagcgagcgcgcgcgagggcgagcgctgcacgtaaagaaactgacacccggaccccccacttctcctgcacgttgctggcaatcagatcgcgtttaagcaatttcctgagcccaagaatagcaatgagtcgggagactttcgcgggctgaaattgggagctccaagcactttttccccccacttttttttttttttttttttctggagacggggtgggggtgggggcgctacaatttggaatcagcttttttttttttttttttttttttttaatcttgcactttgaaaccgcgggaccgaggcagggtgcgcgcgtgtggttggtgcctttttttttttttcttcccctccctaaactcctctgtcagtctgtaaacattacctgagaattccccagccgaaacggctgctggggcaagaaacttcttgttagaactttccacctccggcttccccctccacctcttttaccgtcccaaccttaggagacgctttttctcccccagaggagaatttatctttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagg

SEQ ID NO: 51664 - DNA, 1050 bp, Homo sapiens
aggctctagaacactgtcatgctgtttttacaatttcttgttacaatttttcaaaataaaaaataatggcgctgattccaaggagtccctttagtcttctgcaagcatgtcaattgtgggaactgagaatgtaggctgtgtggggccacaggacattctcgttcccattgttttagggtggtaagtgacaagaaatattttctcaaaaaggtggagcttagctttcaggatcctcagcaacgcttcccagtgttactgagatttagtgcagcaatggttgaaaatgaatgggccagtggttaccttgccctctcctcattgtttggaagacattctttatggtaccagcaagggcagaattacagatttgtgtccagaaagtgcagagtggaattggggtgaactaattacctttccacctctaccagagcaatgacattggcactaggagatgatgaagtgatgtgatttgccgtaagaatgatgtttttttctctagattcatcaggatgagcctccaggccccacctagactcctggagctggctgagcagagtctgctgagagaccgggccttggccatccccaccctggaggagctgcccagggagctctttcccccactgttcatggaggcctttaccaggagatgctgcgagaccctgacaactatggtgcaggcctggcccttcacctgccttcctctagggtccctgatgaagtcatgtaatctagagatctttcgagctgtgctggaggggcttgatgcactgcttgcccagaaggttcgccccaggtgaggtgacccagctaaccaggtggggagggctcaggcatccagggtagggttagctgggtcagaaggagtgggaggcccaagggtggcccagagacttctgatggggctggggaggaagctcagagaggccttggccattgtccagctcctctgggaaaggactgctcaccatgcagggtccactgaaggatcaggaacctgcctcctgccagtggcaattgaagacactagcagtggggaccaggcaggtt

SEQ ID NO: 51665 - DNA, 1027 bp, Homo sapiens
gacccagtcacccgagtgatggtgaaggactgagcctcgattgggtctgccctgaatgagcagagtctccattcccacaccccaggtgctgattatcctcagataagcagaacagccttgggttgtgaaaagtgtcatctctcaccttgaggtcttccccaccactctcctctaactccttcttgttctctcccaggtgtctccaggcccccttggagacagtcgtaatgaccgaatgcctgctgtcagagtcggacctgaagcatctctcttggtgcccgagcatccgtcagctaaaagagctagacctgaggggcatcacactgacccatttcagtcctgagcccctctcagttctgctggagcaagctgaggccaccctgcagaccctggacttagaggactgtgggatcgtggattcccaactcagcgccatcctgcctgccctgagccgctgctcccagctcagcaccttcagcttctgtgggaacctcatctccatggccgccctggagaacctgctgcgccacaccgtcgggctgagcaagctaagcctggagctgtatcctgcccctctggagagttatgatgcccagggtgctctctgctggggaagattttctcaacttggggctgagctgatgaagacactgagggacttaaggcagcccaagattattgtgttcagcactgtcccctgccctcgctgtggcatcagggcctcctatgacctggagcccagtcactgtctgttgaatgcctgctgtcagggtggatttatttaaagctttcttctggtcatttggcaactgaatcctaggccatgagtgtatgtcaaagggagcacagacccatcgtttcatatgcctgctcaatgtgaacgggaaaggaaaggggatgcaggaagggagggactgggggaaaagttgagttggagtcaataggagctttagagacctgtgtcccagagaatcagaaatgggaatctgaattgctagaatgagaatcaggtaggagagacacatga

SEQ ID NO: 51666 - DNA, 1054 bp, Homo sapiens
cggggagtaaggctctcacgtactcctgcctgctaaggtctcatcagcagcccttcttttatttatttatttatttgttttttttttgagacagagttgcgctcttgttgcccaggctggagtgcagtgaacctcccgggttcaagcaattctcctacctcagcctcccgagtagctgggattacaggcatgcaccaccacgcccggctaattttgtatttttagtagagatggggtttctccatgttgaggctggtctcaaactcctgacctcaggtgatccacccacctcggcctcccaaagtgctgggattacaggcatgagccactgcgcctggccagcagcccttcttttaatcatggaggcagcatctacagaagtatatgggaatgagaagaaggtctattctgaaaatgaagtggtttcctggctcatgcttttgccttttggaaactaatgatttatttgcaggatgttcctcttttccattttaagtttattcttgggacctggaaaaagaactgtggggattagcttctgtctagaacttgctatggtccaacaattttacttgcttagattttctttccttttttaagtcaatggttttttttaaatgaatctatttcaacaaatatttactgaacagcctctctggcatggagtttaagagcgtggcagtggagtcagactggctggtaccagatcccacctctgccacctgctaacttgtggccattggcacattaacttctctaatgctgacttatcctttcaatggggatagtattggtacctgccacataagagaaagtgatgatgatcgaatgagatcattcctgtggaggaattagtacactgcttagcacatgctaggcactcaatgatggaagagggggaggaggaagatggcacatgtcatgccccatgataggttctggggacacccacatcaatgagaaacagtccttgcccacaggggtccataaaacatccatcagatgtagcagtccttgttggaacagagagtggattgggccagggatggtggag

SEQ ID NO: 51667 - DNA, 1028 bp, Homo sapiens
ttatctttcatattttccatctgcttgtctctgttttgccttctggataatttcttcagatctatctcttagtttactcatctttctcttatttgatgcttaacaaatatattgagtttcaatgattatagttttcgattctaaaatttctatgtggtttctttccaatctgcctgatcaatttttatggtctcttggtctttgttcagtttttagttacatatttttttctgtaaacacttcatactttatattttgtatctgacagttccagcatcagaaatttatatgactctaaatctgtatttagttaattctgttgatctcactcagcgaagcttgtttcctggcaagtttggtaatgttttttattgtgaaatttttattgtgtgtgtgttttttttattggttgaacataatctgtagggatcctgggagcatttattggtgatgctttattccggagagaatttgtgtttgcttttctcaagagccagaggctgttaccacactggatacatttaagctcccttgaaagaatcagggcttaaggcaagagtctcagatttagcttccctatctcacagagagctcaaggcttagtgtgcggattccagggctggtactcacactgtctcctccggttacatttgctgactgttcccaatctactgtcaatttagtattctcctcccatctccccaccaaccttagagagcctttattttcatacaagcctagcagcgcataaaactatgtttattgtaattttcctgagacctagttatattacagaggaggagccttcagaggaactgatatgccgtacttctcgaagaggaattcagttcatttttaatctttgaatcatatcaaggagaaagtctgaatcatgtgttcttatgtgaattatgtgttgtgtcttaaacacctcttcaacacctgttaagggatactgcaccagcaacagtatccagctagaatttaatacaattgttttgtttgcattatctttatcctatggttac

SEQ ID NO: 51668 - DNA, 1950 bp, Homo sapiens
gccaactttttttgtttttaagccatcaaattcaatatttacaggaaaaaccccatgcttggttctaaaactactggccactcaagaaacagtttacttctcacttctgcccataacaagaaaaacatagacttgtgccttactcttaaaaaaataataataataaatataggttttttaaaatttatatataatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccggacggagaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagcgcgggggagctgagggtgtgtgcgtgtcaggcggctgagcgccggaggaggagaggcagcggcttagtcggtgccaggtcccaaagacgcagctgcgcgggtgtgccgggaggagccccggaatccacaggctgcgaggtgggcagcacagggggcctccctccgagtcggcagcaccagagagatcgggtggaaggttcacagtaggcagccccgcttgctggcagcagtggctggggtttccttcccatagagcggtgtgttggaggaatacgcacgcctcgggagaagctggcctcgtagaatcaggagggacgttcaggagggcttgggccaaggggagggttccccgccctgcggtggccctggtcccccttgggactacctagtctggcgccctgcctgttggacacactcagcaccccgtcactggactggaagaggcctcctttatcctctttagagaggatagtgtgtgtggaaaggatccaagtggaggcttccgaggagtgtgagtgcatgaggattgttacgcgttacgaacattgaggtttaagtgggtttgagccacgtgttcatcttgggcaacaacatcagtggctgaatgtctgttggtgactccttaggctttaaatattttgtatcccatgttggggtgggggcgtccacagcttccattaccctttgtcctctcctggagccttacctcttcccgctgggttgctgtgttggtggtctccattgacatctgtcaacattttgttttcttttcttgggtttttatttttatatttcctcaatagaacatatgttctgcaggacgcagctacatccagccatgattccccacggccaaaacaatgcctggcacatagtagttgctcactaaatgttggttgaaggaattgtaacctaactcgtgatctttggggctggaggttgctgagttatgctgtgaaaagtaaacattttccaaaaattgaggatcaaggtaggcctaggccctgaggaatacttcttggagagggagcggtttgcaggaggggtgcgcctaacctggcctcctacaatggtccacacagacaaaaatacccaatctcagggaaatgacagagt

SEQ ID NO: 51669 - DNA, 1042 bp, Homo sapiens
gcagaacatatgttctattgaggaaatataaaaataaaaacccaagaaaagaaaacaaaatgttgacagatgtcaatggagaccaccaacacagcaacccagcgggaagaggtaaggctccaggagaggacaaagggtaatggaagctgtggacgcccccaccccaacatgggatacaaaatatttaaagcctaaggagtcaccaacagacattcagccactgatgttgttgcccaagatgaacacgtggctcaaacccacttaaacctcaatgttcgtaacgcgtaacaatcctcatgcactcacactcctcggaagcctccacttggatcctttccacacacactatcctctctaaagaggataaaggaggcctcttccagtccagtgacggggtgctgagtgtgtccaacaggcagggcgccagactaggtagtcccaagggggaccagggccaccgcagggcggggaaccctccccttggcccaagccctcctgaacgtccctcctgattctacgaggccagcttctcccgaggcgtgcgtattcctccaacacaccgctctatgggaaggaaaccccagccactgctgccagcaagcggggctgcctactgtgaaccttccacccgatctctctggtgctgccgactcggagggaggccccctgtgctgcccacctcgcagcctgtggattccggggctcctcccggcacacccgcgcagctgcgtctttgggacctggcaccgactaagccgctgcctctcctcctccggcgctcagccgcctgacacgcacacaccctcagctcccccgcgctcccctggacaacctcgaataccaggcccgggcattccagcaagtctctgctcgctcgtccccatcagcgacggcaggaagccacttgcgctgggtcttacctccttctgccaggacccagagcgacgcgcttcccaaaacgaagagcagagctgacaccttccacatcgttcccgttgagttgttgctctcctgggggccgagcagcaagattctgagctgg

SEQ ID NO: 51670 - DNA, 1837 bp, Homo sapiens
ttatctcggaatataccagaactgggtttgaaaaatatgtctaacttcaaacctgaagatctttttactacactactctgccattaaaaaaaaaaaaaaaaaaaagaggctgggcatggtggctcacgcctgtgaggggccgaggcgggcggatcatgaagtcaggagttcgagaccagcctggccaatatggtgaaaccccgtctctactaaaaatacaaaaattagttgggcatggtggtgcgcgcctgtagtcctagttacttggaggctgaggcggaagaatcgcttgaactcgtgaggcggcagttgcagtgaaccaagatcacaccacagcactccagcctggcaacagagcgagactccgtctcaaaaatatatataaaaacaaagtaaagaggttgaacttgaaattaaaggttaacctcactttaagcctcttaaacgtagaaacaaaattttctaaagatacgagaattcctttacattaaatgctccccataatgttcttttaagaatgaaattgtcataatacattaaaataggatttattaattcattctgcaaatagttattaagcatttcctgagttcttggtgtgttactagatgcagaatttgaactgtatgcacttttgagagaggcacacctcacatgctaaagtgtgccctgcagtcctcaccagcaaagcaatgaacatgcactttcaaattccatcggcttatctgaatatttgtcatatttctggctttggaaaggaggcaggccaggttataacttgtggaaatacgacgggggaggaggaggaggagggagagagaactcaactactcaggattaccctggtgaaatttatttgacgaatctgaatcagatgctgtagggcttttccaggaagccttgccactcttggtgccccaaaacttctcagggaagtacccagtgtgcacgttttattgaagagaatcaactgatggagggtgctggacacttccaagtggacagttactgtgatgagtcttaggattctcatttgctgggcaagagatacagctccgtgattaggcattttatctggggctgtgagctagagccccggtagggaataactggaattctgccaattccatccaaggcaggaaaacaaggtgactgtttccttcccacatgtctaaccccagcccctgtccaccggcctgttggcagccagtcagatgatggcaagctcccctgagtgtcagccgaaagaggtaggagggctcaccctcctttttgtctggctgagtgtctttgccttgagaattgctcagagatggatttgtcctttgaagtgaatcaagctaagtccagggggaagtacgcaggtatggccaactcgttcatgtagttttttgaggagctgaaagctgacattgtgaggcaatgctaaatttcatgaacccgcccccccaaacacacatacacacacacacacacccctggagaaagatgtgatgggctcttgacccccatccagagaggccaggccacaaagtgccgtaggcaatagagggagaccaaccctgagccactggggtaacaatcaccattgttaatgtttgcagcatgtacaaatgccagatacacagagtgtaaatgggaagcaggaaaggggcatgctagaatatttttaacatattattgatgagaacagggcacttcccacaattcatcagggtgtctccatccgggagaacagaacacaactcatttaaaaagctgtgatacagcgaatattgtcctgccccaaagagaagggaatcagtttgcctagaagaggagaagaatgagaatttgt

SEQ ID NO: 51671 - DNA, 1054 bp, Homo sapiens
agtaggaaaggtgtcatatgtggtgactggggatattctgatctcaatcaaggtggttctgtgatgaatcagatgtctttgttttgtcacagtctggaaatttattccacccgacagctccaccctttgcttttgttgtaaatacaaaaaatagcatcttgtggggtatctcacccctgagaagggcatgccttggacagcaaatatgcatacaaagcgttggaaaacagtttcctgttctaaataaactatttggttttctggcctcttgtgagcttggctaatgggaaacagtttgttctgagccaaatctccccataagattaaatgtgaatctgtaaagctacaggatctagattctgaatggctggtgttaatagcgctaacaatataataacagctagcgtttactgagtgcttagcgtgtgtgaacccctttctaagccctgtttctttcagtcctcacaacagactactcggctggagcttcttgtattttatagaggaattaagagactcagtgaggttcagtagcccacacacagacacggagcttgtaaatggcagcagtgagactgaacccaggctgctcaaccctagagcccacacccctaaccacttagctacacaatcagctatgcttggaatagcttgaatccgtgccactgaggacacccagaaaagcgagaggttgattccttcaagtacttcttaccttacggcagcaaaccacttgtattgattgattgattgattgatcgattgagatggagtcttgctctgtcgcccaggctggagtgcagtggtgcgatcccagctcaccgcaacctccgacccccaggttccaaccattctcctgcctcagcctccctagtagctgggattacaggcatgtgccaccacgcctggctaatttttctacgtttggtagagatggggtttcaccatgttggccaggctgttcttgaactcctgacctcaagtgatccacccgcctcagccctcccaagtgctggaattacaggcgtaagccaccgctccctgccaccatttg

SEQ ID NO: 51672 - DNA, 1098 bp, Homo sapiens
attacaggcgtgagccaccgcgcctggccaaaaagatgattctttcttcgctgaagaatcttggcacctctgtcaaaaatcaattacccataaatgtataggtttaattctggattaaattgatctatatgtctatcctcctaccagtagcaccgtcttgattactgcagctttgtagtaagttttgaaatggaagtatgagtctactttgtttttaccaagattgctttggtgattctcctgtctgtattttaattatttgtgtacataacttgtctcttagagaagagagcacttaaaagagcacgaggtaggtacatagtaaacatttggcaggaagaagagggaggaaacacgatagacacataggaatgacagaaagcagataataaaagcataaaaatcaggtaggagggatgagagattaggaaccaacttggtaaggaaaaggtatttatacgcccggctttagatatgatgagtttgaggtaaatagtaagacacccaatttgatgatctgatgagtacctgggaagacagtcatctaaaagagtgccagagctaagcactggagatgaagtttgctgcttgaatttcccctacattagaacaaagggagaaaaatggcaagggaagaacagaagagatcctcttagccaaaaacaactattttctaaaaatctaccaaagcacacttcgaggtccgaaaccaggcttgagattgaggccaagggacgctagtggaaacggccacattctgcacattcctgcaggcctcatcctcctgggctcacagctgggctgtctgagctgcgtggggtggacggtgaggtcagatgcaaaggggcttcttttctccctcttgcaaaatcagggcatgctcagctgacagccatgagtgaatcagctcagatttccattcagtttccgagcagacggcaagtgcttcccaaacacaccccattgagaagctctgctccaggacagcacttctaaagcaggtttttgtcatttggtactaagtggccctccctagaaggggaatgttcgtgacaccagccctagctgagttccagaaaagtttattacagagctgtg

SEQ ID NO: 51673 - DNA, 1023 bp, Homo sapiens
tgcttgatgagtgtgttgattcactcccatgaactctgaaaactgtgaatgtcattcatccattcattcaggcagcagagactgtgctagtggctgggccataaacttacagcagaatggggccttaccctcaaggaacttgtagatgctggtggggaggaggtagtaaatgccaaaatgttatcaaattctatactagtttagaggagattactttctcctggcaacttggaagagcgctgaagggaaggggattttacctgggcaatgaaggagaggtggggtttggaagggcactgattgagctaaaaggtgaacctgcaggtgcccttggcagcccctcctcaataatctacagaagccaccatctagggcagctcagtctactccagacctttctttagaagtagagaggaatataacagggagctggtcaagagtattcagtgcctgtgaagacacagtggttgggagcatgggtttgagagtctgaatagatggcaatgtctaatccatgcactggcacttgctcatttcatgggcagttgacttaacctcttagcctcaccattgtcagctaaaaaatgaggatgatactagtttgcaagacttctgtaaagaacaagagagctgctgggtacggtggcttacgcctctaatcccagcactttgggaggccgaggtgggcggatcaccaggtcaggagatcgagaccaccctggctaacacggtgaaatcccgtctctactaaaaatacaaaaaaaaaaaaaaattagccgggtgtggtggcgggcacctgtagtcccagctactcgggaggctgaggcgggagaatggcgtgaacctgggaggcagagcttgcagtgagctgagattgcgccactgcactccagcctgggcgacagagcgagactccttctcaaaaaaaaaaaaaagaaagaaagaaaaaaaaaacgagagcatgcacctgacgccacagtttgcacattctcccataaatccagcaaatagcacttgttatta

SEQ ID NO: 51674 - DNA, 1051 bp, Homo sapiens
agtaagttttttaataaggactacttgtctggcaaagggatatttcccattgagctcaataaatacacagtaagcgtttgcctacaccacaagtcatacatttttgtaggagccaatcaccaaccctcacctctacccctactccagcaaaaggccacatggagaggcaaaccatttgcatgcatggaaatattcggttattgctaactggtaaacccctcgctgtacacccccagattaaaaaaatgtgtaggtagctcatccaaagccatctctactggattaggactctagaataaaagagcaggctcatagaacaagtgaactaacttcagaggcttcctctaggcatcaaagaagctataatcaaatatttattagctgtgcctctggctgggctgtctaagcagtggggagaataaggtatcttaaggcaaggaatggattgctgatataagtgctgtctaagcagtggggagaataaggtatcttaaggcaaggaatggattgctaatgtaagtgctgcctagagacaaacaaacatctgctctttcattacacaaagaaatttccaagcacctccctccccctcgctcctgggatgtgtatgcttgtttattttgcaactgtatttagtcatggaatttccagaaccactggagtttagggaagaagcccatggccagtgagtcacatttttaatgcacaaagagggttgtttggtgatttttggagatgataattgagcatggtcatgactagtttgggtcactgcaacagaagttgaagaagaggatactgctgttatctgctctatctctcattgtagaattcagcctggtagtccactccaattccctgctccagcagaaacctttttttttctttgagacggagtcctgctctgtcaccaggttggagtgcagtggtgtgatcttggctcactgcaacccccacctcccatgttcaagcgattctcctgcctcagcctcccaagtagctgggactacaggcatgcaaccccatgcccagctaatttttgtatttttag

SEQ ID NO: 51675 - DNA, 1115 bp, Homo sapiens
actgcgactttaaggaaaatgacatgcagcaggtcctcacataatgttggttctttctaagtcattttgcttcaagtcacagtttccaagaacctatcaacaacattaagtgaggacttattcttctttgttgagccacgtaactattccttggtatggtggctcatgctgattttatagatagatatatttttatataaagtaaattaatatacatcatagccttgcatgtgatcacatgcctacggaaaaaattcctctcttcccaggacactgaccagagttgtcaagccagacttatagcggtcttcgctggttcctggagtcaccacatcatcttcggcacctggcatggcaacgccgccttccaaacctgtagtctcagtgtcatcttctggctggcctgtgctggctgaagaagaaagattgagtcagagcttaaggtggaaattgcataagcagacccaacttgtcggctacattcggattattttcttttccatttcttttggaaatttttgttttatttttggtcctttttgtggcttactgtggtgccagaaaccaaaccattctccttgcagcacttctgacacatcaacaccctggttatctccgttgcaaagcaaaggaaaatgaaaacattaaaaggtagagcagccagcccctccctggggccccatcgaggtggcctggacaggggacgtacatctttccttttcaataaggaaccagattcttcctggtgtcatttcatatgatgaattaatatattcatctggacctaaaaactctaaattagagtcaacaggaaagatttctaaacacacccctttgcagacccgatgcaaaagcggggtctccatctttttatttttttatttttttctctaccttttcaaattaatttttcttaagagacaggctctccctctgttgctgaggctagagtacagaggcacaatcatagctcactataacctcaaactcctgggctcaagcgatcctcccgtctcagtctccaaagtagcggggactacaagtgctcaccaccacacccaacttccatctttttaaaagcaaactctctctccatttaattttaagactgctgt

SEQ ID NO: 51676 - DNA, 1191 bp, Homo sapiens
agtttgaggttatagtgagctatgattgtgcctctgtactctagcctcagcaacagagggagagcctgtctcttaagaaaaattaatttgaaaaggtagagaaaaaaataaaaaaataaaaagatggagaccccgcttttgcatcgggtctgcaaaggggtgtgtttagaaatctttcctgttgactctaatttagagtttttaggtccagatgaatatattaattcatcatatgaaatgacaccaggaagaatctggttccttattgaaaaggaaagatgtacgtcccctgtccaggccacctcgatggggccccagggaggggctggctgctctaccttttaatgttttcattttcctttgctttgcaacggagataaccagggtgttgatgtgtcagaagtgctgcaaggagaatggtttggtttctggcaccacagtaagccacaaaaaggaccaaaaataaaacaaaaatttccaaaagaaatggaaaagaaaataatccgaatgtagccgacaagttgggtctgcttatgcaatttccaccttaagctctgactcaatctttcttcttcagccagcacaggccagccagaagatgacactgagactacaggtttggaaggcggcgttgccatgccaggtgccgaagatgatgtggtgactccaggaaccagcgaagaccgctataagtctggcttgacaactctggtcagtgtcctgggaagagaggaattttttccgtaggcatgtgatcacatgcaaggctatgatgtatattaatttactttatataaaaatatatctatctataaaatcagcatgagccaccataccaaggaatagttacgtggctcaacaaagaagaataagtcctcacttaatgttgttgataggttcttggaaactgtgacttgaagcaaaatgacttagaaagaaccaacattatgtgaggacctgctgcatgtcattttccttaaagtcgcagtttccaagaatctatcaacaacgttaagtgaggagttactgtctttcccaatttcgtccacttagctggtgtgctgatcacaggtggttggagagtagaagccagagcttctcaaattggtaaaaggagccaggattttacatttccaatctgttacagcccaactttcaatacaatgaaagttttcttgggtgttgtggcaa

SEQ ID NO: 51677 - DNA, 1958 bp, Homo sapiens
aggactcgttatataaagaggtcaagaagaaaagacatttttatttttaaataggttattgcataaaattattcaaaagaaactcacaatgacaaatactcaccttgtaactattagactgggtttgactgcagatagagaccctaaaataacagtggcacaaacacaaagggtatatttgctcatgaaacttagctgggcctattgttgccttgtaaaaatttggattttgctaccaaagaagtagcaggaaatagatattgagactaaccacaatcttggtcacatcttcccaaactaaagtattaatctcaaagtgagtaatacctcttcacagtctgtcccttctctgtgatcttgacattggactaagaatccacagctctggattcttctgctaccttaacctctgatactccttgatcatttatttaagatctttgtggctcagtttcctttactctgctttctaaactataaaattaatacgtagaaaagtgctatgaacccattggtgtgaataagggttcataaattagataataatagttacaaagacagtgccacatcggggcttgtttaaaaatccctggatccaatttatttaagaagccatcctcttggtttatgttttgctgctttccacttgggtaaattcatcttttgccagttgttaaattatagttattaaaccctaataattctacattattatatctttctattcacagagaaagtggatggagacacacagacaacagttgagaaaggtaggctagattttggcatcaaaatactcttactggggttttttaaaaatttctttgaagctaattgttgagacgaattgcgttcttttctggattgcagtcaatgagagcagaatagaaaacattccgagaacagatttcaagctttttttttttttttttttttaaagagagaaaagggaatttcttgtatttgaaactaagcaaacctcagatgagtctattcccttaatgtcagatatggggaatggtgtcatatcacagttcatcattactaaggatgaaaataggggccaacttaatagtcatacgtaaacactacccaaaaattaacacttaagccaatgtgaatgttacgttgatagatcctcagacccagaaatcttcccatttgtaaaataggattagactagcccaaattttctccttttggaagaaatgctccatgctcaaacaacatagagcaatatttgctatgtgcagtagggcagtggctttgtttatatgttacatattttatcaccgatgtattttttcctctggggctcatgctttttttctctctcttgttcagatggtttgtcaacagtgaccctggttggaatcatagttggggtcttactagccatcggcttcattggtgcaatcatcgttgtggttatgcgaaaaatgtcgggaaggtactcgtaagtaaatagcttacacccatgtgataggcaaatgaaagccatcgtgtctagaactcaaatctttgaactaatagaaatctctgatataagctgggtgtggtggctcgtgcctgtagtctcagctgctgggcacctgcagaccagcctgggcaacatagtaagaccctgtctcaaaaaaataatctctggtacaatggtcatgttccaaagttccttacttgggcctcttgagtgcagtggctcacacctggaatcccagtgctttgagaggctgaggcaggaggttcacttgtgcccaggaatttgaggctgcagtgagctatgattgtgccactgcactccagcctgggtgacagagcaagactgtgtctcttaaaaataagaaagagcctcttcatcttcaaaaggactacatctgaagtttccccagaaggacaaatgtctacttagaccttataaatttccaaaataagagagtcagagccagaggtggcttgta

SEQ ID NO: 51678 - DNA, 2788 bp, Homo sapiens
agaggacaagtgataaacacctggagggttgagggatacaggggacaacacagctgtggacttagcgtgtttggaaaagccaggcagtttgaccctgctgtgtgaggacgaaggcatggaggaggaatgtcaggaacaagagatgatcaccaggtgtcagaacttggaagatttagagcaaaggacaataggaaaaaggactcacggagttactattcacaatgccagtaagagacacgaccgtcacccttctctattttcacaggccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaacaatgagtcagacttttgttggaaaacacaagtctgggccacacttgggaacatctccagataagattacaacttaggtaaatgcctgcctgttgccttgcttgagagtggattatagatggccaggggaatgaattccacaggaggaaaacacacctacacctttcagctaggtctgccaaagtagagaggtcaagtagaagcatgggcatgggagacacgtggcacctgggggctctctccctctctggtcccaaagggttaatgaggttttccctgattttttctgttttgttttgagatggagtctcgctctgtcgcccaggctggagtgcagtggcgcgatctcggctcactgcagcctccacttcctgggcccaagcaattctgtctcagcctcccaagtagctgggactataggcgtgcaccaccacacccacctaatttttgtatttttagtagagacgggg

SEQ ID NO: 51679 - DNA, 1089 bp, Homo sapiens
ctctgtctggagattgccctggccagctcctgggtgggtgctgcagatctcctcctcccgaccccaccgcaccactccatgtggatttatcctcctgatgcgggtcccttccctgccagcgtaaggatcaggtgctaggagcgggagagcagttagccccatgacttcctcgaaataaatattcaatattgttaaattaggactgttgaatttgtccgttgtcagtaatcctgggtgcccatttgagttccaaacaaggaaccatattgtatgcctgtagttccagctgtttgggaggctgaggtgggaggatcgtttaagccaggagttcaaggccagcctgggcaacaaagtgagagccccatctcttaaaaaatggaccagggttctagtcctgttctgctcctccacacctgtaacccttcagggaagtcatttaacttctttgggctgcagtttcttctaagaactttcatgagatgtcagaaagcatcccttttctagcaggaaactaaccacgtctacctagtccaacagattgaaagagaacggaccctcaactatgttacatgtaaatttacattccattacatgccacccccaggagatgactggaaactgggggagctgccagggttctgaaagtttagggaaacagctctatcagagacatctgggagcagggggtgctgaggttagctctttgcatgatataaaggccttgtttttaacccctactttttcccctcaacctgggaaaaccagttgaaaaaccagggcttagttctgcttcatgggccaccttcaaggcttggctttcatgaataggaaagagcaaggaactgttaatccctttgctgtctctatttttattttaattcagatttatttagtattcagggcatggggcagtttgtgacatgcttcgattggggaatggtgcacgttttgatattaaaacttttgccaattaaaagtccattggaagtggaaaaagaatcctccccaaaatatagctgcatgttaacacatgcactaaaaatagagtcatccccttgtgtgcgctggaggacttgttccctgaaacat

SEQ ID NO: 51680 - DNA, 2912 bp, Homo sapiens
tttgatcagttgtgtccaagtattagaaaaatgtaggccttttaaaaaaaaacatgataggaaatttacatatattaaggaggaggaactgagacacactgtcatacgttcttttttagtagggttctgtgtttttgagatggtccaaactgccccatcactcttgaggcttccggactaacacttattggccaaatttttacatgtagaatcttagtttagccttgagatgacctttaaagatcatttttattaaaccccctcatttcgagctatggaaacaaatcaaaattcacagtggaactaaaactcatttacattttctgtgattccagggctctttttactcaacacatctgttttggtttgattgaaataagttaatacattttaagtgcttagaaaagtgccagaacatgataatactgctcagtaaatgtttgcttttgttgattctgaaggtggtttctttaattgaaaggttggtatgttcaggtttgttttttccttattttgtggacagggcctgaaacagtacagtttaaatctgtaagaatgtattaattttgtaagtacaaaacataacaaaagattctcactgtagaaaattggaaagtagagaaaagcacaaagaagaaacagaaattgggcataaccttcccctcttcagataaccattgttaacgtttggcagatcttcctgtctctcttggtgtggatatgcgtatttctttccttattttacagttcattcacatatatatatatttatttacattttatacaggattgataatatagtgtgtatattgtttgcaacctgtcttgccttatgatacggtgagcatgtatccatgccactaactagtcaatattatgtttaatggctatttaatatgtggatgggccgtaagttatcaatcaagtccatattgatctgtaaggtttctcaagcctgagttttcttttcattaagatttgtttgaaagtttttttaaaatcgtgggttttaaagttctgtaatcttttgagattacagtgaaaaatataaattctgctttttagcatctaaataagcatttttcttgcgggtgcagtcataagaagtaacactcaatttcagcttcctttcttccgttcttggctgtggctgtgcagttatgtacatatatctgcgcctattcttttgatgattattttacgttagatgtttatttattcatgagactgtttctttaagcagcctgtttcttttcaagttccaaacctgatttacaaaccctttttaagtcctgttaaatcatagactttccaggatggaaagcaccttaggttatttactattttcatgtcttctgagtagcttttcatgttatttttaatactcatgcagaaaaaaaaccaaaacagcggacttctactagaaaactccataatggggagtggaagaggaggaggttgatggttgggggaaaatcgtcaaacttgcatgacgatgggtagctaagggagtttccagatgatgagggacatcacctgactgtccttaccacagataactgccgccctgtgtctagggcttcacgctttgtgcgctgagcaccagctatgctgtcacctatggttacaacatttggttagaggcctggggtggtggtccatctctctctttttgaagctacaagtttctagttagagctataaaaaccacctttatggagtgtctgaaagctgtggactccattactgaaaacaatacttagcttccattaaagcagagtttctcaacctctgcacttactgacatttgggtgagagaattctctgttgtggaggacgatcctgtacactgtaggatgttcagcagcatccctgtcctctatcagggagatgccagtagcacctccttccagtgtgacagccagtaaaatctccagacatttccaaatagcacttgaaccgctgcagtgaaggaaggctcatctaactgtatggttgaattattgaaacagattattgaatctctttaagaactgtaaggatagactagatggtttacaccttgaagccaagaagtggacttcaggtctgtccacgttcctttccacctttggttttgtgactttattgaatggtcagtttcagcacttttgcttcggcatcagttttgtggcatgaggtaaaacaatgtgaggtatcctggagatcataaaggagttttcatgacgtggaatcagcattcttagtatgcagattaaattatgaaatttgaataaatttgcatagagttgatgcgtggtaaataatttaagcatatagaccattatgctgaacagcgcagaaacaactgtcttctagaaaagcaacttggtccagcaaccccttgaagattgatggtagaggctatgctgtagtttttccgaaacctgtttttttgaaaacaaccaatttgaggttatgcacagaaatggtgagtttgccctgaggcaataaggcttacttttgaagtgcttacctaactttaacttaatacattataatttaaagatagttcattgatctttgtggaaaacatgcagcattaatgcagctttcctctagggggaaaagtataagttgccaaatccttatttgtaatctttctaagtgtagatagtattgattgaatttttattgtggcatacgtaatctttagtcggaatgtattgataaataaaacgtgaaaagagatgtgcttttggagctacatttggtaggggtggttttctgaattacagaacatctgtataatttcactggaatgaatgcatgtgtcgtttaaatattctttcttaaagagaatgcctttcattccccacccccaccttcctgaggcatgaattagagttattgtatgtagtaaatctggctca

SEQ ID NO: 51681 - DNA, 1223 bp, Homo sapiens
ggagattttactgaatacttattattttccagccattttggtgaaaagaatattttgtagctcttgcaataaatcatactctgggttttgctttgaaagagctgaattacttcttggcacagcttgtctgaaatatgtaaagctaagtgcaagtgttagtttgattatagggggcagtctgtctggaaattggtaaaacccacacattttatatgtgcttatatgtagttctattaagacctatgttaaactctggtgggataattccgtggcactttcacataatttaaattatgccatgtaagagtcactaaacccttatatacttcagtatgaatcctgtacattgcccaagaccttgttaagagaatgtaaattaaatataaattggagtatcagtgtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgaggtacttttcccgggaaggtcgggcatctcctt

SEQ ID NO: 51682 - DNA, 1096 bp, Homo sapiens
ttgcaaacagtaggcattgccattatttttaaatgtttgtgagaagtagtaacatatttagagaataaatcccaaatctcaaattatttaaaatagaagagtcactttctaccaaaactaaaaaaaaaaaaacttaataaaatcttcggagaagacctatagaatcttgtagtaatataagtgtgcctgacaccgtagcaaaagagtttaagttgtcattttatctattatgacttccagttttgctttaggttgttcacctgtgaattcaggaagcctccccaccatttatgtgcaggttgtatggaaaatgaaaagagcttcgagcagctccttgtaagatgcctctgttgctcagagagtcttcatgtgagacatgaagactttggtgccaggaccactaccctgcccgtgctgctgtagtgttcttccgcttttcaggaaattcacaaatcttttgcaggattcctagacatctcttaattttaaaagtaacatctgcattggcaactccagtggaaaaatagtacacaggggtcaactgaggattcattttgttttgggaattgtgaaatgagctatcatatggcatcttgctttagaaattttgtctgagttagaagcttggcatttgagccttagtcaagaattgatttaattttccttttataagttaaagtttttatacatctaatgtagggaaaatgtcagaaaagaatctttcatggaaacttctgttactttaatactgttttgcaggaggtaataatggccttgaatctgaagcatagttctcatcagagagcaagcactgattggaaaactcttgtattctgacctgcccccagatttttacatttgtatttcttggcaattagtcttaaaaataaggaaaggaaattaacattttaattcaagagtcctttgattggatggagttacttcatgcaggaaaattgacaataattctttttttttttttttgtactgttggaggggaggaatatcctatagtgagagctaagataatatgttttaatttctttagagaaactgggtagttttaataagggggttgcagggaattattgtagga

SEQ ID NO: 51683 - DNA, 1101 bp, Homo sapiens
tcctcctaatgagtccgctttcagttgtagagtacagtgaagccctagcaaagagtagtaagaaatctattttactggagataataaatctgacaaggaagctctcagcatagattgaagttgatttggcatagagttgctttataaatagccctttcagcaaactctacagttctgtatgtggttttaaatccctgtaaatttgtaggcaggtacatattacaattgtctgtttttctttttagggttcatgtaatcaaagaagtttctttgttgtgtgtatctttacagaacacaacaggaattgaaaatgaatcaggtgagtttaaaaatcagaatttatacaaatacatgacctagatgttagaccagctcttgatttttacaagatagtagcacacacattcatttctcctggattctcatttttgtttcttaataccattaattagttcattgtgttcataccgtgcatttgttcgtgcagtggaatgtgcattgtttgggcgtgggttggcgtttctgtggttccctgaggagaggactcattcttagggattttcattaagactttctttttgacctctcccttgccacactctagtgtgagttttttgtgtgtgtttgttttgaagcttattaagctttcatttttagcgttttttattttgtgattatttgttggttaaaagacacatgcacacgtatgtttattgcggcattattcacaatagcaaagacttggaaccaacccaaatgtccaacaatgatagaactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattcttattcataggtgggaattgaacaatgagatcacatggacacaggaaggggaacatcacactctggggactgttgtggggtggagggaggggggagggatagcattgggagatatacctaatgctagatgacgagttagtgggtgcagcacaccagcatggcacatgtatac

SEQ ID NO: 51684 - DNA, 1062 bp, Homo sapiens
tttattttcctattttaagattgattcttattacgaacctggtcacccaaaggagctcggttctctgcagtctaggaactgttttgttggaggagtcttgatcctgcgttagaatggttgtgagttcttccaaagtggaatctaaatgttaatattgttcttgttgcatcgctgttcagaaatcatttatttgatatgtctacatctttaaccttaggattaattatgccttaattcttgtacagtattagacttgtaatatttctagtgaattagacttgacacttcaaacttttgctttatatttccattatatcaaacttgtgtttaaaaaagtctgcttgccagtcaaaaagtggtagcaataactactactttttttttttttggctcttttataatttcgttttgcttttgacaagttttaatatcagatctgcagaagaccgcctttgatcccaaatgccaagtatcagtggaaaagtgtcctcttatgtttctaatggttaacacatttctgatttgggtgtaatttaaatggtctggtagtaatgaagcttttatttggattataaaaattgcccactttttatgagtaaaatttttagcatcttttgttatattttcattactagaagaatattagttatatgctgtttagacccaattgttatggcataaaatctatcagtgtttttcaacaatcaccccagtcattcttcagggttaagacttatttcaggataatttacagttttcccttctcgtatttattgctgtcattttcagacagtgaaaatgagcagtaaatgcttgaaaaactgaaaaataaccacacaacaaaattcagatataaaaaagtttgaacttgaagaagattgacttataaataaaatcccgatggttattttagggttaggttattctccccaggaatggatcagcattgctttgatgggttttaattgtcagttctgtttcttatgatgggtatggtctcaaagacaatagcatagaataatttgttgatatatgcctgacagttgagtttcagggactgca

SEQ ID NO: 51685 - DNA, 1126 bp, Homo sapiens
atacaaagatgggttcgtagaattttagcgattttaatatggtatgattctaagctgttttttgcttgtaacagttactttggtgattattattagtctattgtagcaataatatatattttagtatgaatatactatgaattgttcttaatattaaggaaaattggtctaatctattccgtcatgtattgctgccactttccagttagttttgatcaagtcaatatttgaaactaggtgctttaattaaatagattaaactgatataatacttgctgataattctctgggcaaagcatgtaaaaggagttacttatataaatttaaatgagacgctaataaaatttgcttattcttatatacttttaaaaataaaaacattagtatgtgttgaccatgtaagatggtacatgcagctttatgtaacagcagccaatgccaatgttatgctgtagagcagagttaccttgctgattacagtcaatgtttgtctaaagagtatggagagaagggctgggtagggagagtggaggaggttggttctgtggttcatgtacctggagcagacctgaggagggtggagtaaatggtcaaagaagtgtgggctcagctctggggtcgccagaaggacagagtagactttgccagtgaggtggggaacctttggagggttttgaggagagggctgttagagttgagttaaaaaattcttaataaatacaaataatgaaactattctacagggcagaatcaggacttggttactggttgaaaataataataataaaaaatagtaacttaccgtgtttcatatatgtcaggcactagcctaagtgctttccgttcagtaagtcatttactattgattgcaaccacatggggtgggcaccattactatccctatttaacagataagaaagtgaatacaatcggaaatattttcttggtgcattaaagtttcattttaacatgatttaaagatgagaatttaggatttattgacctgtttagttatttgactttaaaaatcaactttgaggtataagctgcatacagtaaaaggtaactgttttaactgtatagtacaagtttcacacccgtgtaactatcactgctgtcgagtcat

SEQ ID NO: 51686 - DNA, 1057 bp, Homo sapiens
ttgctatctgttttgacttaaacctcaactaataaatgtgtagtttaggaaattagcatgttgaatgaatagtggtagcccttgaaatctcattttgaatcatgtattctactagataaattagcaaattttagaaaatctgggaccttgtctttctgaatgaaaatattatttgtgaaattcaaaaaaaaattaacaacctgaatagcatttccttaagtcagtggaatgagcttgtggcaagaagcctttcctcttatgttaggatagtaacacttcggcagagaaaaaagctgtgggactgtttttctctgcctctcctttgatgccctctaactcactctccttggtcagttctggcaatgtcattccagctgtgtgaccttgggcaagtcctcggcttatttgtgttcactttcttatctgttaaatggggacagtaatggtgcctaccccgtgtggttgcagtcaatagtaaatgagtttatagatgtaaagcccttaggctagtgcctgacataggaaacaccgtaaattattatttattactgttatttttcagccggtaaccatgtcctgattctgtcctgtaaaatagtttaattactattactgcttgaattcagacccaaacatcccttctctgggctattacagaaagctcctgattgatttcctcgccaacgttttcctccctatgggaccattctccataggccttacagaacatgcagctcaccatctgggaaatcagaaaagccagcggtcgttgcgagttgttgggaatgttttcgtggaggagctgggatttgaacttgacctggaaggatgtggaggatattgatcgtcagaagaattgagggccaggtgaaagtctaaattgagaaaggcccagagtagcaaggggacctaatgtggtgagggtaggaggggccagagggtgtgccaggaacccagatgcctgtaggggccagggatgacctgtaagagtaaaatggggatttttctgtgatttcttccaatagaatttttttttttaaatccatgggtagaccga

SEQ ID NO: 51687 - DNA, 1702 bp, Homo sapiens
ggctctgttattgcttgtgagtgcctttatttcttatgtatctttgtgcctccagtaccagatactttgtggaccctcagtagatacttgaatgaatgacatgctgtgagtgtatctaaattcttctggctgggatttctccttgaacacaaaccaggcgcgtgtgtgtttggtttttatgtggcctaatctttagacagaagctaaggaagtaaattgtaaaactttagtcaaaatacagtcttggaatatatcatatttatatccctgtttcttttttttagatgtacttccgatatcccaatttatatgtacatatgtatgaaaaaattttaatacatgcttttaaaaattctcattggaaacttattcattgagcagtttgaacatattgttcaaatgaaagtggttgattttatagctcaactgattgttgacttacatagcggacttacagagaagtggaatttgtacatcctagcaggataggactggcccagcctttaccccccattctgtatatgaggaaactgaagccaaaaggtgagggaaccgatctaaagtgatgctgttgactgctgggccagactcctgccattttactgtctgcttgctcattatatcgctttccgttatggtcagtgcatagtaaatagaaacaaccctaagaatactgtggatgaacagctattttggctgttagaaactctgaaaagtgagccgttccagtagctaagttttcaggaagcttagttaggcaggaaagggttttctactttaaagcaaatgaacttcaaaactatttattcataaaactatatttctaaccctttataagaacaagtcatgttcattagagacaatttgaactttataaacaagcagacagaggagttcaaaaatcagttgtagtttcactccattccaatattttttctcttcagttgttgtgactgtgttattcaagtatttgtgatcctactgtacgggtagtgttacatgtaaaacattttaaaagtatataaaacatttttttctaatcgtaaaacaatataggttctttatagaacagaagagtataaagaagaaaaataaaaatccccattgaggacttgacttaatttaacttgatctcaggctattttaacattagcttgatttaggcagtctagccttttaactgttttgtgaaacttaagcgattttaatggtttcaatctttaaaataaccatgatacattataaaaatactgattttattttctaggtgtctgggccactaaaccaattttaaaaggcaaaaaatttgggccatttgttggtgataagaaaaaaagatctcaggttaagaataatgtatacatgtgggaggtaagaagtaattctgattctttgtttttcagagttttatgaaataattattctgttctctcagaatttgacattttgaatttaaaacaatcattttaatgtgttctttaaagtcaagaatatttttattaaagagaaaatgtgtttccctggatacagactgctatttatatatgcttttgtattttgaaactgcttggctgtcctcaacaataaatgtcaaatccatgttttacattgccgtgtccagggtgttttgctttgcaactaagaccgtgacttcctgtttgatggtttgtcacttcacaggccgccacataaaccccataaa

SEQ ID NO: 51688 - DNA, 1017 bp, Homo sapiens
atgtctactacttatttacgttattgtttgtttcttttctttttttttttttttttgagacaaggtcttgctctgtcacccaggctgaaatgcagtggcatgttcacagctcatcctctgcctcctgggcccaagtgatcttcctgcctcagcctcccgagtagctgggacaggcctgtgccactatgccactatgtccagctaatttttgtatttttggtagagatggggtttcaccatgttgcccaggctggtcttgaactcaggggctcatgggctcaagcgatctgcccgtctcagccttccaaagtgctggggttacaggtgcgagccactgcacctggcttatttacatcattattcctatgcctacccacaatttcattgtataccattcatgatttatttaactaagccttatgttggacatttaaattgttttaatgtttttatgattataaataatttttcaaagtataaaactcattgtatataaatatgtgttgacttgtctgattatttccttaagatgaatttctagaagtataaatgttgtcaaaaagttatatacattttaactttttataaattttgccaaacattttctctccagaaggactgtactattaattatttatacaaccaccaagagtatatgtttcttgccagccttttaaaatccagtattgttaatctttttaatattaaattgttaaaaatatctatttttgtagaggaaaaccagtggtcactgcttctattaatatttacattttattcattcaggcaacaaattttgaggtcaggagaatagagggaagaagtagaattgcatgtcagttaaaattgatagagaaattgtctctgtataatgagaagactttaatgtaatttttaaaagatatataaacttttttatcagtcagcgctgctatgattaaatattaacaggtgagttttatagtcttcgctatctcagttcttctgatttcaaattatttgtaagttaaaattgca

SEQ ID NO: 51689 - DNA, 1157 bp, Homo sapiens
agccatttactataaaactttaaaggtaacagcattagaattaatttactgttagttacgctgcttgtgttttcctttttctttttttgagacggtctcattctgtctctcaggctggagtgcaggggctccatcacggctcactgcagcctaagcctccccagccttgggcgatcctcggacctcaacctcccgagtagccaggactatgggcacatgccaccacacccggctgagttttgaattttttgtagagacagagctttgctatgttacccaggctggtctcaaactgctgggctcaagcgatctacctgcctcagcctcccaaagtgctgggattaccggcacaagccacaatgcctgggcctgcttatatttttctaatgctgtccttagttgtgactgacaatgactttgcagacctgggagggattatattgggaagtgctttatccacactcttaaggttctgtgttttaatatatggttacctgtgtgtgtcatggagctaaagcatgaagatcgtgttaagtaattacacactgcatcttgaaagatactgatgagttaagcatgtggcagctgcttcccttctcctatgacacagaggcattaggaactgtctggcagatttatcctactgtaagaaactatcagtaggtatggtgggtctgtgttaactgaatacacactgttagtctctgatattaatgcagccttggattagcttttcttttccctaaattttactcagaatacaaattgaacagaacatgtttcttcctttctgccaaatttttctttggagatattaattgttgaaaagaagaagaaagtcatgttttaggattggtaatgaggttatggagcacattcagggacatgagtgtgaggaagcgtggagtgttgctgcatttctttgttgagcaaaggccatatctccctcattttcatgggtcacattctttaagaagacagatccggacgggcgcagtggctcacgcctgtaatcccagcgctttgggaggccaaggcgggcggatcatgaggtcaggagattgagaccatcctggctaacatggtgaaaccccgtctctactaaaaaatacaaaaaataagccaggcatggtggcgggcacctgtagtcccagcta

SEQ ID NO: 51690 - DNA, 1596 bp, Homo sapiens
tgggggaggcagagacagtgagagacagagacaggaggcggcggggagggcagggagactgcgggtgcggtgggcttccgaaaggatgcccagggggatgtggaagttagagagcgtgttgttttgtcgttttgactcaattctcatagttttacgacttctgatgatttcgaacaaaaggtaaagtgtagtcacacttaaaaagggaggggataatttctgggtaggaaaatagtttggttggctgtatcatatttccagtgggcatactgacacgttggggcttttttttttaatgaagaattttaatgtgaattggggaatagttcatagatcccagtttgaaaatatgccaaggcacagtatggttagtttcttattgatacaaatacaggtttgtgttttttgtttttttgtttttttgttttttttttgctctccttaggtcttaagtagatttctttttagtcatctgaacgaacgagtccatcctttatccagaacattgcaaagtgagttgtggaagtcatactgtaaataaaatcatatcgtaaactcgatttgggaaaatgttaaaatcggcattaaggaatgtaggcaagaagtctgttctgatttttcaagtatgtattctttgtatgtcaccacaaaatggaaatagaattaattcccccgtgaaacagttagtaggcctattactgaatatgcattgtctatttattgaatgtgatgtagtcactgcttcagagcattaaatgcttttgatcctgaatcagacgatcagagtctagaaaattcccagttttttttttttttaacttttaactgagttctgggattttattgctattaggcttagtgcttaactgtttgtagtgaaaactttttatgtaattcaacttgtttctttatttagtattcattttgtttataactaatgttaccagccttccgggtaagttatttgtagggggctggagatggggaggacagtaccctctttactgtgccactaatcataactaactcctgtacttaaatagatttgtagtttaatagcaaccttactttaacgcttttctctgtttggcatactttagtgtgcatgtttagaacatatgtcattactcttttgcttttttgtttatctgtttatttttctcttggttggatttggggaaaaacttgaacatatactttttgttttattagtgatatatgaacttaatagctgcatttttatacctgcgtagactgttggtgtttcgtattaaatagttcatatttcttattatcctattattttgtactactctgggcagcctataacccagaatcctaggttttaattaattaaaagacttatgtttatgcagagctctctgttggaacttacagtctgtttttaacagcttactggttaaagagacctatttgctctttaagacttaaactttggagagtttaagtaatgagtcaaaccttttttacttttaaattaaatactcagttaaaaccaatttatagcttgcaaagacctgaaatggagtctttttttttttttttaattaactcagttctgtttaggtcttatgt

SEQ ID NO: 51691 - DNA, 1109 bp, Homo sapiens
actctgcaaaagggtgagattctagatagtagtgtcttaaggctgggacgaggaattctaagaatgaaagaaataccaagttgtcaaatgtgaaggagaaacttggggcaaataaagcctgaagaactgttgggttttgtaattatggtattagtgatagccatgggaattggatgcctgtagagtagagagggtggaaattcagttgcaaggatgaaggactgatggagggcagaggaactggaggcagcaggcacaacccaccttggtgagttggtatcagccctgttgggaagcccgtgtcctcgatgaccattcatggtacagctgtggaaatctcccagttggagtcttgtctgctttggaaccaactgtgaagctccccaagtgaagatcggatggacctaacttctgtgcacagatatttaattctgattttatccttcagagttggatagctccccagtgaggaggcagcacatctagagttacatatagttttaaatttaattcatttaaatcaccaaatgcatgagccttcactgttgtgatgaatttttaatgtaacttgagcaaggctcccagaattttgcattctctctactgcctgaacattttaaggtgaaacattattctctagaatttcctactgtgtctgtccaatttattaggctagtagaacatagtccagacctaggttaaatttttcatgtgacgctttaggcaattttaattttgtaactcatatcccaggcatcagtggtataatgctatacatagtcttagaaaatagtcattatggctgttgaatgtctttgtatggtaactatttcactacaaaatccagttttattgatattactcagtggtgaatcatacttgttcagatcagggttctgtgctgttgacttgtttctggcacaggataaaatagaaataaaaaaaagcattccaatttgattgttgcttttttttttttaaactataaatgcagtttaagtctttgttttgtttttgagacagtctgtcgcccaggctggagtgcagtggcacgatcatggctcactgcagccatgaccttctgaggtcgagtgatcctcccacctcag

SEQ ID NO: 51692 - DNA, 1389 bp, Homo sapiens
cgcactagccaggatggtctcgatctcctgacctcgtgatctgcccaccttagcctcccaaagtgctgggattacaggcgtgagccaccgcgcccggccttctttttttttttaagatggagttttgcccttgtcattcaggctggaatgcagtggcacgatctcggctcactgcagtctccacctcccgggttcaagtgattctcctgcctcagcctcccaagtagctgggattacaggtgccctccaccatggctggctaatttttgtatttttagtagagatggggtttcacccaccatgttggccaggctggtctcgaactcctaacctcaggtgatccacctgcctcggcctcccaaagtgctgggattacaggtgtgacccactgctcctggcccttgagttttcattctggctttacagctactgtagtcgtgtgtcattgggcaagttatttcacatctctgccctttgggtgtctaccttgtaaagtgatttatgcgttgggactttgggggcttctagcaaaattgatccattaagtggcaggggcatcagttttacaataagggcgcacagtacaggcccaagaatgaatatactacattggtcttattctcagcaactaagtacacagttaaacattatttttggcatgtgagcaccttgatgcagtagataactgctgttttccttctgttgtattcaatttctcatcttgatgtattcatttcttttcctcatgcacatagtgttgtcctgtccctctgctgttccttgtcatcatttccatttcacttcccttgtgtttcattcctctttcttgtctagaccaagcggagcagccagctggcagtagcgccctgtaggacccccaggacccgatggtaagtgcacttgtgtgcttgccaggcctcccagcggctcctgctcctctgcctcacagagagaagctcacaaatgccatctcccctctgtaaatgtccttatgggtttggttttttcttttaatttgatgacatataggacagaaatcaggtgtcagaagaaatcagtactggtttaaggaaatgtagcaggttccaccgcctgttgctgcaatatttggcggttgtgagggacaccaagcctgtgtatgtgtgggcaggacccctggttctgctttctgttctgccataggctaattacttcccctctggcgctggccttcactttctcccacaaaattgaaggcaggacaggtgatttcaatagccccttcatctctagtccaaggccctcacgatgagacgtaacttaactgatggttctcatgaagattgagaacattgttccaggtgtcagataatctcaattccatggatgaatgatatagacttgtgatag

SEQ ID NO: 51693 - DNA, 1043 bp, Homo sapiens
ctgaagaattaggtatgtaggccgggcacggtggctcatgcctgtaatcccagcactctgggaggccgaggcaggcggatcatgaggtcaggagatcgagaccatcctggctaagatggtgaaaccccgtctctactaaaatacgaaaaattagccgggcgtgttggcgggcgcctgtagtcccagctactcgggaggctgaggcaggagaatggcatgaacccgggaggcggagcttgcagtgagccaagattgtgccactgcactccagcctgggcgacagagtgagactccatctcaaaaacaaagaaaaaaaaaggtgtttaaaatggtattttagaatttacgttttaagactaacaagcaaaatgactgttaaggttatgtctcaaatttttgtcaaaatctggtggtgttttttaggatttgtttttgctttgtattgtatttgatgtttctacttttaatctagatgttttcaatgatgctattttatgtctctgacctcatttttgtctgtttacatttttagctaattatgcttcccggtagtgattctctgttatggagtatgtaactttacgtgtatatagcagctttaagtcgtttttagtttgattttactaatgcagagataaaaggtgtcagaggcttgtagttctggaagctggtggaggtttgtctgggggagagcagcggagaaaaaggaggattgttacggaagaatggggatctgtctggatctgaagactgaaacaccagcttccagaaaaatagaaatctggtaattaaaaaatgtaaaagaaaggttgcaaattctggttaaatcctaaagaaactgggcttctgacttcttcagtattattactcctatagataattgtttcttatcttcatgactttagttccgttgttccaacttatgagaacgatgttgcaatttaatcttaccttgtaaacgtatggtatcacttggaatgcagtcagtgtttctgaattccatcctctgaattgttaatgaaatattgacctggactggacct

SEQ ID NO: 51694 - DNA, 2255 bp, Homo sapiens
tgaaattccgcagaatctctgcttctcttgttttgcttccaacaattatggataatcatgtcttagctaaaagggccccaagttataacatactgtttttctctaatatgcttcttacaaatagccaatccctattagctgtgtggcattgaaattcaatgctattactaattttcctttgacatcaatagtaacgttacctcataatttgatagtcattatagctatgaagggaactaatgcccaagattctcaaaaatgcaagattgatgtgtttctttcttttcccctctgtcataatttacctatataacagagtatttacagtcatcattcattcctttctttaggaatccaaagtggtaattgcccaggaatatacagtgttcttgattggattaataattatcttcagtaattcagaataacacatgagggaatgaatgaatgaataaataaaaaaaaaatgaatgaataaattaaaaaaaattgtgtttcagggaagaaaaaatcccaggaaaataaaaacaaaggaaacaaaatccaagacatacaactgaagacaagtgagccagatttcacctctgcaaatatgagagattctgcagaaggtaagcttgtgatattggcttggtctgaattgggtgtgtatgtacccagtgaatttaactttgtatctctttatattgtccttctgagaatcatttaggatctttacgaggttaaacagcaaaaaagctgcctaaatttaatgtggtaagctgagccttctatatgctaccttcccttcaaacaattgtgaaagacttttcttcttaaaaatgaacttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattcactaagatgatggcatgtgcctgtagttctagctacttgacaggctgaggtgggaggatcactggtgcccaggagttagaggctacattgagctgtgatccccccactgtactccagcctgggtgacagggcgagactgtctctaaaaaaataaaaataatgataataaaatgaaacatatgattgcatttaaaaatagcatgaagttcaaaaccatcaaaaaatagtgatagcaaggacatgaggaggcacctggggtgctcgctgttttctattattcatctgtggaatggtcacatgggtatatatatttagtgaaaattttatcttgctatatactcaactatttgtacactttaatacatgtacgttttatacttcaaattaagcatttacttacaatgtcagagactttgatttttgtataacagaacaaaaagtatacagaatgaagtgtgtttctgttttttgttggaatttaaattcttattttgtctcttcgtgtttgtccccttaaaattttctcctttatagtccctctggtgataatattctaggcctgccacgacgtaagaatccaaccaagaggcatggattgaaagttaatcagaaagacagcttgccctctgctcattgcagttgggccaccatattgagactattgatacagaagggaaggaggtgtgtcttaatttgccatgggcaaatttttgcagattgcagcttacttgagttgtttatagtgagccaagtaggcaaatttcagaagacaggtttgtgactcttttaagaaatatttgtagaggaaaataaccagaatattttggatgcctttcataaccatttttaagcactgtttgtgatgataacattcataaaagatataattttctgtgaaacaagaatagtcaagttcatttcccagagtcttaagactaagttctgcctcctcattgcaggtgtgccgagagttttttttgaacaacaaaaattactaaggaacctcactacctttggcggtagaattagaaaacagattcagcagtcacctactccccttcagtaattcgagacaattatttttctcctgacacaacatcaggtcccatgaaaaatgacacttgctggcctggcgcggtggctcacgcctgtaatcccagcactttgggaggccgaggcgggtggatcacaaggtcaggagatcgagactatcctggctaacatggtgaaaccccgtctctactaaaaatacaaaaaaattagc

SEQ ID NO: 51695 - DNA, 2723 bp, Homo sapiens
aaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagat

SEQ ID NO: 51696 - DNA, 1668 bp, Homo sapiens
accgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggtaagctcaggagctggtgggagggaaagaccgggaaggcgacagtatccttgcctacgggtgttttttggtttcttgttgcttttttttttttttttccccacttaaaggaaatagctgttgtataagttaaaggcatgaagggtcattgctttggctgcttttagagatgaataaatagttctaatttcagacttaggactcacaaagcagtgccacttctttaatgtggccagatgtaaattgaatttaaaactatagaaaagctctcaaaagtactctaagaaaagatgcaatcctctcaaacttcctttatgtcttgggtaatagctcagtgtcatgtgtcttattttccgatcatagaacatttcttaggttaagacgggtcactaagttcattagtaaaccatgttacaatcttgtttaatatttctgtgacttcagcatagatctagtacctgacactttctttcagaattgccaatgcttaaattttaataattgattgcatcggtcaaaacaaaacatagtcctttaaaaaggtcttatgc

SEQ ID NO: 51697 - DNA, 1044 bp, Homo sapiens
aaagggccttaaaaatcatgtctcttctttgccccagttcattttcattattttgctttgtttgatagttaacagagggttaccttgctggagtgaaattttgcctaaaaggaagcacagaagaatcagataagaaaacactggtattgtcctaaccgtagatggtaatgacaggcattggtggcagctcttcctcctctgtgtgaggtgctggaactgtgctgcggacacatctgtaggtcaggaatgtgatccaggggtccacttaccaagtcaccataaacctgtgatgtgttcttgggaattagaaaacagatgttcatcaagatagattttgactatctggacacaaaagtgggcatttctttaaagtgtttgttttggtcttagtactttgtagtgagtttagcacaaaactgggattcctaaacttagacctgggtaatatgatgattgtcattaacgtgttgcccagggctcgtagagaggaggcctcagcctcagtgcatatttgttgcattacactaataaggagttgtttgaactacagtcgtctttctgtttaagtatagttctacttgtaaatttcgtgtagggatgattcctgacacaaggaatcatcacatctattacatgtcgaggaatactcactttcactctgtttgcagcttgctttacttaccctgttgggtacacagggatttcttacagaacaggcagcacatccttgtcctgtgttatttctttacaacaagctgtgattaagagctagttttccatactcagatattttacatgtgaatgccactttcggattccacagtttttcaagtacatgcttgcaatcagccatatgatttttccatgagttttctacttaacactgagggtcatttcctggaacacaagccatggtgccagacaaggtgtcaaaaagccatgtgctccaaatatttttcttaggagaaaacacaggaaagcaggcatgccacagtcattcaggttctcctgctgcagctcttactacagtgacccaccccccac

SEQ ID NO: 51698 - DNA, 1035 bp, Homo sapiens
tacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagca

SEQ ID NO: 51699 - DNA, 1024 bp, Homo sapiens
tagttttctagattaagaattgaggaaaccatcatcactctacattaaattacttgcagttgcaaaaattgcatttaattgtgagtcattaaaaggtacccagaaatacttttattaaaataaacttgtcgacctgttgcgggtaataggatttgcacatgcctgcatttctgccttccttatgtcagctggatttcttttcaactcttttttaaaatagaaattcaggtggacattctggagaccataaacattttacggaagactggtgcctaaatgtgccttcccatgtccagctaataaaccatggcaggaagtcaacagaacaagccatgtttctgaacaccctttcataggtgccacctgagttactcagtgaggggagaaagaactggagtgtcatttcagcaaccacagaaagctacaggtgaattttaaagcccaggtttgtgttctgattcagaacatatttaagctaagaatatttccttattcatgtttaaacaggagcctatgatacaatctggaatcctacatctactgagtcttagcattaaatctaaatgtacatttaaaataggactcactttaaaaaacctggaatttgtggcacaggtaagttaacaaaagggcatttaggccttaggagacagttatgggtattttaattttttaacttaaaaacaatttcagtgtacagcagttgaatttgtcgtagcatttaatcattggcccaaaatatactttaattttttttattggaatgaagttatttaaaactcatggattcaattttccttgcggtaacattctcttctcacttgctttttataatcgcatccaatccttgccaacccagctagagtttagaacattttcagatggcttctatttccaggctattattggacttgtgaattcaggcacattctcctgttgtgattcagtcagccagccattcagaaaacatctttcaacagccaatctgaatcatcaaagtgtcaggctgtagatctgaaggact

SEQ ID NO: 51700 - DNA, 1964 bp, Homo sapiens
agggatcttcttaaactgcaaattctgacttggagtgggtgggagctgagagtctgcattaccaacaagctccggggggggaaatgatgccgctggtctggggaccacattttgagtacaaggatctagaccagtggcctgcaaagacaccttttaaaattcccaatgcctgggctgtacctgaaaccaacgaaatcagaacttgttgggatagaaagcaggcatcaggatcggtttagtatccccaggggattgcagtgaacacccgagtttgagattctctgttccagtgccctctgagcaaaggtgggtccagcccaaaacagactgccagagtcttgagtggtcaatgcagctgctctatgggcaaaggctcacccccacctggctttgggatattggaaacaactcttcaatcctcactactatggggactgtgtcagggagtggggcatgggctttggtgtcaaatggtcctggattcaaatcttggctgcttctctacttggccgagggaacttgagtgtccagcttctttatttctctgagcctcagaaccctcctctgtaaaaccaggaccatcacaggcccagccttacaggactgctgggaatttgaggagctcccaaaaactacccaaagtagctcctggtgtatagaaagtgctcagtggatgatgcgatgatgtttttttcccccttgcctgacatcctcattttacaggcaagacttctatggctcagcgaggtagaggcattttccagcggctacacagcaagtccgtaatggagctaggattccagctctgggctctggaatccccaccccatcctcctttgggttcctgccctgcttctttcttctctgtcttctcagcccttcccccaggctgggggcttcatttgaatgggcaggggcttcctgaagcacgtgggccttcccacttggggaaggtgggtcctgcagtggatgtcgactgttcctggaggtggctgagggccgatggctcccacagctcccacctgtgggccctcacccagcccccagggaatatcagcatcatcacaggcttgtcttacctttgcaccatctccccaccctctgcctttcccctaccttcagcaaaagtgcagaatatcagacactgacttcaaatgaattgcactctgagaatttagagagttgtgtaagacttctgcggccagcgatgtggcctaaccagctttctgtatggctgtcccaggagatccctcctgaagactgtgagaaaaaggtgcaaggagggaccagggcaggcagagatcccagcccaggatgcccatggcggtctggcagggagcttggaagagcaccgtggccacgtggggaccctggagccctggagagcccatgtcctctgaaagccggcagctccttccctcccaaactcctttccctccacccttcttgaagcgtcctctgggttcctgcctccagtgtctcttctccccttctctcttgaactcactttcagggttttggctcttcttgaggagccatcaaaccaaggttatcagcagcccccaggatgctcaatgcagtggttggtttccagtcccatctcccttggcccatctgcggcagtggacgctgttaatccttctcttccttgaaatactctccacctggacaccgccctctcccagtctctgcacattaccagctgctcccccgcatcccgcctccatccctgggctctgtcccccgcatcccgcctccatccctgggctctgtcccctcgctccgtctccgctcccccttggtgatctcatccagtcacatgcgttaaataccacctggatgctgaccaatcccgggtttccaccctcatcagaatctccattcagccgcccacctgacatctcccttgggtgtctagattcaaatttaatctttccaaaatgaaactgtctctccatgaagcc

SEQ ID NO: 51701 - DNA, 1078 bp, Homo sapiens
gggcagatcatacctgacgattcatagcagctaagagttctgctgacccctgtcaccactctccagttcccctgccaccaccctccaaatcccctgccaggcccatctcagttgtggagaagctggaagaagatcagggaaaggaacgccttcttcctccccgtgtggttgcacgacaccagaacattcttgcttgtttgatgcaaccttgatccaagtggtggaggcgaggttgtgctctgtgggcactcctgctacccccttggagtcctaggctgctggaaacatgaaagaagctgaacatagttttaatgagtttggcaagaacaactgtttgagcaggtggctgctgtgtggtacaagatcattggggctaaatttattctgcgggctttgttggctgggtcatgtcagacccttgggtcaggcttctgaaaggtccctgcccctttactttctgatgaattgagacctcagcacaggagctcagatggagcttggaacaggcagtcctgcaagcaaagagccccagggcctctgcccacttctccagtcaggctggagaggggagagaagttggggagaggaggtgtcctgcccagctcccttctcctctgtcctcttccaccacagcaagcgctatgttacctttgtggggatgtaaaggccttccattcccaatattacctctgctctacagattgtgtgaagtaatgagtcattaagaacagagcgccccttttaaagaagctgatattctccactcatctttgcatacctcactattattattctcagaacttaccttttgggcatgccacaagacgctggggattctgggaccatcttgaagcctgtagtttctttctctttggtcaaggtgaatagtttaatgtagcagtaaatgagaactggtttcattgctttggtcaaactttttaataaataataatatgcacttacaatatatcaacttccctggcaagcgcttaacatgcattattgaatcctgaggccagcgaggtgacaactatagctggcccccacccagcacagtaaaaaatctgtctataacttt

SEQ ID NO: 51702 - DNA, 1035 bp, Homo sapiens
gattcctagtgtttttaatgaagagagaaagaaaattttggctcctacattttagtagtcatatttttgctatctgttggagaaaatacataaatgcaaaagattacaatgaattcagtagctttgtcaaatggttacagcttcggtattgcatatatttgaaaactaatggtacatacatgcaagaaaaataattcattgtgcccataggcagcaggttggagatgtgtggattttggacttctcgtcaccttctctggccacccagagtctctgcggcccacaggttgggcccggatcagtgcagtgctgaacaatgtcaggtgcagtgaggtgcttgacaagtgccttggaaaactatggcctctgccctgggactttgagtcttctgccgattttaagggattcctctgttcttcaaacccaactctgcctccctgtgacacaactgattaacctgtaatttgggcccctggctttcagaaaactctgcaaaatttctgcagagtgacttcctggtatgaataccagaaagcaccagttatggtcagaataacagaactggccccatgctagatttccgggaatacgatgcaattggccaactgccatcactaactagtgtcaccctgcctcatctccagcaatgtcctaaaacccctcaagcatgtgatccgtcatatcattttctcatttatgccaacactggataatggcctaatctctccagcagcattcagatttattagagaagatggcatttacaaaaccatttccctgttcctctgcaaacaccctaagctgtcttataataaaccactctctttatagtaagccttccttttaacagtggtttattccctgcaattaaaatcacctggaagagtccagaaactggttttcatttctcttccttcgtgtttggttcatctttggctggagggctctgcaggacttgggagtgaacattagagagaggcagaggccaaactttgctaaggatgagagctctgcagcaggacatggtcagtatga

SEQ ID NO: 51703 - DNA, 1034 bp, Homo sapiens
gaagggaagtggtgtgatctgaggcatgtggacagccacctctgatgtctgggacaccctgagacaccaccatcagaatcccatgggttaagatctcctccagatcatcaatttacaaacgcagttacctttacctgggaaggttacctttaacttcccataatgccttcatgagaacaagtgagtagataatctggctcttttctagcagagtcctgaagggatgggacactggacgggttagttttgatatgcggatgagggtcttacatgtcgggagcattcgttcattccctcatttgatattcactgagcatctcccaggagggggcctactcaggctgagggctttggggacaggaggacgccaggaatctggtagacgggattgtagggagggcttcccaaggcaaaccttgtctgccttactgcttaaaactagagccatcccagagtcagggaagaacacatgtgattaagtcactgtccaataaagtctgtttccacagaccaaatccatccattccggtcagctgatgtgcaagaccctcctcacttttccagacctgcttccctctgcttccccacatgccccactgtccaggcaaatggaaacacctgtgtatgttccagtggctgaacctttgctcctctggtgcctctcacctgaaccagccttgggaagcatttccatctatcgggacacccaccagtcgggacccttccaggttcatctctgattctacattctccatgtctcctttcctgtttcctgtgatcagatgggacctggtccccctttgggcctccttaaaacaaaactttagcacctccctcctgcctatggtgtgttctgtcctgtcctcaagtcatctgtcctcttatctgagtccccattcttactctgaaggcaaggactctaagctcctcattaccaaaaaaaaaaaaaaaaaaaaaaaaaaaaaaaaaaaaatccctagagcctagacagtatctggcacacagttaatatgtttgctgaattaaagcttatg

SEQ ID NO: 51704 - DNA, 1055 bp, Homo sapiens
atgtccccatcctgcattcagaccagcctgtgacaaccacatctccaccaccccgccttcacatgagctccatggctccacagaccttgtcctgcccagctctgattcccagtctctagaacaaagcctggcacatggtaggtgtgcgctacagactagggaaactgacaattcttcagacagtctggaatcgctggagagctccaggatgcgtttctgttacaaaaagggtatagacgtgcatggttcggctcagctctatgtatcgccgtattttggaagatcactgtctcttcatttgtaagcatggcaccagggaagactctccattgggtgtttcctcaaagtactgcctttggcataacacgagagtcctcgcccccatcacctgaaggagtgggaaaggaaggggtgagtttaagaaagacacaaacttgactgaaaggagaaagagtctcgaacagatggcacaacctgcccgtttctccacagcatgactgtgacaaagagaaggaagacctgagtccactcagtggtgagggcagctcccaggtaccccatgtaaggaaaatggtgaagacggcctgatggacttggaagcagtgggttaagctatgttgatgtatcatttggtggccacttaggtaacacacatggaggtagaaagggcagaaaggtggtgctgggtttttttgttttttggtttttgtttttcagatggagttttgctctcgttgcccaggttggagtgcagtggcatgatctcggctcactgcagcctccgcctcctgggttcaagtgattctcctgcctcagcctcccaagtagctgggcttacaggcgtgcaccaccacccctggctaatttttgtatttttagtagagacggggtttcaccatgttggccaggctggtcttgaactcctgacctcaggtgatccgcctgcctctgcctcccaaagtgctgggattacaggcatgagccaccatccctggcctatggtgctgtttttaatttaactatgttttgtccaagaagcgctaactggagactct

SEQ ID NO: 51705 - DNA, 1048 bp, Homo sapiens
aagaagccctgcaataaagaagcctgttgaatctagcatttcccaaatgtatttgactatggagctttttgtcttagcatgattccaaggactagagtttgagatcaagcgatctaggtataacccaagtgttcctaggccacaagagagaacaaaaaaaggaagggaaccataacagagaggaggcagggggaatggctctacacagaggcagaaccagcacaaatcatgtcactggttgctttcaacagaccgtgagatattaaaaaacaaaaacaaaaacaaaaaaacctagatatggaatctaggtattattggccaaggctgacacaagaacacatatttattttagttgacttaataatcaggcctgccatgtacacagtgcactacagtttacaaagctcttttctatctgtcatctcccttgaatatcaccatgaccttgagaatcaggggggagttatcatcctcattttgcagctgacaataacacttaccacagtgatcataactgttgaatttcctgagtgccttctacctgccaggcagtaacttaagcatttccacctttattaactatagtcttcttatataggaaggtgactgtggttcagagaggttaagggactgatttgaggccacacagccagcaagcagcagacccacacgtgaacccgggtctggctgacaccacagcccctggcagggagcgaggggcagcaggaacatgcagccccctctaaatgggttttttacaacctgctctaagtcacagcgagaagtaggctcagggaatgtaaagtgggtagtgatttttttctcccctattcttttactgcttttgtttattgaaggacaaatcattgctgttttcgtttgtgtttctagcacaataaaaataaaagatatgccggcaatctttttaaaagcttatacaattccagaatttgagctgtcggatttatgccgcacactgatctcatagacatcacagtgccatctgcctgggcccgccaagggcttccgaagttgtcgttatcaatca

SEQ ID NO: 51706 - DNA, 1052 bp, Homo sapiens
agccgccggggccgggcgcgcgagggcgctcggagccgggatcgggaagccgctggtggcaaagttctcgcagcgcgcggagccccgagccccgggcgggtgcagcgggaggcgtgcgggacgcagagtgagttcctcggcgtggggaccggggctcgggggctgcaccggggggccaggaccgcgcttgccggagccaggcgatcccgcggcgcctggagacccagctccgggctggaccccgcgtctgctgggggaagcgtgggaaaggggccagccctgcgcgaagttggttcggccccctgggaccgcacctgtgagccatgtggcggcccccgcggagtgccgaggggagcccccttcaccgccgcccctccgaggcgaaattgatgcctcgcatttgctaggagcggagagattgctgcgtttctcatacacttgaactccgagtaatgcagaaagagaaattgcagaggtggagacacaaacgcagtgatctaattgcgtttggttggcgaatccgccccaagtggagaacagcgttttactgttaaagtgttcccagcgggtgtgcccgttccatcccactcaggcctgcgctatctcccttccccctgccccttccccccaagttagggcatggggatgggagacaggaacccctgcgtcatcttgactggagtaggaagaaaccttagaagacgaagggcttttctgagaaggggctgccatcaccaggtccaagttctgaatactttttccgggaaaaacgggagggggaggcacaacataattattccttattcatcgaacacctattgtgttctagtaattcacatgcaacacatccttaaaatcttatcacaaccctgggagtgaggctgtgttatctccatgcagatgaggacagaaaagcccggaggttaagcgacttgcccaagttcccagagtcctaaatcatggtgttggaattcccagttttgtccgtggaaatccaaagtcttagcaccataatacctctcccaggcagcaagctcactagctggggagca

SEQ ID NO: 51707 - DNA, 2386 bp, Homo sapiens
caaccacaaggccccctattcttgtttttgcctatggtagcctccccaggagatggaatgccgcctctgggtgtcagggcagagtagtcctctctcctgtgttggagttttccttttcccaccttctccccagttacacacggcagagtccaagacgggttgaggtaaaacagcatcgatgcgaaaaggaagcagatgggagagtttggtcaagttgcttcatctttttgagactcaatttacccatctgtacagtggaaataataatagtaccaactaaagatctgtcattccaaagatggtgtctgtaaaacaccttgcctcattcaccataaatgcttaatgcatgttagtcctcagctccttctggcattacatgcttgccagatgacctgtcagtgctcccactgactcagtttcccattagattgtggcgctctctgctccatctccaccctcatgaactatgtcaagatgacttttgtcttgtctgtaaaatactaaagtgatctgaggctgagtgttgtgtcagtgggagttgttttcatgtaaacatgtacaggagatggctaggtggagatagggctgtttactttgtgtctctatagactccatttgtgtgttcatcataatatcctaatgacacggtatagcccaggaatgcctgtttcctaggtctaggggtggttgttattcctgcagccctcatggtatgtccgttttaaaagacagcacattggaaaactcttttcccagtttacagatgacatcactggcatgaaacaagatcagaccagcagctaaaccagaaagttttgagttttctctaccctactgcccttcaccctttctggtctctggttcttaaagaccaaatcgagtttctgagaacttccatgatggctaggcattgaggacagcctgccgtggaaatggttctgaaaccatcggctgttacaaggggctttcctctaggagggcgatgggaactctggctcaaagctgcaagctgaacttgttgctgaaataaacatttcagccaggctgtgcggtggctcttcctcgaatctcagcacttgatcccaagtcaaatgtggtgctcagtttaaggagctgaaagaggtgccctgttggatgggagagtctgtgaattggcactttcagagatgtggggaagggaaaagatagagggggatgctggcttggtgggatggaggcccgaacaccttgaattgctcagggagaatgtcctgagatcggcaggtgatggccctgtgatggtgacagctctgacctccagggtgcgtgacccagggactagagcaggaggtgcagacagtggatgtttgcacaatccgcacctgcttctgcctcgattgcgttttactctgagatgttccacaactcactttccctgttggcaccaagggaataactccttctgaaggacggatcattccagagccccctcagagtgaaccaggtgctcactggaggttcttaaactgggaacaggaatccggttctttgatctttcattgtccattcattcggtcacatttcttgagcatctgctccgggccaggcactgttgtagctgccagggatatggcagcaaaggagatgactgcagccctggtttccatggagcttatagtctgtgggaggagatttccagtaggcaaataggcacaggatatgtccagagatggtgtaagtgctatgcagaaaaataaagccggggaggggttagaatgatgggagcaggtgctgcttagtttttaggtagggtggacagaggagcacgttctagaatgaagtgaggtgtgtgggtgctgagtttctaaggcaagagggtgttgccgatcagctaaaggaactaagccatttttaaaaggtggtgggaaattagtatctttgtagacgaggcactctacaggtctgtaactgaagcatctgcactctaacccttttgctccatttggcatttctcttaaccccgagctcagaaagccacgtggccttattctgcctcttcacatcctctacctttttaaaattctgtattattttattacgatgatcatttgggttcttatcacttcttgcccctcccctttacatgaaacccgcggttgaggggactggggcgcttgtgtgtctttgtctttgtgtaccggctcccagcactgtacccttctggggaccagttgtgtcgtgaacgaaacaggatgccttgtcttcatgggtcctcccagcaacccaatggggaagtgcagttgctaatcccatccacagatggggaaactggtccttagaacagttcagtaactgcccaaagccacacagccagtggatgtcccaaccgggaatttatcccagaccg

SEQ ID NO: 51708 - DNA, 1058 bp, Homo sapiens
cttatgttgcgggtgccagatgagtgcctttcaagggagagggaaggtcaggcttgcctcctgttcacaaggacaacctctgtctcccttgtggcggcttctatgaaggtggggactccaggctttctctcgtctgctttttggatgccttcaagagaggccagttagaggatatcaattgtggcaattccccagagccctcatcagatggcattagcccgtcatgtgctgcagtggcacccagtttggaggaaattcggaaccagaagagtgtgacaggtacgtgagtgctggccgctgtcccagccctgaactggctgacactgagtctggcctaagcagcggggagctggtgggctctgggtggggcccgtcctcagtctacgtgctggacactggggactgttttgggaaacaccctccacctggcaccaggtgggtaatctgccggtgcccgtggtctcgtcttttgttgcttcttggattcggaggctggctcaggctcccagctagtttgggctgtaactttatcacaggcattcactgtgttcactaccttttaattgtacagaagtttcagaaaagctctcctggggaattggagagaagtaaaaacaacagctgctatttcccggatgctttattccctcccctcacagcacagcctcagcagcatgttcctgactttgaagttctatgtgcccaggctgggaagaatgtggattttcgctcagtcgggtcccattagtgtggaaggatcattgactgagggccgagcaggaaccaagcaccttgttacatgtgttccttttgatccccctcttcctgtcaggcagctgccattctccccatcttacgggtgagaccactgaagcttgggagaggttacaccggctgtggaaagtagctgttccaggctgccatgctgccctcctgggacccttcctcctgcagtttccttgtcagctgacgattccccgggctaccaggccacagagcggaggctgagctgccgagagtcacaggacttttcttcctggcaccttcggctcactggc

SEQ ID NO: 51709 - DNA, 1043 bp, Homo sapiens
gtgcgtcttggctcactgcaacctccgcctcccaggttcaaacaattctctgcttcagcctcccgagtagctgggattacaggcgcctgccaccacgcccggctaatttttgtatttttagtagagacggggtttcaccatcttggccagactggtcttgaactcctgaccttgtgatccacctgcctttgcctcccaaagtgctgggattacaggcgtgagccactgcgcccggccctcctttttcatagcatatttgtgactgctaagccccaggaccactccttgccctggggttttgaacagaagggcacctgctgcttagacgctgtagtgtagggagacaacctttccttcagtatgagacagattttctgttcagcaacgggacaggctgccctgggaggcagtgggttccccagcactggaggcatcaggcagggactgggtgtgccccatcagggtaccagagtggtcatttgggggctgatgctggccagtatccatctaaatactcaattgcccatcctggcctccagtcgccccctccatctctcctttcagagaagggtggggaggttgggccagccaggtctgtggccctgcagccaccttcacaccatgagcgttccctgctgcccaacagcttcaaacatcccaggctgagggtcatcgctgatctggggtagcccttcttctagcgccgggggcctctgtggcattcccgtaaacctccctggctggggaggagttgctggacttgcatttccacagtgccagccctcagccttcctgtgctccttccaggccctcctgggtgcaccagcggctgaccaaggggcaaacctgcatccctggttttccctctgcagggacagaggctaccccttgggttctggagcagtcacggatgcctcccctgccagtctggcctgacttctccctcccaccagggtacagtggttctttcttttttctttctttctttttgagacagagtttcactcttgttgacaaggctggagtgcggtggcgcaatcttg

SEQ ID NO: 51710 - DNA, 1019 bp, Homo sapiens
tagttttctcctctgctctccttagaggcggcatgcagagtggaaacagcgtttgacctttgtgaattgtgggcagagctagccagacagacggggaaacatttggtgggaagtcagaggccactcagagcaagaattaaagttccgtctctacctttttcagtccagaaaccagagaaagccagaggggacagcagcagaatagtgcccaagcctccagattaggattgcaggatcacttcctcagcagtcaccccccgccagctgctggagagcctactccggagacctctcagcaaagaatgttctacctgaggatttacatcagagattccagaagtctctggggacccaggacaatgcttcctggcaagggctggtctcacaacgagaaggcagtgtggttcttgagggaggagcaggagggaaaataataaccaaaatgtatgtagtacttgccgtgtgcccagcaatgttcttttatggtatagacccccaattaatccctacagcaatcactcccattttacagatgagagaactgagtcacggagaggtgaggtgacctgctcaagatcacttggttagtaagtggctgggatgccttgcttggagatgtgtttctagctgcttagacggcatcgcctctcaggcgaggtgctcagtgagtgtcaaaaccaaaagttgagccgggcacagtggctcacgcctgtaatcccaccactttgggaggctgaggcgggcggatcacctgaggtcaggagtttgagaccagcctgaccaacatggtgaaaccctgtctctactaaaaatacaaactaattagccgggcgtggtggcgcatgcctgtaatcccagctacttgggagactgaggcaggagaatcgcttgaacccgggaggcggaggttgtactgagctgagatctcactactgcactccagcctgggtgacagaaagagactctgtctcaaaaaaaaacaaaaacaaaaaaacacacactggatatgcagcttctat

SEQ ID NO: 51711 - DNA, 1050 bp, Homo sapiens
tttctaatcagctgtgttcatttctagtcctgaaaggttgtggcctgatgccggggagacacagctgtgggggcccccgttggtgtcctacttggtttcagaagccatgcctgccacggcccctggagatgggatggaccattctggaattgcaggtctctctcgccttcgaataggcaggggtcctagggggacacgaatgaactgccccagagaggcggtctccagtgtggactgcctggtgtctgtgcatgggagatgggccaggggcaaggggcaggtggggaactgggcttgggcctccccataccccagactcctatgtgacccagctgagtcatggtgctgttcccggggccttggggttggctggcctttatttaggacaataaaacccaccattgtaatcttcccaggcagctgggatgataaacagagaagtgagcacttggaaggagggaaaagtgctttattcagcactttgtcaatatcagcaatatcagcccgcagcaaggccttctgcggatggcggcaccatcctgttctgggcagggcaggaggcctcttgcccgcctgccagctgatctgcattctgggcttccttccgagttacattcgttgggttttggggtcgcagtggccctgccacacattcagaacagcatcctgggacaaagtaccgcaggggacagcaccaggctgcacggaggctcatggcccacagctccctagctttctgttcttgggcaggctccttatcccttttgccttagtttccccatctgtcaagtaggactgaaactacccctgaggtctctgggaggttgcaggggatgtgtgcccagcatcaggagcacccctgcaggcctcgcagctatagatggtggaagtccagtgctggaggctgagttgggtctcctgtgaggcagtcccccgtggcccagtcctggtctttctcagcccaaggtaatttttcaattaactcaattggctggaaaccggggcgccctggagtgtgggaaaacgtcccaggccggaagggccctcccc

SEQ ID NO: 51712 - DNA, 1464 bp, Homo sapiens
ttttatttcttcctggagcagctgctcaggcaggctggagagtaatcgggagtgagttatatggatttgtgagctgccccgcagcactttcaagctccacggcctcgagagcctcccaccaaagggcaagtgtccgctccggcccggaagacttgggcagcctgagcccaagacttgctctcctttcctgtcgcctccatggagtcaggcatgccctgtgatggcatcagcagctgtctgccagtgttgacggagggctcatgggtgccaggccgcttgctggggctttttatctgtcctcaggcattggcacagcagccctgggagatgaatactattgtgatcttcattctccacacaaggacagggaagtgacgtgccagggtcaaacaactacccaaggacagagccaggatttgaaccaggccatccagttccagaaccactgctcttcactgtcattgtggccattttacaggtgaggaagtggagggacgtagaggtgatgtgattgccggaaacgcccactaggtgtgtaccttcagaagctgcatgggagacagtgagtccccaggtttgccatttgctcagaccccagtctggacttcttttaaattctctctctcttttttttttttaattctctctttttttttttttgagatggagtctcgctctgttgcccaggctggagtgcagtggcacaatctcagctcactacaacctctgcctcccgggttcacgccattctcctgcctcagcctcccgagtcactggggctacaggcgcctgccaccacgcttggctaattttttgtatttatagtagagacagggtttcaccgtgttagccaggatggtctcaatctggtttaaattctttagaaagcacgcgtctgttcactatggagatctgaagatgtgtgaactgcaggctcaccacccttgtgtgatggcgacgtctaggagagccttcagctgagcccccgttcacctacttctcctcttagcagaattatttacatctgcagggactgtcagcatgccttactcattttgctgcatttaacccgagttgaaatctgatactggcttagcatgtagtgtgtttccagtttgttctccagctcatggtatagccagtggccgcgcggttgaggttgtggattccagactttcctctaggctttggtttgattgtctataatatggaaatagaaatgcctgttctttcccctagtcttctcagaaagttagctctcccgcccggagctagacacgggagaacctgctctgtgaggtgtggggcaagcagcttccatctttccgtgggttctgggaatgggtggagaaggaaactgagacactgggtgttatgctgctgagtcacactcagggtgggaaagaaagcagggctgggctctcccggccgttgtaaggccgtgctcaagttgcttcctcccga

SEQ ID NO: 51713 - DNA, 1039 bp, Homo sapiens
ctttgaggcagaacttgaaaggtttgtgacatccagtgtttcagtccagaaggactggtcactgggaacaaagagaagctagaattgaagtctaaagagtgataagtgctcactgcttggaagaactaagttcccttgtccatttttgctcatccagtttttgaagaaagaataaggtagccttcaagtttgtagggaagctaagtgcccagaaaactgtctctgacaaaaacagtgtatcaggattctttttcaagtacaagggataaaaaagatgcaactcaaactggcttaaatgaaaaagggaataattggcttatgtaactgaaaagttcagggataggatctggcttcaggtgtggtgtgatccaggactcaactattcggatattatctgaatcctgtcctggtctcattggctcctcccctcccaatggcaagacagctgccagcaactccaggctccatcctcacagcctgagcccattggtaaagagagcacctggatcctggtgcagagatttacctctgattggactgacttgggtcatgtgccttctcctgaaccagtcacagtggtcagggtgattcagtaatctcattagccagactgggtcatattttcatccctgaaccacaggtgttgacagtgggggctcctgaaagggaaatggaggtgccatgttgaaaagaagggtcatagatgtcagccagacagaaacgtctgctgcccagtccagcgggggctaatagagaaatttggaaagaaaaggctggatgaggtggcctctcagagaaagcagtagcatggaggctcagcttgatggctgtgctaggagtcttccttgtaccaataggatggcccagtaagctcccatcccaagtcagcccacctgacttgtgatgaactggcaacaacttgctgcttctaatccctcagtggaaaatgtgctcattaggccagtcatggtggctcatgcctgtaatcccagcactttgggaggctgaggcgagcagatcacttgaggtcatgagtttg

SEQ ID NO: 51714 - DNA, 1658 bp, Homo sapiens
tgcactgcgtgcctcccaagaacacggcacagagcatggtgtcgggtgttgggtgtgagcagaacagagtccctgccctcatggaatggacaggctgactccatggccacacccttctccaggggctgtgtggggagtgtccccagtggagggccagaaccaccatgcgctgagtggctgactcactcataccctgctgaggggcatgcccccctctgctggcatccaccaagccaagcctggttgccacctgggccctgctggttcaggaagcccttgtgtcacccacagaccttgctcctctccttttggaaggtggtagtgtgggagttgaggctggaggtgctggaaccagaccatctgtgtccaaaccctggctctgctcttcaccctgtgtgaccttggccaagccatttaactcctctgtgattcaacttccccatctataaactgtggatgataaaataggatctgcttcatggagctactgtgagaattaaactagttaagtaggtaaaatacagcaaagcttagaacatatagtatgtgctcaataagtgttaagaaagatgtaattgttattataataaataataatcataatattattgttacttagacctttggcttggggaggctggatttacaaacctacgattcaccaagagtcttagcagtctgagaggtcgccttctgttaaaaggtggctgctgtagctctagccattgagtccacttcccagaagtggagaaagtggagaaaggtggagaaagaggtaaagccttatttttgtaagagtcattcctcctaaaggacttttttctgcacctcactgcccagaagtgtgtcacatggacaaccctagctgcaagggaagctgaaaatagcatttttagaaagtgggactcattgcttttgcaaactaaaggagatgggctgcagaagggcaagggtctgccccagctccctttgccacctggtatggacctttcctctgagtgggtacaccacaccccctttcccttggggaggaggcccctggggacctgctgcatggcctgccagctggtatcattatcccccctgagggcagcaccattggtaacagttggctccctggggcaggagggccaccgtttcccagacaatgtttacttcctgctaccatggccaagagaactctgctaagtctatgggttttgggcccctctacttagaggcctgagggcactgtggttccccagcgtcagcagaaaggtacccaatcagtctttgggcaaaggccaggagagttttttgtccttgggcaaaggccaagaaagttttctccagtaaggatgactccttcctcagtagctgtcttgcctttggcaaatggctttctcctgtcattgggtcatcagcctgagctgtaccagatgcttaacaaataccatcttcatctcacaccctctagcccagtgccaacaggagagcttcgtgcagtcatggcagcggtctggatctgcactgtccggtaccctagctcctagccacgtgggtgcacgtgaaatgtggctagagaaactgagtttttcattttaattaatttatacgtaagatagtcacctgtggccaggcccagtggctcacacctgtaatcccagcactttgggaga

SEQ ID NO: 51715 - DNA, 1050 bp, Homo sapiens
ggagtacactggtgcaatctcagctcactgcaacctctgcctcccgggctcaaatgagcctccagagaagctggaactacaggcacacaccaccatgcccggctaatttttgtatttttttgtagagacggaggcttgccatgttgctcaggctggtctggaactcctgggctcaagcagtctgcccgggtcggctttccaaagtgctgagattacaagcatgagccaccaagcccagctcatcaatggtatcatcttatgtataaactgcatgagccctgcccagcacatgtggtaagcgtgtagcctgggggacccctttggggtgtctgttgatttcctcaggcctcctcaatttcatgatttctccgcgaatcaaggcagcacagaaacaatgatagtgaaaatttgcttcattcctttttaaatctcttaacagcatgtcaggtgttttgagcgtgttcccacaacaataaatactctttgaaaacataatttttaatgactacataatgttctgccaaatggagataccataatttatttagccgtttccctattattagacacttaagttgtttccactttttttctctctctgtcttttgtttgtttgtttgccattatataacactgtcttaaagatctgtgtatgtaaatctgtttattttcataagacagcatttcttaagctctttggcctgaggaccactttatatctttacaaaactgaagaccccaaagggcttttgctcatatggtttagatctattagtattaatgttttcaaaattaaaactagaaaaaatatgtaaatctttagtaatttattttaaaatcatcataataaatgcattatatgttaacataagtacagttatctttttctttcctttccttttctttttttttttttttttgagatagtttcactgtgtcacccaggcttgagtgcaggggcgtgacctcggctcactgcaacctccgcctcctgggttcaagtgattctcgtgcctcagcctcccaagtagctgggattacaggcacgcg

SEQ ID NO: 51716 - DNA, 1076 bp, Homo sapiens
gaaacgcctgcagggcacagcagccagcacggggcgggtggagttagctagcactgactgagcatggagcagaagaaaggatccggagtttcctctccttactggaaggactaaggcctgtgggagccttttccctgccacagagtgagtcacctgccttacactgaaagaaacacaactttattatttaatttgctcattcaccaaatgttccctgaaagcttccctaccccaaagcttgtgccgatgcctgtggttcagagcattccaggccctgctcagagtctagggacatgcctgaaacctacgacacactcagtgtaccttacttgaatcctatttttccaagtggccaaccaggcctgtagatgagagtctatcccataggcattcctgcttcaaggagttctaggctgcagagactgtcttaagtccagcggggtcggtggggctggaagactaaagctcccagcaggtgcagccatgccctggctgcctttgcagatgtcaccaggcctgcagacagtggggtagtaggtggcctgagaggctgttgaatagaacgatgtgtcatctgtgctggggcggccatgcccacttgctttcttagacacacatccttgtcaccacagcactgtgtgggtttgaaaagctacttgatgtttcctgtgtcccttcccacatccgcactccattcttagtctcattccctccatcaaagacgtgttcatcttctatgcagttcatcacctggggttgaatgtgtatgttcctctttagtaaattcatacgcttgaagctactgctgtttctttagcctggtggctctcggggctgctgcagggggcccaccctgagccagcccctcggtcccacagccctgacgtagaagactctttgctggtaaatctcggaactcactggaagcttccacaaagtttaactctacagacagaatgtcttccttacatactaccggctgcttttaaatattgttaacagatcccccttaaaggcttcttagactccacattttgatccagttgataataattgatggtcaggtggaagaattg

SEQ ID NO: 51717 - DNA, 1416 bp, Homo sapiens
tttgccaggcactctcttcattcctttgcctgcgtgagtcatcagtcctcccaacaacccatgttcgatgggtagtgttagcctcagtttccccatctataaaatggggatgagagaggttaagaaattcttctggccggatgcaatggctcatgcttttgtaataccatcactttgagaggccaaggcgggcgaatcatgaggtcaggagtttgagaccagcctgaccaacatggtgaaacactgtccttactaaaaatacgaaaattagccaggcatggtggcgcgtgcctgtaatcccagctactcaggaggctgaggcaggagaattgcttgaatccgggaggcagaggttgcggtgggctgagattgcgccgcggcacgccagcctgggcgacagagcgagactgtctcaaacaaaaaaagaaaagaaaaagaaaatcttctacggccttctagctagtaggttttggagccaaagcttgatccctaatgagtctgttttccaaactgattttcttcatagatatttggcaggtacttctttgattctgaggttctcaggggtgatcacagcagaaaagaggaaaagagtgaaatagggaagagaggagaaagaggagaggatctggaagtgggtgtctttcagaggcccccttccctggaggcaccaggagttgtttttttttttttctttttcttttttttttttttttttgagacggactctcgctctgttgcccaggctggaatgcagtggcgcgatctctgctcactgcaagctccgcctcccgggttcacaccattcggcaccaggagttttaatgcattctccgtcttcgctctgaaaatggtccccgggaagaaaggctgcaaggttgctctcttggccacaccagacagaagtttttcttcccacctcctcccagtctcgtcctccttcccctgcagggcattgagcatgctccagcccccggaaatgccagtggtctcggctgcagcagaggctgtctttacggtaggggcagaggctgcacacgctgatcctcagcttttaattaatccacccctccctggccccttcccaggaaaggtcagagatggattctgcagaatgaggacaggactcggtgtgcgtcaagccaggctctccaaatgcctttcagaagaccttgcccaagaccccattaaattttgcttggagcatggcctccatcactgtgcaggtcttcatgcctacctggccatgacagggtcaggacatgaccttgaaagtgtggcaagaaaacgaaagccacgctggcctccatcccaggagaagacctttggtgtgagcaggggagggtcatcttcagagttggcctcagaggcagtgcagggcactcttgctctgcggtgcctgagcttggctcagtt

SEQ ID NO: 51718 - DNA, 1041 bp, Homo sapiens
tataggatatgattccatttaaggagactagaaaatgcatgctaatctacagggacagaaagctcctgtaggaacgtgggcttattgcagagggtaggcagaaactgggtgatgggtattttcactgtcttgattgtggtgatagttttgcaggtgtgtacatatatcagagaatgtcaaatggcacatgttaaatatgtacagttcattgtattttatttaaaaccaataaagctgtttttagaaggaagtaaggtggatttggagtcctgcggatagagcattgtagggcaaggagcattttagaaccctgtaagtcacatcagtggggtggcctctggctttgccttctttccctgtgtgctggcctcagcaggtcacagaggggacccggccccagatgggcagagtcctcgaagacaggcagactgtgccagccagctcctgggtgagggaaagagcagagagtctgcagagctccaatacccagggctcctgggctcgcattccaggaacaggcagagaccagcaaggtccaaagctggatgtgctgtggcttgagctcccgcccaactttttaaataggtctgaccacctggcccagctagaggctgagacataagctcctgatagccaggcaggctggacaggccttcatgcctggagcctgatgttggagcagaaggagaggcatttttcttggcacccagctaaaaattcagaccagcttagagaggaacgttctaatttcagcttagggcctggtgctatggctgggaaaagaccaaggttaaaattcaatgtctccatgaatataatatttttaaaaataatctttagatttaaggtatatataattaataaagtttttatatatttatggaatattggtatagtccaggcatgcatggaatataaattccacagatttcctcccagcagccctgtgagttgtttttcccattttgcacatgaaaagattgaggcccagagacctgacctactgggaggtggaaattaaagcaaagaaggtggccgggc

SEQ ID NO: 51719 - DNA, 2588 bp, Homo sapiens
ggcgcagtctcggcgcactgcaacctccacctcctggattcaagcaattctcctgtctcagcctcctgagtagctaggactacagttgcaagccaccacacctggctaatttttgtatttttagtagagatggggtttcaccatattggtctggctggtctcaaactcctgacctcaggtgatctgcccacctccacctcccaaagtgctgggattacaggcatgagccactgtgcctggccataagtacctatttattaaagaccagctgtttactgtaaatattttactaagcttagagtggccgtatcatttgttgtttaaactgggagagttttgcaagagaagagggctctattaaaagttgtgttgggagagtgggagtcaacagggatttcccgagacagacaggatctgtagccttgcccagtgctcaggatctgagtaggcaggcaggtgtgtcaggcaggcatcccaggtcaggggatggcataggcaaaagtgtgcaggctggacgttcgtgctacgcgcaggtgaccatgaggcagccttggggcccacctgcccccctggacaggaataggaacatctgtccatctgcaccccgactccttgacccagaaacacatcctcgactctgctccaggctcatctgcatagtccaagaccgtctgcctgttcagcatcgtgatttgcgaggacacaacaggccccattctgttttttatggacctgaaaaagacatgatctttaccatgacagagaggcagggggtgtctcggaaaccattccgatgccatgatagacggcaggaagccgaggcagagaaggaagtggttaaatcgtggagcacatcctcagttgacaccaaaggaacaatgctttcagatcgaggcctcaggaggaaaaatgagggaggcaggagggggaggtggggtggctggaggaggctggtggctcctagactgcgtgtcttcagtgtgagcccctgcaagagcatgtgacgccctgacaaggcggcgtaaccaggcaaccgtcattactcatccccatggccactgggtcttccagtggagcaccgtgctcctgggggtcagggctccccagagggacagggcagcctcctctgcagaacagcggggcctgagagatgccaggaaaacgtgcttgctccaagaagggaggggagagtagttaggagctggaggcccagccttgccgggaaagtggtgtgccacagcatagctgggagctggggcctagctcccaaccctgaatgcttagtggggtttctcgctttttgctgtctctgttcctaaaacggatttttaaatttcaagtgcgtgcttgacccagtagcacagttctgtgcattaaagaccttagcccatgaagcatagaccagtcttgtgtgttttgtaaatccatgttttttaggtattaacagaactcccactagcttatatggagtttttatgcaaattggaaaaaggtacccactctgtgtagacagataaggaaaaggtgctcttctatcattgaacacagtcctatgcaaccccatagcctggtgatcaggcagtggtatctgcatgcaaccccatctctggggggttatagccctgtggcaggtttgctgcggaagcagagagatgcctcctcctccaggttgccggagccctgcgctaagctgcacaatatgacaaacacaatactggctgcatttcagcttccacctaactcacctatcaggcacttttgggcagtacacaagctgtgcgactgtccatggcagccctgggtataagtcacggccatccttgctggttgtggttggcataaggagcaataccctctggatttcatcttaaaagaatttaaggaagagaaaggggatgcagtgccttttcaacataccctgagtttgttcaaactaaagacatgaccatgccccaggtatagcgtgccatccagggcacctttctcacttggagaaagtgagaggtgaagcacctgttaggagggacttaccctggcctgtcagctgtgatctaaatgaggctgtcccctgcatggagttaacgtttgcctggagagcctgtgtgccaggctgtctgcatacgtggtcccatttgatcctcacagcagaccggtgagatgggtcctgttatcatgccgactttacagttgaggtcactgaggctcagggctggaaggaacttgcagcagacacacggctggcaagtggaggagccgggtcagcactccggccgttccagcccgcgatccacacgcctgaccactgtaccttaaagaccaaacccctgtctgttgacacctgaagtttctctgagcctttaaaacgtggcctttgggtggatgtgggcgggcttgggcatgggacagggcatgggacagtggttccccacatgttccctctgaactggggccgctgttctcagcacctgagattttttttttttttttttttttttttttttgagatggagtgacactctgtcacccagtctggagtgcagtggtgcaatctcagctcactgcaacctctgcctcccaggttcaggcaa

SEQ ID NO: 51720 - DNA, 1021 bp, Homo sapiens
ttaatattaaggcagcaaatcccagaaagtgctgacctgctgcttttcttggttggtgctttccaagcagttccgcagtcctgcttggtgccagcctgagccagggctgtgaaaggagtgtgtgggccactgagtacggctggtatgggtctctagcatgacgcccccaaccctccttgatgaggctcaaaagaaccaaaagggaataacctgtcaccttaatttgaggtcacttcaagaaagtgaggctcaattccaaatctaagtcaaagggtcagttgtttgttggggtggagggactctgttggagctctgactggctgccttccctgaggttgacatgggggccattggacaccaatcactgtgcctgccctcacccacataatcagtaggttcccaataagcagtgaatggtcactgctatttttctctatccaatttaatcaaattcacggtagcaggcactctgccaggtgtcaggaacacagatagtcattccagaaatatcaattgacctccgatgcatgccaggccagggctgggcactgagggtatcgagtcctggtgggcagagcaaactgggcagtctcctccagcccaggcagcgtagaggagaagcaaggaataaataggtgaatagacagtaaaaagatgagatggtaatacatactatgaaggattcaaatgggaaggcgcagaagagagtgtagggctgctttgcacacgattgccaaagaagttctctctgggccgggcacggtggctcacgcttgtaatcccagcactttgggaggccaaggtgggcagatcatgaggtcaggagttcgagaccagcctggccaacatggtgaaaccccgtctctactaaagatactaaaaattagccgagcatggtggcgagcacctgtaatcccagctactcaggaggctgaggcaggagaatcgcttgaacccaggaggtggaggtggcagtgagccgagattgtgccactgcactccagcctaggtgacagggcaa

SEQ ID NO: 51721 - DNA, 1085 bp, Homo sapiens
aaggaggcccccggagctcaggggaggaacctgccaggcagggagaaggctgaggacaggaatgagcttcgcgtatgttggggacccagaagccattgtagctggaaagtgaaggatggagagggagcaggagatgaggggaggggcactttcatgcggggctctgcggtcctgggtaaggagtttggattttgtgatccacgtggaaggatgcggggaagccacttgatcggatttcattttgaagcagtcctctagctgctgcattgagaatagatcaggggtgtagggatacggggcccaggccgttggactcttctagcaggacatatgatagacactcaggccaggctgcagaagccacaggacatgctggcaggttagatggaaacagaagagaggagaaaatagcaggagttgggcttgagcaccaggtgcaagtgaggccagctctggcctgagggtactagggagccatggtgggctttagacagggagtgatgggatcaaactggggctttggaagctggcctggggtgcagggtggaagcagggaaaccagtagtgagcaggaagtcctgagccaagaaaggaggaatataaagacaggagtgaggctctcccttgagaggaagaaggagctgcaggcagggcctgcttcctgctcccatttggtctcatgcccctaccccagccctgtctgcaccatcagccccatctcttcctcctcccggggcttcctccgtcacagaacgcgcccctcccctgcgggcagctggccgcattctcaggcagacacggagcccccaggggcatctctgttttctctccccaccctgctggctcagcctgagcaggactaggactcacttaaggaatgagggccgcctggcagctccacccggcccagccctgctggagggaatcgtgatgaagaacagggcagctgcactgagggtgatggcgtgctgccctcagaattgcttttctcggctctaattttcctgatgcgagaaaagccagtaaccccggggtacatccaatagtcaggacatggtgctgattggacttgaaaagtccgtcca

SEQ ID NO: 51722 - DNA, 1049 bp, Homo sapiens
gtggattctcagtaaatccatgcggaaagcctgtgtggggaagtggacagccccctgagggtggaggagcaggggctgggctgggagttggcagcagggttcagagcctcatggctgatcaggacctgggcacctggggtccactggggcctcacagagcaacagcatcaggtgggcatgatcagatcccacctcagctccgctacttagttgctgtgtggctttgggcaagttgcttaacctctctcagctccagcttccatctgtgaaatggatgtagaactttccaactcatgtatgtgaggaacttgggacagaccacccagacaggctaagcactcaacgagtcactgtcgttattgagcctggttttaatcgtgtttggttttgtcatgaggcaggcaggaagtcgaactgtgggtctgtgcccaggagcagggcaggcctcggacactctccagtggatgggaactgccccagaagctcctcagctggcacagacggcgggggggaggggcagcgcggggggtgctcccctgctgttacttcactgattccctgatggttttcatggttttgtggctaaaagatgctccaaagattagcctgtgtgaaggtttgggaatccgctgcaatatgggagcctgggccttctctgcgtcttctgtctgcatcaactcaaatataggtaaggatgttgctctcagaagacagccagagaaagcccacctgaggcagagaggagaggctgtgtgtatgtggcggggggactttgggggttagaccttgagggttcctctgggtgcagcactgttgcagcccaaacactctacctgaattaactcattcaccctcataataccctatgatggaggtgcttttattgactccacttcatttattttttatttttttattttttgagatggaatctcactctgctgcccaggctggagtgcagtggtgccatctcagctcacggcaacctctgcctcccgtgttcaagccattctcctgcctcaacctcccgagtagctgggattacaggc

SEQ ID NO: 51723 - DNA, 1054 bp, Homo sapiens
ttgaggcctgctgaggctcctggaggccttgtttgtcttgaactcgtggcctgcggaagtgggtagctgctccccctggaagctcagcccgaagcttatctccatgagcccagcgcttgggccacacctcacccatccagacggcaccacctcggagtccaggcctcggctgtaagtctgaagcccaggctgccagagtcgtggaggaaagagttttcccaagtggatgagtggccagaagtggcaggtgttacagtggatcctgctggactctgcaggtctcaggcgagcctgagagtagtcggccttgctgctcactggcaggctgaccaaggcaagtcatttaacccctctgagccttactttctcattcatcagatgggaacactggtactcagtaggttgtgtgaggtgagtgagacagctatgatgaggaccgggaatgccctgccgggtttccagagcacttcactgtttgcagagctcttcgcagaggtcatttcatgtgaccctttaaacccctctggaacaggcaggttcaaaggccagaggttatgtgacctgcacaggtgccacagggcttctagccctggtatctggctctaagtctaaggctctttctagcttgtcccgtctgccttccaagttcaaggtctgtgtaaggcactgttactatcctgagagtcagcccaggtttctcaatggtccctgtgggcccaggagccctgggcagaggcggcaaagtcataagaggagcggcaaggctgaggtcccattcccctgccagccacagtcctcaaggcctctcctgcatcctcatcacttagtgctgtttgtttgggctgtaagtagctcagttcctgttattcccccctggacaatcaggcaggaaattcttcactttggtttccttaagaggtcacatacttttctctcttgcagaagtaaataaagcccgtgtgctgagttggcagttttgcacacgagcccgcccgctggggtgagccagcagcccccttccctccagccttagctagccctacccagggggccc

SEQ ID NO: 51724 - DNA, 1079 bp, Homo sapiens
ggccattctcctgatcaagggtgtctggggagtttctagtttggagcttttacaaatagggccgctgtgaactttttcgtgcaggtgaacgcacagatgcaggcctttcagacatatacccaggtaggaactcttttcattccttttacagatggcaaaaacgctggcatgatgtgacttgccccaggtccccccacatcactctaaggagcggcagagctggatgtgaacccagattgtctggctccgggttctcactcgtgagctctgctctctgcagcctctctcctctcttgtaaacttttctgggaaaaggctgctgcctgcatctgccttcaacaaccctgctgtgtctctgttacgcagcaggggtgagaccagtccatatcactaggcacccagggcagcttcccgatggacagtcttgagtaggacaccaaaacccagagagggtgcctgagttcccaaggccacacagcatgcgggtttgcaccccagtgtcctgcctccctgtccaccggccattccctgctccatgctgcctcttcctcctttctcaagaccgagcccaggccattatcttgcctgcatacgacctcacacacccacacaagcctttaaaaatagtcctcgttgtgtggggcatggggcctgaggctgatattgcatttccagaaatctccatttccccctcccgcttcaacctagggaatgtccgtgttccgggcccattccctgccactatttttagtggtgattgggaggaaggaggacatttcctggactccccttcagaggctggaaaacaaacaccacccgctcccagtcccggcccctcccatttccctcctgctggtataccttggcctcctgtctccctcggggaggagcaggcagtgggggcctgcttcccggggccctccgccctcctggcttccaggtgacctctgagctcttccaggggcagtcctgagccggggtggtggcagggacagtgtgccctgcgtgcagttagcaccctgaagcctgcagagggcccctgtggctccctgcagtccctcttatgacggacactctgt

SEQ ID NO: 51725 - DNA, 1024 bp, Homo sapiens
ttcccaccacagagccagagctcctggccacatgtcatggggcctccccacttcttttttttttttttttttttttttttttgagacagagtctcgctctgtcgcccaggctggagtgcagtggtgcgatctcggctcactgcaagctccacctcccaggttctgccattctcctgcctcagcctcccgagtagctgggactacaggtgcccgccaccatgcctggctaatttttttgtgtttttagtagagacggggtttcaccatgttagccaggatggtctcaatctcctgacctcgtgaccccacttctttttccatctaggagttaggccccctctaggcatccctgggccaggaggagcctggctgtaacacccacggtgctctctccctctcccacccacaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggtgagaaccctccccacccaggtgggcctggcatctgctagcagtgccgtgctgggagccgggacgtctggcaccgactcacatcggagacctagggtggggtgggtggggcagagcagaacacaagcagggggcagggcccgccgcgggagggggctttctgcaatgcatcataagtttccctccaagaccatgcccccagagactgggccagccttttatccacctgccttgggcccagggagtgtggagacgctgggaaaccactcactcctccacacaccccagcctactattaggaaaaaaaggcctagtgcagtggctcatgcctgtaatcccagcagtttaggagaccagggcaggtggatcgtatttgagcccagcagcttgagaccagcctgggcaacatggcaaaaccctatctctaccaaaaaattagccagg

SEQ ID NO: 51726 - DNA, 1070 bp, Homo sapiens
ggcactcggcagggaagtctggcctgtggacagcatctgcacctactgcccatggaacaggctccaaacttctcgctgtcctgttgcacgtctgcaggccaccttgctctgttctctgtcccttctgcaagtagttgcccttatgtgatagatgcaagttgggaacaggcatccagcagcagccaatgcaccagaggtaagagctggtcactgtgaaggctgcaggctgggctggctgttggagctgcaggagatgagtcagacacagccctgacctacaagggcctggcaggctgatcagggagatgccagcaggccctgctattgcctgtcaagggtacagatgggggagtgtaggtgagtcattgggacgaaggggcataggccctggattcagactgctgggttcaactctggccctgctgcttactagaggcatgacccatgacctaggccagggtcctcagtttcctcatgtgtaaaaggggcattaggctcttagcacacaacgtacgttaaagacgtttgctgagacttcctttacctacttcatggagctgtcgtgaagatgaaatgtgtaaaactgcgggaatggggctgggatcatggtcagagctgggtaaatattagctgctattctcattatcatcgtcatcatcaccattgttgtcatcattgataggtgacacaggggactttgagaacccagacagtaagcaaattcagagtcttcccttcccattgagtgggatagcagccctcccttcactgtctgacccaaggtggtgtgacttttttggggtaagcgtgggcagctctggccttcaaagcctcaactcagaggtggaagagcttataataaaactgctcggggccagcatcctcgtcaggcagggaaactgagacccagagagggccaccacttgttcagagtctcacagcccagccatgcagccagctgtcctggctttgggtccagccccagggcagcaggagggcagaggtgcaatttgaaggcagacagggcttgggcagtttctgaatcacgtgggggcagcagactcctggtc

SEQ ID NO: 51727 - DNA, 1088 bp, Homo sapiens
ttttttggagagatggagtcttgctgtgttgcccaggctggtttcgaagtcctgggctcaagcagtcctccctcttccgcctcccgaagtgctgagactacaggcatgagccaccatgcccagccaaaagcaagcactttgataagaaccaacaagacagggtagggagagctgattactggggaaggcctcctgggacaggctgagacctggaggatgacagtgcccctgatgggcaacaggaatggcagagaccaaggcagggggacatggcctgtctcaggcagtcagaaggctgatgtggctctagccgaggctgctggggtaggcagggccgtggcacatcaggccacctcggaggccaggaggaagagagatgagatgctggctggtggcccatgctctggtgtgtagagtggagtcagcgcgacccaccgggaggcctcatggtcttccaggcgagagtcagtggtggcaatgcagtgggagagaagcaggcagatttggggcaatgttttggagctgctgctgccgattggatgtgggatatgggggaaagagagaaagtggtggtggcctttaggtttctcatttgggaaaccgatttggggcagtggttaggattgcaccaggtctaggaatgtccaggtggtgggagcatgtgagtagagtcacagagtactcacgtattaatgcatcacggtgctgcttagaaatgaatttataaacatcaagcactttcctgtattggacttggaaacgaggagacttgaatttggaatgagaagacttgaaaacttccatgtcttctcctcgttcacgctggtggaggagggttcattggatccagaggctatgggaggttcttcccagcagctgctctatgggaacgtgtggagctgtggagtagggggttggagaaccaggcaagtctcttcccttctctacacctcagtgttcccatctgtagaacgggggtgttgggtggaataaccgccaaggcagcacaggcgaggacgttctctccatccctcactcaccagctgtccctgctttccagcggtcagggtgagcccctgccactcccg

SEQ ID NO: 51728 - DNA, 1046 bp, Homo sapiens
tttccctttagagccagctctctatcctgacccaggagtcttggcatgaattgcctctggagaggcttgtgaatatggtctaagtttgtttcctttgtttatttcatcaaacactttttgattgcatactgggcaccagctcccaggaggcaaaggccctagctgcctagctcttgatgactagtggggcagacagatgggctctgcaacagtgtgggagtaaattgaaggtgggttgagcttctgaggacagttggaagccatgtcgaggctctaacatgaaatattggggtctgggtgtggggaccaccttgaatttttgttttatcacacagttggtaatgcagaggctcccctctgccatatcctgaagacagacatcatagggttagatcctcaaatgcacgagacggctttttccaaaactcagttaatgtcactttattaaccagcgaaatagataataaaaaagaaatgaggtgaacacattggacaaaaccattacttgccagtgacatgattctctacctggagaactcaagagaataacttgaaaagctattagaatgaataataagcatgtacataacagtgttgcttggaaatcagtgtgtaaaaatcaatcactttcctatagatgagtcgtaattatggaaccatttttttcaatccacaataatgaaaagtgcttataaaaatagctaagagtaaacttcagagaagctgcctcagtctgctcaggtgggcggcagagattgctggcccggggactttagatggcctcctcagagtaggaaggtcatttgcagcctggggccctgctcaggcctgggattctcttttttattgttttattttatttatttgtatgtgtgtgtgatggagtttcactcttgtcacccaggatggagtgcagtgacgcagtctcagctcactgcaaccaacaccttccaggctcaaacaattctcctgcctcagcctcccgagcagctggcattacagatgcctgccatcacacccggctaatttttgtatttttagtagag

SEQ ID NO: 51729 - DNA, 2095 bp, Homo sapiens
ccacccgcctgggcttcccaaagtgctgggattacaggtgtgagccaccgtgcctggcctgttctcagggtctttatcctctctttagcaacatcctcgtggcaatcttggaagggtcttactgttgtccctgagaggttctgtgactggtccctgtttgctcagtgaatgaggggctgaccttggcattccagccctggaggtggcttctcagccatcccagcccgtccctgaccccactggcttaaagctcagagaggccttccccaccccggatcccatccactgcagtctgcaccccagctaagcttggctttcttcttctcccccaccctcttccacgtggctcctgactcctcagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattgatgtacataccgcaaaccgtgtgtgaacctgtcaactctctgtcgtctttggagcgatacagttgtgttgttaatctggtttattatttttcttcagtgtttggtttttctttttctttttgtttggttcgtcggtttgtttttgtttttgtttttttccccctttctcctcccctcctcctttttatgaaacttgaaaacttgaaggactgctgtgtatttgtaaataacaaaactattgtgcactctgtgcttgtaaatgtccctcgtccaaaccgctactcctggagcccgtctggcagaggatgtggtctgtttttgatgtcccccctcccgcccccctggtgtgaacgtgtgggaccagaccctgtcctgggggtgcgcccaagtcactttaaccacaaaacgccatcgtcgtcagggtaagctctgctctctacaaagactcgcgagccgggccaaggggccttgtcttggctgggtttgtcagaggtcaaaccggctcttttaaacggcctaccagtttttaaattgcattgccgtttctttctttatgaaaaaaaagaaaaaaagaaaattgtttcatttaatttatttgcacaaatgctgaaaacttattctatctaaattattacataaatattggaatgtctatttttccatggggtgggcgggaggtgggtgtctctgttgacttgtctgttctgttaccatgctgctacccaactgtgcaaagtagtttagggtggccagaacccagggaccattggatttcaaagcttgctttttctgttggttcttctctctccttctctctctgtctctcccattctcctgcccatgcatgaaaggatcctccaccttcttcccacccagagctccctccaggcctttctctatatatttatttatctgacatacagaacacgactttagtgagcagagtgctgacagtcatggtccccttctttgggtctgtcttttgagagaggttgagttcagggcaagacagcctgccacacatccaagggtacgaccagtgggaccctggcctgagtctgttctccgaggggcctccagcagcttctgttcctccctgcagctgtgtctttcttgtcctgggtttaggatgcaggtgggccaggcaggtgttgttaggggaggcacccacttcaaaaggagggccacagtggggacacagagtccagcacctgagccctccaccctccccattctggttggttccatcagccacacttagaatctcccaggatcccttggactccgtcccccaacttgtcacagcagcctgagcctacccaccccaggagacaagagctggcaggaacatctgcctat

SEQ ID NO: 51730 - DNA, 1001 bp, Homo sapiens
cactcctcatgggtgtcccccggcttccctgctcacccctcctccctatcagtgaggggcagtatgagaccctccttaaccctggtagaacaggaaataggaaaatggggcccctggctccccttctggaagtctataagacaaggccaaggccatgaatgtcccccacgaaccacaggacaactgcattgagcaacgcctccccaggtcacagcgatttacagttcacgacactctttcacggggagatgggggtcagggttaagagattacatcctgggcaaactccctgggtttcaacctcagtcctgacgcttgttacctggtaaccttaggcaaaggacttcacctgctgtgccttcgtttcttcatggggacaataggggtgaaaagatactaggtcagagtgtggctgcagggatgaaacaggccaatatgtatacaaggcttagcacagggcgcaataaaccttagccaccatgatgatgaccgtgatgatgacaatggcaatggtgatctcatttcagcctctcgccggccctgtgaggtaggcaggacagggccctttgtacagatgagaagactgaggcccaggtaagttcagcaattagcccaagctgcaggggccagcccagaataggaccagagggagcaagagtttgggagctgagaggggtgtcagtggtctctagtccactcccctcatattgcagatgggagggtgcttgaccacagcccagcagggcatcagtgtctgaactggttctggaacccagggctcctgccttcctggccagtgctttgagctgcctccaaccataagactcaactagggggaaaaaaatccctgggtcagtaagttttggaaacactgcatcatatctccaccccttatagatcagcacaaccctttcacttattaaggctctgacaagttctgcaatgaaagaaaatcttctacctttacccatctagtgtttcccaaacttacgtgaccacag

SEQ ID NO: 51731 - DNA, 1012 bp, Homo sapiens
tagtcgttaaattgtggacacaagatgaaggaccttttgtcacaattcaatactgttggcttatttttttttttagtgaaacccaacataatttcagatattttactaaacaatgtgaaagtggggttggggcacagctgatttcctgaaacccacagccatccatcgcccccagctttgcctccaagagctgtacagatgcacacgtgcccggcctctgcatgggtgcgtggagaaggatggtcttcttgccctggccacctgtgtcaagatccccccctcacttctcatgggatccacctttcagggctgcccactggcagagaagcctgccgggaaaacatgtcagaaaagaggagtcagtgtgggacttgcccaaggaggccagcagctggagaaagatgggcttcggctgcacttgcaattgagactataagaaggacttcccaaatgtgggtgctgctgcagcagtggaacaggttagcaaggaagaaagaggaaagcttttgatgtatagatatatatgtaaaagcataaagtcattgtcattggataactatgtgtttgtcttccctggacctcttagcagcttcctcctaagtgcataaacttagagaatacttgtcaagtacctgcctaggaactgagtgcagagcagtggggaccctggccaaccccaggatctcaattccctggccctttggaaaattttcagagtgtggcaggagggactgaaggaggaggatgtcctccgaggttgggagaagggtggctggtcatgggaaaaagcacaagtctaggcctttgcaagacggtggcaccaaaatgagggggcgcccatgtgattttttaaaagtataaagcagttattgttggtaaaagcagcactctgctggacttttctatttactttatgatgtcgtaaatagggacacgttggggtgggaggtaccaccactgttttagcccagggcctcccaagggtgagcctggccctggggtcaggggtggt

SEQ ID NO: 51732 - DNA, 1093 bp, Homo sapiens
ctggggttcgggggattcttagccgagggaacgcagtggtggagagggcgcactgccctctcagggaccgggttggggacgcaggaagcgcggcctgggagcgccggcgtgcgggagggagggaccgcgggaggcggagggcggtgccggccaggagcggcctccagcccggagaagcaccgcccaccggccgaccctccctcccggccctcggcaccacccccgggcccgaggcgagggatcgcagctgagcgaggcgggcacccactccccagcgtatgccgctggagcgcgctgagcgtgtgccgggggctgggcctaagttctccccaacccttgccagccgagttggataagagggggtcgggagaaaatagagccctgatcccccctcctccctagggcccagagaatcggtgtgcatgcgtgtgtgcgcgcacgcgcgtgtgtgtgacgggtggtggtcggggaatgtctcaagctagaagtcccaggttttaggggtttaagtggagctgggagacccgctttcctcccacaccaggcgcagacgccgaggcacagctccgccagccgccccgcctttacctggcgggatactcacctctcctccttcctggggaggccaccgcctccctctcccccttctgccctgggctggttcccagcgaggtgagtgaccggcacaagtagggaaggaggaagcgagtttttaaaaactgagtcagctcacgccctcggccagggtccccacccgatgcgtggtccccagggcgccctcgggatcgcacgcccgagtcccggcccaggtggggcccattccgggttcttgcgcgcgggcaatggatgggggcgcgctgcaccgggagcctgccctgctgagggctcatccccagctttgccgagaactttcccggcgaggcaccggctggcgttttcccagcctgcgagtggcaggcgggcagccagtctctgctcggatccacggaggcccggagccgccacggagttctggctccggggagtgcaaacccgaagtcggcgcggaagcctctcacccgcggctctgcctccgccccttggagatctgccc

SEQ ID NO: 51733 - DNA, 1044 bp, Homo sapiens
accacccgtcacacacacgcgcgtgcgcgcacacacgcatgcacaccgattctctgggccctagggaggaggggggatcagggctctattttctcccgaccccctcttatccaactcggctggcaagggttggggagaacttaggcccagcccccggcacacgctcagcgcgctccagcggcatacgctggggagtgggtgcccgcctcgctcagctgcgatccctcgcctcgggcccgggggtggtgccgagggccgggagggagggtcggccggtgggcggtgcttctccgggctggaggccgctcctggccggcaccgccctccgcctcccgcggtccctccctcccgcacgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtgagtctcagccgccgcgccttgcgcccgctgcttcccgcggcgcgctgtcggttccccacagggccgtgtaagggggccgaggcccgtttgggtctcctgtccgtccgtctgtccgccgagcgcttcccgcctggggtcgaccaccgggaggactccgcaccccgcaccctctgcggccgcgccccgccggcgcgggacgctcccgcctcccgggcaccgcgcctggccagctggcctcggctggggaaggcagctggccttgggggccccctgttggcgggaacaggtgctatccgcccggcgggcttcgaacccttggcttcgccagaagcgctttcagcgcgtggttaggagcagaacttcccagtaggtcccaggaaaccaccttggcgctttgctcgcgcatcccttactgtatggaagtcggggccttttagggatttagattcgtgtgtgtgtatgtgtgt

SEQ ID NO: 51734 - DNA, 1031 bp, Homo sapiens
ctttagtgtggattctcttcccccagccccaaattaaggtgggagtcatgcaaaagagaagcattgtctccctcggtgctgggaaagtttcagaagctcaggtgtcttctgacttgggatgtggtatgggggctgctgacttttgctttcacttttgtttctgctctgaagctgggaggaatcctcctcttgcagcgaaagctgtgagaatatccttctccatgcttcaagtctccctttgcttggagggaaaaggaaggtcctagaatgtctcaggtggaggggaccttcaggtcatcagagacatcattctcatttgacaaacaaaactcagagaggggatgggacttacccaaggacacacaacagttcagcagcagaactgggactggaacccagccctcctgactcccttctagggccctttactttaacccaggagacctggccacattcgggaccaagactgttttgggccccaggtttctcaacctctcagtctttcaagcggcttcatagagttgagctcctccccagcctggacaggtggtgcagcctcccctgccaatgttttattctcccttcctctggattgagccctcgctgccatggccacccctcctgggagctcttgctcctgagaaagaaaacaggccgtttgtttggaagaaacaagccacctgtttggtttcccaataccaggccacacagccctgtccctcccagacagccccaagatgctgaccagagatagccctctgagggtctctgctgagctcccctgaccctcgactcctcccctcagctcccgtctcaagactgctggttggtcctcaccttctgtctgtggtgtttacttgggcggagcaacctaaagtctccacattctctcttgccctggatttatcagacttagcagcccttaaacctgaatgcgtagcttcagatcttagaatatcggggccagagggatcttagccatcagaaaatccactctgcttatttgacaactggggagaccaagacccagg

SEQ ID NO: 51735 - DNA, 2183 bp, Homo sapiens
ttgtttttaatctgtccagagatggtcctagccacgaccctttaaataaatttttgtttaattttggaataattttagatttatagaaaagttgcaaaggtaatatggggcatttttgtctacccttcacccaacttcccctaatgttggctttttttggggggggggaggggggaggggacaaagtctcactctgttacccaggctggagtacagtggcgtggtctcggctcacagcaacctccacctcctggggtcaagtgattctcctgcctcagcctcccgagtagctgggatttacaggcatgcaccaccatgcctggctaatttttgtatttttagtagagacagggtttcaccatgttggccaggctggtcttgaactcctgacctcaggtgatccgcccacctcggcctcccaaagtgctgggattacaggcgtgagccaccatgcccggcctaatgttggcatcttacataatcgtattatacttatcaaagctaagaaattgacatcacaactaactaaactacagactttattttgatttcgctggatttcccactgcatttttattcaccaggatccaattcaagatgccacattgcatttggtcatcttgtctccttagtatcttctgaactgtgacactttctcagtcttttcttaaatttcatgaccttgagaactttgaagagtactggttagtgttttgtagaacttccctgaatttcggtttgcctgatgtcttctcgtgactggactgggcctttgggttttgggaaagaatcctacaaaggtgaagtgtgcttctcactgaatcatgttaggatggagataatatcaatgtaacttcttattgatgacatcagccttggtcacttggttaaggtggtgtctgccacatttctccactgtaaagttactacagcccctttttggaagggtattctttaacatgagagcgaaaggcaacattataaaagagattattgaaacgatttttagattaggcacctaaaatttaaaaactttgatatatcaaatgataaactggggacaatatttgcaacacagaacagacaaagagttgtgttctgaatccatgcgggagctttgctttttttttttttttccttttttttttttttgagacggagtctcgctctgtcgccaggccagagtgcagtggcacaatctcggctcactgcaacctctgcctcccgagttcaagcaattcttctgcctcagcctcccgagtagctgggactacaggtgcgcgccaccacacccagctaatttttgtatttgtagtagagacgaggtttcaccatgttggccaggatggtctccacctcttgaccttgtgatccgcccacctcgacctcccaaagtgctgggattacaggcatgagccaccaagcccagcctgcttttctagttagtaaggaaaagctgaatgccctagttgagaaatgggctaaagaagaaatgctgaggccaggcacagtggctgacacctgcaatcccaacgttttgggaggctgaggtgggaggattacatgagcccaggaggtagaggctacagtgagccgtgactatgccactgcagtccagtctgggtgaccctgtctcaaaaaaaagaagaagaaatgctggtggccaattagtacatgggaaaaaaaagaatcagtattcagcctcattgtattaaaggaaatgccaattaaaacaatgccgtctttcacacaggaaatctaaaatgttttaaaagttttaaaattttaatttaaataatgctaactgggaggtagtgctttcaggagctcagcatagaagtgtaaactggagaacagtctgaaaacacaggcccaaacctttaaagcacttagctttaaaacacttttaattccaagattttaaccttgttattaatatcttcaataccaagattttatcccgaggtaacaatttatggttgtatacggagttaatttcaacagtattttttataatagcaataaaactaaaaatcaaatatatttgcagcaacagggaattggtgacataaattgcagctctttcatatactgaagtggtcctcaaccactaaaaattccagtattgatgaatactgatgatacgaaagattgttcattgtacatcaaatttttcaaaatta

SEQ ID NO: 51736 - DNA, 1040 bp, Homo sapiens
catttgagatttccccatactgcatttattccatggtatgaatgtgcaggacgacagtttacttatcccttcacctgttaaaaggatatttggattgtgtctactttttggtgattacgattaaagctgctataaacattcagaggttttagtatcaacatatgatttcatttctcttggggaaatacctaggagtggaattattgggtttgtatgtgagtgtatgtttatctttatatgaaatgactaaacttaggaggttagggccagttcctccagccagcaccagggctatgcagggacctaatgaaacattgataatatcctcccctcccatttggaacttcagtgacctatgttgaagacccggtgaaaccatctgtcttttctggagtgatgctttcactttgccagctgatgtgggtttcaccctgctggtaggaggttgaccacctccccattgatgactctccctttcccatatcacaggcatggaaatgacaatgagtagtgatcgttcttaacttaaataactttttcattaactctttttctttaattaggaaactaatatatgcacatggtataaaaaaatcaaatggtgtaaaaggatgtccaatgaaaaaatatacatctccctctcattccaggctcccagtcccttatacgagcgtagccaccatctgctatttcttgtatatacttctagaaattgtctctgcatataatgatgcttttagatgctgcttttagatgtttgcctggtcatcaaagcaataaagtattatagtggtcaggatcattatgaaattgttgggtaatttcaaacttgtaataactcctatgagggtcctcaatcacctttaaggacccactaaccacctgaaatggtctgtcaagcattctctgtcaagtattctatctctgcatttttctgtggcaggtcagtagctttcatcagattctcaaaggggtctgtgcaccaaaagaaagaaggggaatggggaagaaaagaaggaaggaaggactgtagaggcaat

SEQ ID NO: 51737 - DNA, 1032 bp, Homo sapiens
aactcagaatgtataagttccaattttatgtattattgccccttggttttatgattggaagctggtagaaccactgatttaacagcataggctgttttgtcttgggctaagaggaactgtgcctggctgagccaagagagacgaaggccatagagttcttcaaccttgcctgtgtgtttgtactgactcactgcatctgaggaagtctgttggtagcttagaacacgcgtactgtctctcccagggtgagccagtgactgggaacgtctcacagaaaggagcagacaaacttgcttcccacaagagggcttcaggctgaaaaatattcaagaagagtttaggggaattcctgggagtcagagccatatccggctcatgataaaagttacagatatttggggactacccttattagagtcaatatctggagttggagtggggagcaactaagctttcccatcactcttaagtcatttgatgctcaaaacagttctatgttagggaaaccgaggcaggagtatgctagctacatacagtgcaaactaccccacatctgaaggacttaaggcactccagttacattttcatatattgggtgggaaggtggggtcttggctccacacagtcattcagagacccaggcttctatctttagcacttcttctccaagagtttagtgagctaataacagggcccacagctagaaagtgagggagtcgggatttgaacccagccagtctcattctgaactatgatgctatggtgagaaacaatagtactggcatctaactagatctacctggcatgtaacttcagaactgggaagtgggagataacttgggattctgaggaacatttgttccttgttgccaaggaatcaagctcttctttttaaggagtgagatgggtaaatctgagagactttttttttttactttgtcttcagttgagaattttcagattcaacacataaaaatgagagccttttccctccaaaagtttgcccctgaaataaatgtgcgtgagactatg

SEQ ID NO: 51738 - DNA, 1048 bp, Homo sapiens
gttggtcacagactgaaggggggggcctgtccctgtggttaattggtgatgggcgtgcagtgtctctctgggaccttgtctatgcttctcttaagcatttgattgttttagatttgggggatttttaaatttgattgattgattgattgattaagattgcatgatttgcacccttgtatgaagcaactgtaagaacaccggtgttaaacctcagagaatgggttgcagaatatttcccaggttatcagtggtcaccaaccccatccccatccctaaagaggaagcgagataagcccagcgctgtagcataacaaccgcgcatagcatgcctaacgtcacgcgaagtcttctaacccatacgcgctgatgaatcctggcaactccgttagggagacacgacttatcaaacccttttcatggcccagctgaaatgacacactgacgttcacccagccaggaaggaagtaacacagctgggagtcgaacctagaaccagaacctttgaccctggctcaataatgcctgccttgcacaggcatttagcacttagctgagttgacccatcaggccacatgaggtccttgtggctggagacctgtgtggccaggctggagtcttgctaggtgagcaggggtggaagagggattccctggggcagagccaggagacagtcctggtggaggagtagagcggtcccttcggttgcccatggtggctcttccaagccttaactcccttcctggtcctcccaccccacctgtctctatatccttgagctcagccgattcctcagagtcctcttgggtccacaccccaggatgaggactctgaggctttagtgagcatcaggatcacttggctaattaaaagcagatgccgggccttacctcgcattctgattctgtaagtccttcatctggcccaagaatctgcatgtttagcagaccgcaaggtagtgcttccggggtcttcagataacggccgggtctcaaactgctgctccctttgcttcctgacccccatctgctgctcacctaccatctccttt

SEQ ID NO: 51739 - DNA, 2233 bp, Homo sapiens
agcgagactttgtctcagaaaaattaaagaaaaaagaaaaagcagctgtagcacagagaacccccaacatacaccatccagccctgaccccctcacccccatgcccccgcaggtccaggccatcaacgtgtccagccgcttcgaggaggagatcaaggcagagcaggaggaaaggaagaagcaggcggaggagatgaagcagcggaaagcggccttcaaggagctgcagtccacctttaagtagcgggggctgcagccgaccgccctgctccggccccagtgtggtgggcgagggtggcgcatgggaggccgagcctgaatccttgcctgtgtctgacgggaccactactaaaaacctaaaaatatctgtgaatggagcaagttcaggggtcttatggaggtggcccggcccctccccgctcccttccactctgcacgaggccgccacaccggcgctggctccctgcccggcccggccctccctggcaatccctgggctctcttgcacccctaactgccccctgcctgctccggcactgccccaggcccagctcctggccctaggtccctcccagccccatgtgcctgccgcctgccctccacacatccctgtccccccaacccgggaacccctgccctcctccagcaggccgcaccgcccctggggccccctgccagccccttcccaggctgggagacggcagaagagatagaatcagggctgcccccacagagtgggacccaaggggctaattggaggcacgaggggacccctccccagggccttttcctcctctgcgtcttccatctactgaaatgggagagggggtggggagcttctgttctggtgaagggacccgggcaggcccccagcaccccatgctgacttggagaaccccagatctctggggcccagccaggcagggtgtgggggcagctgtgccaatctacctcacaggcccaccccctgccgggcatgccgtgggatcatgggcagggaaggctctgggggtcggagacaccgctgcttagcacccccagccagaacaccctgagggtctcggggctctggagagagtggggcgggaggaagaattggcaccttcctagggaaggagacgagcgcttcgccttgattctccgagaagcctccgagaagtgctttaagtgtgtttgcatgcgccaggcggtgggcagcgggggcctgtccagccctctcccgccatccttccccaagtgacgtccactgccttgtcaccagcgacctgcctgtcatgcccaccccctgaggaagcatggggaccctaacaccctggtgccctgcaccagacaggccgtggtcaggcccaggccaccggccgggttctgccacagcttcccacgtgcttgctgacatgcgtgtgcctgtgtgtggtgtctgttgctgtgtcgtgaaactgtgaccatcactcagtccaaacaagtgagtggccctcgaggccacagttatgcaactttcagtgtgtgtcataacgacgtcactgctttttaaactcgataactctttattttagtaaaatgcccaggagtcctggaagctacgcggacttgcagaggttttattttttggccttagaatctgcagaaattaggaggcaccgagcccagcgcagcagcctcggacccggattgcgtttgccttagcggatatgtttatacagatgaatataaaatgtttttttctttgggctttttgcttcttttttcccccccttctcaccttcccttctccccgaccccaccccccaaaaaagctacttcttcattccgtggtacgattattttttttaactaaaggaagataaaattctatattcttatgtgtgtatggttcttgatggtgagtgggcagggaaatgacaaggtcacctgggtgtggggacagtggtgtcagagcctgggagggaaggggacctgccctagtggaggaggttggtgttttatgcccagatgctgtcaccaggcatgagtctaggtgctttgtgcctattaactcatttaaatccttgcaaccagcccatgcaagggatgatatttttattcctcttttgcagataagaacagggaggcggctgggcgtggtggctcacacctgtaatcccagcacttcggtcggccgaggcgggtggatcacctgaggtcaggagttcgagaccagcctggccaacatggtggaacctcgtctctaccaaaa

SEQ ID NO: 51740 - DNA, 1037 bp, Homo sapiens
acaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcg

SEQ ID NO: 51741 - DNA, 1049 bp, Homo sapiens
tgctctgtctcaatcagcctcgtgcccctggctttgaccttccaaatccttggctcccacaaaacctctgaacaggctgttggattcctactccaacttcttggttttgtaaccagggttcttggtcttctaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggtaagcagctcctcagcctccctctgggtgggtctggtggggagggagccgccacctgcttctttctccagcctgcccctcacagggcccatgaggtctctccaggcagtcagagggtaccacacatggtccctttttggcagcacctctgtctggctggagcaggccctgctctgtctgctttgtagaggtcagagtcttctgtttcatggcacagtggcatcatgggctcaagtaactttggcagcttcaattccaaagacttggcaaaaagaaagcagaagagagaggagaaacctctttttatttttcttgtcaccattctcctgacctccatcaactagaccccgtttccactatcccagagaaagggtggccacagctaaactgcatggagaaaccaaagaatttaaatattggaattttcaaaagtgtagttgtgggggttcgaggaacatttaaagattacttgggctgggtgcagtgtctcatgcccaacactttgggaggccgaggcaggaggattgcttgagccaggagttcgagaccagcctgggcaacacagcgagaccctgtctctatttttgttttgttttttaaatgtattacttggattctttgtagttttgctgtatgctctaattttaaacttaactcctattacagtgttatctgattttcttataaaaaaagagggaagagagacaaacatggggttcctagtttgtgggtcatgacaggaatatcagggagcgctagaaattctgt

SEQ ID NO: 51742 - DNA, 1129 bp, Homo sapiens
acaactatctcattttgtagttttgtacatggtaaatcttacagtttcatgagtttgtttaacatgtactcaatgaagtattcttaaaccatttattttatttattcttatcagaataaatgaaatcatgtatttgagaggtagtcgtcctgattatcctatttaggttttctctcatttatgtattatttctgcatcccattcattttcattcatttctaaagcttttctagtcaaagtgttctggagagttgctattcttattactcatcttttcatctgtaatagttctcatttgtgatattcaaaagcagtagcgagatttttattttaagatacagttcaacagcttgacacttttcctgcaaaataccttttgttggttttgtttttcatctatatatcttatacctttacctaaaaagcaagactgtccaggtttctgccactgaaactcattgcctcttcaatcatttcagctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggtaggtgaaacaaagaaatagaggtttaacataagctaaacagtcttagcagggatgaagtctaaattatgactagcttttatttgtctctgtttctatgttcaatatatatatctgtctaaaatattttacgcaggagagctaatgttcatgttctataattgttagcgataagatccaaagcctatgtttactctgaaactcccttttaggaatactttggcttaaagaattgccttagatactgttagcatatttaatgttaaagtaacaagttttaattttaaaaaaatgtatatatagtcaataatggatatgctacccttcccatgatacattattcataaagtaactttatgagtgtaattgctaaacaggaacactatacaaccctattctctaaattattaatttctacactttgaaaaaaagttaagagtaatagccttttgcctccaaaaaaaa

SEQ ID NO: 51743 - DNA, 1118 bp, Homo sapiens
ggcaacagagtgagaccctgtctcaaaaaaaacaaaaaaacaaaaaaaacagtggccttgaaatctttatccaggtaaaaagcaatcgtaataataacgaaaaatgttctaatttgaaagtcaggcacaagtgcagtttgaaacctgattgttactaaatgaatttagtctatcctaaaagctatttctcatgtctacctgtgttatcagaagaaacaacagcattctagcatcctgatatcattctagcattgggatgaaacgttgccatcctaggagaagacatgggttcttatggataaacgacttagccttcagccagctttagcagtgtttgggagcagtgtacagacatgcaccatttcccaccttcctctgtgaaatgctgcagtattatatggtgctttgaaaacatgccctgctggagtgctttgggaaaaaatagcctgtttcaaagtttcatttattatagtcatgtaaaacaactgattgcctctatcatttattttaagaaactttcctaacaaaatagccctccgtctgcctctgtagtgaactctgtggacaaggacattaaatgactgtgcattaaaagttacatcctttctcaccgcctgcctgtttgtgtttcaggcatcctgacaaaaacaaagatcctggagcagaagacaagttcattcaaatcagtaaggcttacgaggtatcgtgtccagctttgtgatgcatccattagctcttacaaaatatgccttaggaggtgatgagttttgtaaagttgtcagaaaggtcatgttccccatgcccttgatgcagtttctagattataatagagagaacaggctggatgcggtggctcatgcctgtaatcccagcactttgggaggccgaggtgggtggatcacgaggtcaggagttcgagaccagcctgaccaacatgctgaaaccctgtctttactaaaaatacaaaaaaaattcgccgggcgtggtggcacgtgcctgtaatcccagctactcaggaggcttaggcaggagaattgcttgaacccgggagtgggaggttgcagtgagcagagatcgaggcctgggtaacagagggagaccgtctcaaaaaataaaat

SEQ ID NO: 51744 - DNA, 1036 bp, Homo sapiens
tgttaagaattaggctaaaagcaactttaatattgtgctttataataagaaatatatgtatattttggtgtttgttcccagttcctggcacagatctcctaacacccttgagattgcctgatcaataggggtgctaagataatcttttgctctcgtatttgatctttgactctgattcctgagatggagcacctaatccttggaatttcctgcaggatgggagcatcttttgttctattgaggcgactcttagtgggcccctgtgtgggagctggtcaccagaaaaaacaaaccatgattagaagtttgaaagtttcaccctcatcctccagaaagaggagaggggctggagattgagttaataattgatcacgcctgtatgatgaagccttcataaaaatccctgaactctggctcggtttcctggggggtgggctcagtctacaccacctcccctcagccaagcctacagtagagggcccaggcatcctcccgtatgggagaggcgtttgagtaaggagcctcacctggggtgtcctagcctcacatttactggcaaaaaaaatgaacatatatatatatttaatccctgaactactgggtttgagagttcccaggtggctgaacacatggaggtgcctggagggtggtgagccctgggagggcaggatgctcccacccttccatataccttaccatgtacctctcttccttctggctgatcatctgtctcctttgtaatatcccttatacctaatgagtaaccataaggaatgttcccctgagttctgtgagcagctcgagcaagttagttgaacccaaggagggtcatgggaccctttgatttatagccagttggttggaagtacaggacacaacctgggacttctggcgtctgaagtgggagcagtcttacgggactgaacccttcacctgcaggacctgatgcttcctctgggtagatagtgtcagaactgagttgatacccaattggtgtctgctggaggatttatggggaacccccacccccacagcg

SEQ ID NO: 51745 - DNA, 1046 bp, Homo sapiens
atataacccacccaagttctcactacagcatggtgagcgcgattcccactgacttcagacctgccctgtgaatgattcccccactacactcccagcctacctacactccccactacctctcatgtcactgtgacatgagacggagaggaaggtgttatcagtggcatggtcactgccatcttacctaattacggtacaggtaatccccaaactcatgcctcctgaccagtacagatttcaagaagatcgttattttgctttagctatgaaaaagaagagagttgtttgtatttactttgttggtacagtttttgcacatggaacaccatagaatggaagtatacaaggatacggaagacctagtggagctgtgtaagctggcatgtacctctctgctcagtgatgtgaaaaagccctacttgatttgtcatttacatctttgctgtagttttattttcttcctctctattatgccctaacagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggtacgtgagggtcaccttggttaagattttcttcacattttatcccaagattttatgtaaataaacagcaaaattgaacaaagtggctgaaggaaaggatcttccttcagatgcacaaaattttttaatgaatttttttatctaacttggtaccgtttgctttaaaatttttaatttaaaacgtttaaaaattttagcacctttaaagggctcctgttggaaaaccaacaatctttttccaaaatgaatttaaaagttaaatgtaaaacagtaataaaaaggaataagaagaagccacaaactaactgagagaatgtacagatgaatatttatctgatcttaaggtaggaaagggttaaaaagcattggggaaaaatcttggaaaatcttgataacttgactcta

SEQ ID NO: 51746 - DNA, 2868 bp, Homo sapiens
gtgttcaggccccatccaacacaaagcgttttcctattattttaagtctcactggggtatttattttctcagcaattaaatgtgtcaggaaatgccctgagtcctcaattctcttcttcctacaggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttctttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttt

SEQ ID NO: 51747 - DNA, 1040 bp, Homo sapiens
tagctgggactacaggcgcccaccaccgcgcccgactcattttttgtatttttagtagagaaggggtttcaccatgttagccaggatggtctcgatctcctgacctcgtggtctgcccgcctcggccttccaaagtgctgtgagccaccgcacccggcccgatagtggctttttcaattgttttttcctctagctgttatattaccctggttatgatcaccggctggtagggaaaataagaaattaaaatgtaaattgattttgttgttagggcttgggaaaagacagaggttgaggttgtttccattcctgcactttttgtgatggctgaaacaagaaatttaagtcaaagggatacctgacaccccctttaattgacttaaatttcttgttacagccatcataaaagacgatttattgtgtggtcagccagacattgccctctgccagttggtaaagttaggaataccttagtaattgaacataggctaactccaaattatttcttgttcattatgtcaatgtttcggcatttacttccttcccaagccaaattagcatatagaaacttgggctccaactggtgttaagcctgtattagatagccataaacagctcctgtttttccagtctgttctgttggctccattgtaacctgacaacacagtatctattttaaggtgtctggtggtcggttgtctttcacttgcttgcttgcccatcaggcaggaacaggatccaccctagacacttgagtcatttcctttcatcaaatcataatagtaaacatcactatagtttttacccataaatatatcatgtttacttacttgagtgtccccccccattacctcccagggttctctcatattactcatcttcccttcctttcctagactgtttaactcctcctcttgtttacattctccattcccattccttcacctctcatttctgattccatttcttcaaggaaatatatatatttttatgttctggctattttttcctgccactatgtgtccacaccactggtgtcc

SEQ ID NO: 51748 - DNA, 1027 bp, Homo sapiens
tgtgttacttctcagtgctttatactgttgtatatcttttcttgttgtagatcgtctatgcggaaagacctctcacagacaaccacagatcattggcttcttatggcttgaaagatggggacgttgtgattttacgacagaaggagaatgcagaccctcgacctccagtgcagttcccaagtaagacatctggtggttgagcatcccccagcagaaccatcagcaggtagcagagcatagcacctcagagttttggattcgctttggattcagactacagaatacagatcctgactctgccttttccctgccgtgtaaccttgaacaagtattttaatgtctctaaattggtttcctcttctataagttaggtgccataattaaccccaactcctaaagctgacgtgaggctaatgcatgtaaaatcttagcacacagcaagccctcaataaatgttagcttctgttatcagtgataattatacaataatctttatccttgggaaggacttgaaagaatacataagcctatgattttgctactttgtgtctgtccttcagtggccagcctttctggagcattttatagccagccaggcacttggagctgcatttcacatgatctcataacttggttgtggggggatttacatactaatttgcataataatttataattatgaagctcagattttaaatggtgtctttaaagttacatagctattaagtgagggcacaggaattaaaatttgatgctttttccattatgctgaacttgataaacattaagcagcttgaccaccaagttgtggttctttcctaccagctgtgttaatcacatacaaagaaacgtttatctatctttgatgctgcttttataatagatgtttatagtctgaactctgtgcattgggatttagtaggttctatgtcactgaaataatatgcagaattgtgtggatgtgaatgtgtgtgtgcactggatagagagagggtcatagctttgttcagatacttgaagtggctca

SEQ ID NO: 51749 - DNA, 1035 bp, Homo sapiens
gtgtggtgcgatcacagctcactgcatcctcgacctcctgggctcaggccatccccccacccttgaacccccatccaacagtagctgggactacaggcatgcaccaccacgcccaactaatttttatattttttgtagagacaaggtcttgctatgttgcccaggctggtctcgaactcctaggctcaaacggtcctcccacctcagcctcccaaagtgtcgagattataggcatgagctaccacacccagccacaaatactttctttacactgaatttaaatgatgaaatagccttgactcagagaacagaaagtaaatgtaattgctcattttaaataagctttaggcatcctctctgcatctcttacagatgtagtttgataaattgtttggtgtggaaaagtactgataaacgttgaaaatatagtgatatttaagatttttctcccttatttttgtagagaaattttctagagtcctggtggagcagcagcaggaccgagcccggagagagcaagaaaggattcgtctgttttctgctgatccctttgaccttgaagctcaggcaaagatagaagaagatataaggtaaagacctgttcatctaaagaacaaaacttagagactccagatttcccagactgcaggttatctgacattggttgggcatctgcttggaggtagcttctctgttttgcagttgagatagtaacctcagtcttttaggttagtctctcctctttcattttctatgcatttcgatttgacatgacaaagatataggtgcttagtttaatgactttctttctaaaattttaaggaggactccctgactagcagacagagcatcataacacagctttagataaatgacccccggactgagcagaagccaccatctggtgagaccacaaggctggttgcatattacatgggctgatttgactctctttctttagacatattgtataagtcctgattaaatccagggcttaaacatgattggattagagagggctctgcgccgatggaa

SEQ ID NO: 51750 - DNA, 1063 bp, Homo sapiens
acaaaaaaaaaaacattagctggacatgatggcgcaagcctgtcaatcccaggtactcaggaggctgacgcaggagaatcgtttgaagccaggaggcgacggcttagagatactcggtaagaagtgcaaagtactgctaatttagcattgccatctgtagacgcaggacatcactgctttctactggtaaagtcttaaaatgtcatttaattattgcatcgctacagaatattcttccctcaatgtcaaattgtacatcatgtttcagattacagagtagaactgaaagttgaattaggcaggcagggcacttgctaggtagaaatgagtttatagagaccaaagccttggggtgtgcttggttttcgctttgttattatttagtgctatattttgagtcttctcacaaagtggattttgtttttattgtctgatgtttctctactcctccaggtgcccagatgactatcatgagccaagcttgtgcagaaaggtgtaacataatgagactggtggaccgtcggtgggcagggattgccaaaggagtgggcacccagaagattattggaagggtacatctaggtgagcaaaaggcactggggcttgctgtctttctgtaggctatttgtaggtagggtagtcgattttcaagtttttagagggtcttttgttgttattttgttgttgttgttttaaatttcttttgtgtgggtatgtctgagctagcaagcctaatttctagaagttttaaatcctgtgttccgtcaaagttatgtgtttctgctggttgcaaacaagtagtctcctctacgtttctatttcctgaaaatataatccctttccgtcattttagctgatttatttttatacttacctccatatttctaaataacatgtttattttgctgtttactcatatgactgtgtttgagagctgagctatctaattgaatgtgattgcttttctttcatggctagtattattttctcttagaattaataattgtcctgtttttcttacttggtttcttgcgtagtattcatcccagacatttcctaatta

SEQ ID NO: 51751 - DNA, 1038 bp, Homo sapiens
ttgtaatcccatctacttggaaggtttaggcagagaatcagagaacacaggaggcagaggttgcagtgagccgagatcacgccactgcactccagcctgggcaacagagcaagactctgtctcaaaaaataataatgaaaagaacttttcagctggacacggtggctcatacctgtaatcccagcactttgggaggccaaggtgggcagataacctgaggccaagagtttgagaccagcctgaccgacatggcaaaaccccgtctctactaaaaataccaaaattagccaggcgtggtggcacatgcctgtaatcccagctacttgggaggctgaggcaagagaatcacttaaacccgggaggcagaggttgccatcagccaggattatgccattgcactccagcctgggcaacaagagcgaaactccgtctctgttttgaagtacgtaacaataaccttttctcttcatgtgctttttagctcaggttcagattgaaggagattttttgccatgttccttctctatacttgaggaacagcccatggacatgcttctgggactggacatgcttaaacggcaccaggtaattaagagcttcacttattttttttgcatctgctttttgtaatatggtcattatcacattatttttattggttacatatactggaaaactaagaaataacgacttttcaaacctggaaatgtccttaaattatgttgctatacagaggttgaaatgatgtgtcgatatagatagaatctgtttttgtgaaatctctctgtgaatctgttaaatcttgccaaatgttttgagattgtaaaggacagtttggttcccttgtataattttcagattctggttagatcctgattagtagttttttgatgacctgactaaaaagtgtgagtcaagtaagtctttagcattctctgatgctgatcaaacagtacttgggaagaagaccttcaaggttaaggaaggtatatgttgggagtgaaagtgtttatttagtacagggtgcataattaatat

SEQ ID NO: 51752 - DNA, 1057 bp, Homo sapiens
actgcaatccagcctgggtgacagagtgagatcctgtgtccaaaaaaaaaaaaaaaacaacagaattgactcccatcactttttggctcaagtttttatattaactacagttttggttgtaacttaagtattttgtaggaagggaggaattttgaacaaccagacagagactaacttaatagttttaatcttacctgcaaggtaagcttgaatgaatttgacatagctccttacaaggttttgcatttggggtgtaatttatcatcttagtcgtgatgctgtgtgttaatatgaggatatattatcattttatgaaatgtcttttttttttttttccttttaacctccacagtcttggtgccattatttaagaaacattagctgataatagcagtgttttctaacctactaataacagttatccttttttggtaattaccttattttagtaaaagtttggaagattaaaacagatacacatatgtttccaggcttagtgaaggggatgtaccaacttcaaagaattaaaaagaaatggctttttacctaaataaccttttgttgctggtagtatagcttgtgctaatttttgtaatgtttaagtaatgaaataattctacatatcaggtcctttttatttagaacatcgacttcctaatatcatccgaataaatactctggacatagtaggtgaaagtattttgttaacaacttctttctggccaagcatggtggctcatgcctgtggtcccaacactttgggaggctgaggtggggagatcacttgaacctatggatttgagaccagcctgggcagcatggcaaaacacttgtttctaaaaaaaaaaaccacggctgggcgcagtgactcacgcctgtaatcccaacactttgggaggctgaggaagggtggatcacctgaggtcagaaatttgagaccagcctggccaacatggtgaaacctcatctctactaaaaatacaaaaattagccaggcatggttgtgggcgcctgtaatcccagctactcgggaggctgaggcaggagaattgcttga

SEQ ID NO: 51753 - DNA, 1073 bp, Homo sapiens
aaagaaaaaaaattagccaggcatggtggcatgcacctgtggtccagctacttgggaggatgaggtggaaagatcacttgatcctggggagatcaaggctacagtgagttgtggttgcaccactgcactccaacttaggcaacagtgagacactgtctcaaaaaaacaacaaaaaaaagagcttattttttaaatactttatactctattataaactctatattaaaatgttttaaaaaaaaaacatgtttttgatagtagggatggtgtctcactatgttgccccagctgattttgaactcctgacctcaagggattctccctcctggacctcccaaagtgttgggactgcaggccagagtcactgtgttcagcttgatgtattatttaaaaactgatgaaaagataagctaggatagaatttaattaagtggtttgttttcctctaaaattgaatctcagctgagaaagaaatttggaaagggactgttagatatgttcactcacctttactccataagatttttttaatcacctaattcgatcaggtggatctactttcttcacctgtctcacatttgcccgtgaattctctatgtgtagaaacaaaattaatttctttacaagatctattaaaaatctgttgaaattaacagattgctgtgtgtattgtgagagaatggaagcaaccaacaaatattttggatgtccaaactacagaaacatccctcaacttggaatctaccagttcctgattttaaagatggcaaaagaacggaaactataaccctgcatgctgtgtggtttgcattgttaacccaagtttgcttgtctgtttcctaattcacacagagcgtcagaagccatgatgcatgtagtgtgtgtgtactgcagctggagtgggccccagaccaggtatttatagacaccatgttaagccttccatccagttgtcatctgtgatctgacagtctgtatccgcagcagtttgggaagttagcatttgtcattcaccatttcaccttgttcaatctggttacaactagcctatatgcatttgtattttggcatgc

SEQ ID NO: 51754 - DNA, 1019 bp, Homo sapiens
gcatattaatggatacttaatcacattgaattacagtatgcagattttattaagaacatgtctacctcttattctgatgctgtgaatgtctaccacaatgagaaagtaattttaaaatcatttctatttgtgtaagagaaacccgagtttgaggaccttattttattctacgctgtttagatttgtatcctctggtaatttagtggcattagtcacctgctaattaatctttttcctttcccctgtgttccatatagagaaaagtggtaaagaatctacctcactgggaatgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaa

SEQ ID NO: 51755 - DNA, 1032 bp, Homo sapiens
aaaggagacttgtggacactgttcattctgggtaagatgctcattttgggtccatctttcagaaaggtctttaatactggtttggccctcagctatggtttctgattgacagattacttcttcagatgtattttctgaagctggtttactgctaacaaccaaaagttcatgaagttctttcaaggctgccgttatagacgggcaagattcttctgctgactccacagaaggctgacaactgccacagagacttggagaggagtaatggccatattctttatttgttccaggtatttcaacattagtttctgggggctgtaaatcctgagtggaaatggaatcattcaaaatttcagatgaagggttacattttgatgtttctacttccatcaagggattatctaaagtgagatccaatgcaccaatgttcttgacattggcattctgcctgcctgttgaattaagcaaagtaactagggactgttgagctgtatcgatttccataaatgtttctgaatttgagcagccactgcattctgaagatggaatacttttcttcgcacttggaggatccacattctgtgggagcccatttcctttcatcgtagcttccaaatcaacaattttgtgttgattctgttgcctttcttcaggaagctcaaggtcccctatgttacaaagatattcttggtcatgtgaagctttttgttgtgcaacctcatactgttcattccctggttcttcgtgctgctgagggtcactcacttgactcaggttctgattttctggatgccaatccttttcacctagaaacatctgtggttcatgcatcctagtagatgtgacagataaactagcttcctgtcttgtatggagatgaaatttgaggccctgggtgcttctttcagcagatttctccagattacctgcaacagttatttcttcggatgaattctgcataggcatagctggactctggtctgttggagcatggtctgctgaggaagcatgatcagaaagatcttgtaaaga

SEQ ID NO: 51756 - DNA, 1035 bp, Homo sapiens
aagcagaatgttgagccagattttttttaaagatttttttcggccaaagtaatttatgatcttttgtctgatgaatttgtctatcctacttgttaaaatttaggcctttttaaatgtattggcagtatgtgcatacagaagctttttattctcattaagatgtatcctggaataaaatggatggttttgtgtgtagcatactgttttagaatgagagtaaatgctttgaaaagcagaagccatgagaaatcccactacccatccagctaaaaacagatgaactctccacactgtgactgtgtgtctgtgctgatggcaaggtatggtttgctggctcagttgtcaatttagaaacttttgaccacataatttggtgtttggaattctacccagtgctctgtgtatcatgattcattaattataacaggaaattggagaataattgaatatcttatcgtagagtggtatgtttttatttgtgtgcttaggatttgacattttaatagggcgagcaggagggtttaaatcttgggctactttgtgcatcacaggctgctgcatggattgccatgaatccttattacattggatgggatattgtgggggagttacaatgcaagtgaaacgtggtgctacccagattcttaaaagaacagaacaaccataattccatttgcagatgtcaagaactgtgagggaaaaataatggcctaaacactggaatttgctagagtttgggtttgctagcatctcactgataacacctcaacccttaatgactaatggtggaattaagttcaggaatggattcattgccagcagcttatttcctttctagactcttctgccaggaagttcttcaaacgctcagtgtgagctgtgatctgagtgaaatactaagtgtgataaccttgtcactggttaatcttggtgcttggaacggtcagtctatttggagagtgtcctttgtggcagtggaaatagtaattacagtttctgacttaagtggccttggtagagttttccatccttttc

SEQ ID NO: 51757 - DNA, 1825 bp, Homo sapiens
tagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaggctcggtggctcacacctgtaatcccagcactttgggaggccaaggcgggtggatcacctgagggcaggagtttgagacaggcctggccaacatggtgaaactccatctctactaaaaatacaaaaattagccgggtgtggtggcccatgcctgtaattccagctactcgggaggctgaggcaggagaatcacttaaacctgggaggcggaggttgtggtgagcagagatcacgccattgcactccagcctgggcaacaagagcaaaactctgtctcaaaaaaaaaaaaaaaaaaggtaaccagttgcttggcaaaggaagctggagagatggcgagtgcatgtgttaaaactcttctgccttgcagcccacatcttctagagctccctgtcttcatatgtactaaagggagacacaaccctatgtgttttttcccaaagcatgtctctagcaagagggtacatagaaatggaacatgaggctttttgtcactgattttatgataaccagttaatgtggaatctgctggttgtcttactacagctttctatctccggtgaaagccataaaaatttaggttaacttttaagctcatgtctatatatatgtgtgtaagctagcatatacatatggtgattgacaagtatagttaattttatatggatttaaaagcaagcaatttttatatctacagacgtactcttcacttatggtggcttttatcccgccacatatataaatatatatatatatagcaaacagccttgcaaatcatcggccagaaaagctgcagggcgttgcaatggccttttcctacctgtttgccacctgtggtga

SEQ ID NO: 51758 - DNA, 1026 bp, Homo sapiens
gtgagccgagccacgtcattgcactccagccagggcaacagagtgagactctgtctcaaaaaaaaaaataaataaatagagagagagagagatagcgggggcatcaaagggtgtagctgagttctgacagctctgtcttccatcagcctgaagtccacagctttaaaagccaacactattcacattgctcttcttagcagcttttctttgaatttactaccttaagccattgatttcccaaagaggcacatctgtgtctcccaggcctggatcctgctgtctgcagaaggccgctgcacgaggcctcccaccaaacgggcctcctctactctctcctcaggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgagggtgagtggccccagggcagaaaagctaagcccctgttgtgaaacagacttgaactgcttaagcctggctgggtgatgtcttccttggctagttttggtctggtggctgaaatttgcaattaaacagggctggccatttcccagatcttcatctcctcagagtccctgtggtggctaaaaagtggattctgggcacaaaaagctgaaattatatatatatatatatatataaaatatatattttttaaggttagacccttttccagaaggttctagtcacatgcctgtggcagttttctaagcaaggaaggtttagcagtgggacctggaaaccttgtcgcagggttgagtgttgcctgttctggggagcttgtctgaccccacattctttgcagaaggaggttaagcaacccctagaagaagagagaaccaggcaggtctgaagcgcagggaaaccttgccactgtgtcctgtgtgtccgtccgatttctctgagttcc

SEQ ID NO: 51759 - DNA, 1348 bp, Homo sapiens
aaaaaaaaagaaagaaatggagttctcagcaccacccttgcaggggcacctggtcctgcccccgaggagtgtgtagggtcaggggtgctggggagaagcagcctggggggcggcctctcggacccctgtctttgccccttcgcaccttgctctcattgccctgctctgtcatcttgtctctactctgtgctctgggcatttccctctgccccatggttcccaccccttgggctcccatcctgtctcctagcctctgcccccactctgcacccctcactttctctgctgtcttcctccattcttctccctttgtgttccttttacctctgcaagggacccttcagaggactttgggcacctctcagccctacaagtggggtatggggctaacggggctgctgggtacccctgtagcgtcctggcaggaaggctctgagggtaacctaagaggcgtgcagcctggctcctctctagggctcccagccacccatggaggcctcgaagtcaccattcctatgggacttaagcctggagcttgagcctggaggctgcttcaccgcgggggcccttaacacaaactcagccaaattgttgtgagctccggaggccccaggggtggtggagatggtgttccttccaagttgctcctaaagtacaaaaccccatgtcctgttaggttgtggcttctactcgaaatggggccacccctgtcaggtttccctgggaggaactggccagcctgcctccctcctgggctaacgcatgctctgggggtcggggaccccggggggtgcctgacagggtgtctcctgcttccttgtcctcccagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcaggtcagcagggaggggcccagaaaggagctgaggtcctggggtccaacctgtccactcccagcatcagctgttcatccagggcagaccgggacaccccctgagggcagttgcatgccttcctggaaacccttcccacctctaggaggttctttgagcaagaggaagtggaggcctgtcctagtcagctcggctgctggaacaaagcaccgcagacaggcggcttccacaacagacattctttctcacagctctggagcctacagtccgaggtcagggtgccggtgtggcca

SEQ ID NO: 51760 - DNA, 1014 bp, Homo sapiens
tggtggcacacgcctgtaatcccagctacctgggaggcaggagaatcgcttgaacccgggaagcagaggttgcagtgagccaagatcgtgccactgcactccagcctgggcgacagagcaagactgtctcaaaataaataaatgataaaaacaaattttaaaaaataataaaggagctattaagactcttctagccccaactttccctgaaccctcaggggacttccccaggtgtccttagttctcctgacggtgaatgtctgtcctcaccggcgcctccacgtggattaaagcctccatgtgtgtctgtgtctcatcttcccttatggagacctggcccgggtgttgggagggcagcagtgagcagcctccttcctcccacttaggaagggcatccactcatgcagttggtttattcggcagatgccaagtgagtccctcccctgtgcaggcagcgcccaggcccagggcgggtcagcatgtgtctttgtctccccaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatg

SEQ ID NO: 51761 - DNA, 1040 bp, Homo sapiens
actcatgacacaaaacccaagagggcccttagtggatgtcaggatcagtcactgtccccatgacccttgcacccctcttttctcctctctataaaataagggtgataatatttctgtctcccggggctgttggcagcatcagtagtaggtccttgctcgggggcagctactggggttagttcctctggtgctcagtccaagagttccctggtgtcttggtgtccgcggagtcccaccctgcggtcatttattttgttccgctggttgggcaggcctgggctctctgccagatctgatcatcctcccagagacaggagggaacggaatgtggcaccaggcagtaagacgcatggctgagctcagcaggagagggaagcttccaacttcctgcagcgaatgtcctaggtgataggtcaagtctgaccccgccagtgaggccaacatggaaacttactagggcctcgaaaaggtgtgtgtgggagttcagagaggagtggagacagccggcctcccaatctggacccacagggcagggcagggagaggagatggccccgcctccaggaatccaggctgcacctccctccagggaactcagatcaaagccaggaggaaggaggagtgtgaactttgcacccagtgactcactgcatccccctagggcaagtgctctcacccgtgcagaatcctgccctccttgccactgacgggaccatccgcactgggtcagcctatgagcaacactgacctgattcacctgcacgccttcattcccccaccttcatcctcctcctcgcagaggtgatcagatgtttgcaggtgcctgcctgtgtttacaagtaggtcttggaagataagagaggcggtgggaggggtgggaaagccctgttctggcagtcaggacacccagggcttggccactaaccagctgtgtgagctcggccggtctcacaccctctctgggcccggccaccacctctgtggttatgggcagttggactctatggcaagttcatctgccctaccggcttggggttctac

SEQ ID NO: 51762 - DNA, 1080 bp, Homo sapiens
cttccaaagtgctgagattacaggtgtgagccgccacgcccggcctttaaaaaaaaaaaaaaaatcaaaatggttttaaaaggtgtcattttcattggaacggggtggggctcctagtgcccgccacagtcctccactcaggccggcggggcgggccctggcctcggcctcggtgcgtgggtgcagagggcctaggccgcagctgcttctccctctgccgaattgagctgggcggtggtaaccatagtggaccgcacttcctcttcgttcagtgcctcccctcattcttgtcctttaggggtgtggtggaaattattaccagggttatgggttcttcaaaatacaaaaagccaaaccaaaacgaaaaaaaaccctcttgtgtaatgaacttcccccgcgtgcaaaattcggggaacccgggcggcttgcctctgcctcccgcctgcgcggtctccctagacgaattgcctcccgcctagccgcctccctagacgtattgtcttgtgacgcacccccgagtccctgtaggtgcaaggctttaaaaagggagctttttcgagaagaaagcacatcgggggctcttagaggccagcgtggacgccgcaatcgcggggtgagccgcgcgacgaccctatggctctcggaaggtgctgacttggggcgggtgcgcgtgcaccactgaccgcgccagcccggggtcgggccggggcagcgcgctgggcggagccgctccgtggcccctaacaaagggcgagctcattgcccggtgggaactgtgagttggtgtcagagtcctcctaggaactcagtatatgaaacttatctagagggtgttgaagtaccagcaagcaatagaattctgacaaggctgtaatttgaggcttggaaatgaccaggttaactgtctcttgaattcgtagaatttgttatagattctgtcttaacataatttatgcttaatagagtctttaaaatcggcgttcctacggtaatgataccactgactactaaataagaggaagaaaatttgtggcgtgtatgttttataatttgaaataggcatatcaaagttcttttgtg

SEQ ID NO: 51763 - DNA, 1052 bp, Homo sapiens
gactctcccggtgtttactacgtcgtgcctgagaaaccaggcgggggcggggggaggcagggagcaaaaattcacctctgtgccctaggatgaaggggagaccacgggctggattgggaagcagatgggaactttctcttcctggcgctgctccaccccttacccgccccccacctcctggcttctcctcgagtatcgtcagtgttttgatggaaaaatcatttaggtgtacattattggagtggaaaaaccacttagatgtgctcactttaatcccctgtggactttctctgtaggtctctgcctgggaaattcgtatgcaccgatgtacaagcacgtgcattgcagcattcgctcgctcctcagtgttatgtgcctagacgtgtcatttctcattatgcagattccagagacattgcatgcttatggctgggagtttggcccctctgcaagatgagggggcagagagaagaaagaggaaatcgtcccaggcagctttggaagggttcttagtggacggtgctgcggtctggcttgtgtgaatgactttctaaaatggcggccaggacccactttatgtgggaatcagcagagccgatctcagaatgcacagagggaggagggggcggaggattcgagctgccttggaaagcggcagtctggaggaacattactgtattaaaaacggcttagctggcagtttgctcacgactgcattcaaaggagtatcttacctattgcagagtaaaagcagatgctactgataaaagcaggttattttaaaactaagcagatcatgtgtccctgaaattcttttattttaaaggtttttttttttcatttttaaacaaatctatttagttgtttaaatagacagtacatttttatgggttcaaagcatgtgaaaggtatacagagaaaaatctccacccctgaccctggaattcccagttgccacacttcctcccctcaccccccaaaatccaggtaatgtctatttctggtttcttgtttatctttctgcatgtacaagaaatgttcctgctgatcca

SEQ ID NO: 51764 - DNA, 1003 bp, Homo sapiens
catgcaatacctatattaaaactgaactttaagtgcctactcttatccttttccctagctgattacattaataactgttttacaggattaagaggtgtacactgggaatacattatataaaacgttttcaagatgaatgttctcttaacagtgattaggcttttgtagtaagtgtttgcattttacaaaaagattaaaccagacagctttggggacagcttagagacattttaacagaaaaaagaggtcagtcagttctttaaaaatttttatatttatttttaaatttacattctgattagttttgtttgtttgtttgtttttaaatggacagtagattgaggggtggatggcgatttggctttttcctccccagtgccaaagaaagaccaaatccttaaaacataatcagaacatttacaaaaattggcttttcttttcttgcaataataataaatctgttgttatttttacagttttcagtttgcggatttaaaaaaattaaatgagaactatttctgaatcgggttttagttaacaaagattcattacagggacacaatagagaaagtcctttcctttgtatgttagctgggttgaagggggaagggaggagttatacaattggttcctgtcttttagttatgagagggagagaggtgtctgcaaaggcgactccttgaattagaatgagcaaatgaataaaacccttaaaatatttaacatctttatcttttcagattttaagtaagttgcgaatttagttcttcccatccatctccagttttagagactaggttaaagattatgcggaggtaaactgaggtagcccctcgtgtaaaaatattgttaaagaggctgggtgcggtggctcacgcttataatcccagcactttgggaggccgaggcgggcgggtcacgaagtcaagagttcaagaccagcttggtgaacatggtaaaaccccgtctctactaaaatacaaaaaattagccaggtgtggtg

SEQ ID NO: 51765 - DNA, 4867 bp, Homo sapiens
aaaaagaaatgagagtaatgtaataatgcgatacagatattttccccagagagaaaaacgttaagtgtaaaagagagccatttaaaaagtcattttgcaggtcgtccctcctacatacataacgcaaattgtccaaaaaaaatctaaaaactcattttggaaaattattgatatgcagcaataacgttgactttattttttccagatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatgggtaagttccaaggtttctgtaggcaggtattttgtatttgatatggtgagaaacagaaactcatatttaggggccccagatggatttaaagttttgggcattctcaatgtttcctattttgggttggaaacggaagtgatttatatcccaatggctggtatcttatggaatcgtagaggatatttcctgcagctgattggatatctgttcctgagatataatgtgatggaagatttcctatggaagcttcatttttggagttacctgtcttctagaattacttattccttctcttggataatgttaagtccttccttggatatatcccttctacctgatggagctatttggcttttgtgttcatactatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgatttttccattttggatctacacaatttctgtattgttggaattacactctttgatggaatggggaaaaattaaaatgatggatgtttcctaaatcctggaatatagccattcttttctaattgctgggatatatgggatgtcttgctgtcaagattccactagcccagggaaagaggattactatatcatttcttaagcaagttgctgtccaatcaaaggtactttagctttgaacacatggtgatgatcagttgtggatacagcaatcaaaattgactgggctggatggctacaaaagtgaactattggcgagcaactgtgccttcctcattcgttggaattgtagaggatatttcctcttctgccagctacctgattcatacttagggctggaaatatttatgaatgtggataaatttctaattgtctgctatctcaagaaagaagtctgggggtttgagagttacagtttgtctgggactacttgcttccagtggaattattttgtctggtcactaagattttttttttcttgtggttcatctaaatatcatttgacacccttgcccattaagaaggtggattacccccataagaggggccaaaattggggaagttatgttcacaattctctccctagatttaattgggattataggtcgtgtttccacacttggaaaaggttggtatgtcctgacctgtgtatattagcccctctcctaacccaagtcaaactctctttttttccccactaactctagaagtatttagtactaatagtgaatcagagaatagccattagatttcagctctgctagctcttgtgcctgccttctgtatcttcttaatggataagaactttgcatatttataaaatagcagctgtagcagtaatcgtcctagaacttttttgcctgttgcttctgttaaatcattaataatggctttcactgattaacatttgatagggtgctaaagtaattatttatggcattttaagtctcaaaggaaaccctcttatttgttagacattgaaatataaaaatctcagaactgtagtaaataaaagagaaactcatttaatacatttaagtaggaaagatatagaatgtttatcatgccagttgtttttcacaatagcagcaaaaaaagctaaactaagcctaggaaggtggggttgctactaagtgaaatgatgggtgaaaagaatattagtggagagacctggaatctaagcatgtactggggatctggtattaattgttataagattttgccagatattcttcattggagagattctaattctttatgtttcatgattccttaatcccttttgatagaagatagatccagagatgggttgaagagaaactccagtgaaatggtcttttaggaactcaggagctgagttctagttctctacaaaagtagagaacttacgatttctttataggattataactagtttttaatattaacacataattgcatgtgtgtaatcgtacatgcaacgtgttttgtactttttaggttgacaggtattcacatcctactaaatgattgtttaagttaagctattttgctaatagcgaccttagaatatcttatagttcctaatgttacctaatttcatcacaggcaatttgagtatagctaaaagccaaaagaacatatttcctacaaccattgagtttatacattaagaaattgaatcatggaataggcatttttaaagtcatttggaatttgatagcacaggagtaaataatttttatttttatttaaattcacatagagtagcatgtggtaacccaatattttgatacttgaagtggtttttttttgagattctatttttattattaaatgtaattgggtaccgctgtgcagtctatgtagtctagtttatgtagtccagtaattttttataactatccaagcagtcaaaacttaatgaaaaaaagttaaacttagaaaattttttctggacttcttgaaagtccttcctattgttgagacatgcgctgcagcagggctttcatgtctaagttaaaacatagcatggaaatgtggcctaaaagaaatttgtgagtaaataaaatttggtatatactttaatcagatgaaagtgtaaaaactttcatattattaaaatagtctcttgttccgttaacatgaaaaggagattgtatatttatgtatgcaagtcagaaaatctctaataaagtaagcaagtgagctgcagaacactagtcatgaaagcccaatatacaatgaaaacaatgattgctcagctgtgaaaataatttttggagtcaagtaaaatgttaagcttgttagcgtttgcttattaagtaggttaatgctgtttagaaaatgaccagttgcaaagacaaagacaatgctgaagtgaatgtttgcatgacttgcttttagttttgcttgctcctttctgattaaatatttttccccctcctaaatgcagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacaggtaggttaacagccttttgttataacagatgagctagctttaaacaaattctcaacaatcagtgggaatggtttcagcatagtattattttttaaagtaatcttggatcatatatgtatgtaatcagtaaagaaactggcatgtggccattgaattaactgttctaagtactcgaagttaagtgatgatttgcaaagttctgtttcatcctccagatgcacagtattaaaattaaatgatcaaagtggaagggaggtggtgactctagctgtgcaaggcaaatcttgtgacactgaaaatatggtatctctttaacatttttaattttgtaggtgtataataccaatttatttctattattttgattgaagatttgtaaaagctgtttggttaaatatgtattggtgaaatataatattgttgacacatttattatcaatgactagatcaacttatgaacaaattttagctaattttaacatcagggtggtagccaatttataaactcaagtagaaaagcttcctttgaatgcaggttgtaactttactgttctgtaaactgatctcactagttgagaatttctttctacaaatatatatatatattttaaagacagtctcactgtgtcaccaaggctggagtgcagtggtgtagccttggctcacggcaacctctgccttctgggttccagcagtcctcctgcctcagcctcccaagtagctgggattacaaacgtgcgcaaccacgcctggctaattttgtatttagtaaagatgaggttttgccatgttggccagg

SEQ ID NO: 51766 - DNA, 1524 bp, Homo sapiens
gagtgcccagccaaaaagttttatttgaaaagcgaaaatagtaagttgagggtaatcttaataagaaacttagcttcaaacctagttatatggattttgaaatcacagatctgggtatgtggtatagattatcctttaagtaatctaggataagttatttatgttcttcaggtctcagctttccctttttttttttttttttttttttgagatggagtctcgctcttgtcacctaggctggagtgcaatggcgtgatcttggctcacagcaccctccacctcctgggttcaagtgagtcttctgcctcagcttcccatgtagctgagattacaggcacccatcaccatgccaggccaatttttgtatttttagtagaaacggggttttaccgtgttggccaggctggtctctaactcctgacctcaggtgattcacctgccttggcctcccagagtgttgggattaccagtgtgagctactgcgcctggccaagctttctcatttttaataaggaccttaataaagttattgtgaaaattaaaatgaacacttaatgtaaaatgcttactttgatacctagtatatgttaaaaaaaatgctgctattcaatttgttaatcccacatgtcctgcttttcaatttaggtggtatatatttaaaatttacagtcaaattctttgacctgattaaaaggctcagattacttttcttttgcctgcttaaaattaatttaagcaaatggtcatgtagttgaatgtctgtttttaggcttcctgaattttcttattcaaaataatacatgaaaacattttgtttatccctctgcctatctagatataattcaaacattctggaagatttgcatattaaaatgaaacaagcacctagtttagaaagtcatgaaagttacgttctatgcccagctttcaagccgtgtgacatggatgaaaactcttaacttcttttgattttatttggtgtgctgtctagataaatgattgatgaaattcatttgaaccctataaactaattataaaatcttgttccacttttttttctgcatagaattgtctaaaatgctcaagttttagtcattttccataaacctacctcattaaaaagctgcatctgcattccactggatcaaaacttattgaaaaggtgttgaggcactgggcgtgtggctcactcacgcctgtaatcccagcactttgggaggctgaggcaggtggatcacctgaggcaaggagttcgagaccagcctggccaacatggtgaaaccctgtctctactaaaaatacaaaaattagccaggcatggtggcacatgcctgtaatcgcagttactcaggaggctgagacaggagaattgcttgaattcgggaggtggaggttgcagtgagcaagccactgcactccagcctgggtgacagatgatgagactctgtctcaaaaaaaaaaaaaaaaaaaagaaaagaaaagaaaaaaaagaaaaagtgctgaggctgggcaaagtggctcaca

SEQ ID NO: 51767 - DNA, 1031 bp, Homo sapiens
ggttatagagcatttacttaggttattggtttcatttcatatatagtcatattttctagagctaacagatttcaaccctatatttacatgttgcttttagtgagttacttgaacctcattcattaacttattgattccttctagtttcactgatgtgacaaattttatgtaattatagcttttttttttttttttttttttgagacagggtctcactctcgcccaggctggagtgcggtggcgcaatcttggctcactgcaacctctgcctctcgggttcaagcgattctcttgactcagcctcctgaggagctgggattacaggcactgccaccatgcccggctaatttttgtattttttagtagagacaggggtttcactacattggctaggctggtctcgaactcctgacctcaagtgatccacccacctcagcctcccagagtgctgggattacaggcatgagccactgtgcccggccaatgatagcttttgtatctatacataaaaagaacagtgagataaatcttttgactgctgggaagacctgataggtagcatttggttaggctatgaaggatatgcaggacttcaacaagaagagaggaggtttaggctagacagggaacactgtgggcagaaggaacaacctgaggtggaaggatgttttgagcatagcagataatttagaatgatttaactgtggtaatgattttttttttattttgaagagacagaatcctgctctgttgcccaggctgctggagtgcagtggtcatagctcctgggctcaaaccatcctcctgtttcagtctcctgagtagctgggattataggtgcacatcacttacaccttgctaatttttaaatttttcgtagagacaaagtctcactttgttgtccaggctggtcttgagctcctggcttcaagcgatcttccctcctctgcctcccaagtgctaggattacaggtgtgagccatcacgcccaacttttgggttttattctgtatgcagagagggccattaaa

SEQ ID NO: 51768 - DNA, 1001 bp, Homo sapiens
ttcatttagtttcattatgttggctgatagtcctgtgttccatgtggtaactttaggcataaaattatgataggaaacccatttcaaaggtgttaagtgatttgtccacggacatgtgctatatgtctgatccaagatttgaatctagacctctgaatcccaaacccatatacgcactattattattattacactaagtgaattgaattcactagtcttacttcatttgaaaaaaaaaagttcaagttattaatagaatgcaacacttgcattggtggtatgtggtggtaaatgaagattatacttttgtgctcctgcatatttattgtcttctgccacctctgaaggtagagtacgagatagatgtgtagaatgcagggcctccagaaattccagtctgaaaatttagacctattagttattttaagaagttttctaatgctgctcattttctgtttgtcttttcactaaagtttgttgttgttgcctttttgcagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacaggtaaaattttgtgtgaatgtcctttcctctgtgctactactgaggaatgaggtatgatactgcattacattgaaataactttgggcataaaattataatggaaaacccatttcgaaatattaacgttttaaatgaggaaagccatgaataatggaaaagtctgcttaagctattctgtggtctctactggtaatatttttaattgacagctgaccgtaatatactgttactcctacattggtcatgttgagcatgtaaacaagttaaaactattagtagatagtcatgccaacaaagaccaaattaagtattttttagctaagtgtatttcagtgattgctta

SEQ ID NO: 51769 - DNA, 1052 bp, Homo sapiens
attacaggcatgagccacccttcccagctaatttagcagatttaaatcagtttatttttaattttaaaggttaaacaaagtgttactttagccttaatttttttttgaaacgtttatttagcctttgtattccttttttgctttagagttaataaggggtggctatttctgaaggtgtttatgatatttcagtttatgtgagtattcaagcccattatttcagacattttgttttttaaatgtagatttttccatgatatataaatatgcattaaaatactgtcttctctttttactcggcccccattccacttacagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggtatgttgcttttactatgtaaacaattttaggtctttgtcataacacataaagcatagtacagattatatttggaaaggtgatatttaatggtgtaatgaatgaacattgttgtgtgcttttagctcttgctaaaagataatccagagaatcccattgggtatggttctatatacgtgtgtaaaaatgtaatatatgtcctttgtttacacatatatattttcttacctcttttttttttttttttttgagacagagtatcactctgtctccgagcctggagtgcagtgtcatgatcacgactcactgcagcctcaacctcctgggctcaagtgatcctcccatctctcagtctcctgagtagctgggactgcagacatgtcccaccacgcccagctaactcttgtgttttttgtagaggtggtgttttgccatgttgcccaggctggctcttacccatttttatctttctttgttcattgggttctgttttaatgccatctctagtcctgtggattgaaaggaaaatctggaagagaaaaatgtttgtaaaaatgaagcagcaggctgagcatggtggct

SEQ ID NO: 51770 - DNA, 2301 bp, Homo sapiens
ttgctgttgttggttttgcttttttgttttgagccaaaacaagacgaatactttactgaaatacaatatagtggtcagtaaacatggaaaacaaagtaaaatacagaagaacaaaataaaggcataatatctcaagccataatgtctatgattctaaacagtccctgcacattttcattttattgtgttcactacagtgtgcatcacacttttttttttaatagaataaaatatataaaaatatattttttctcatccgtgtccttgtggcttaggattttgttgggactgacactaagtccagtggatgaggctcttacttgttttttgtttgtttgttttacaggtggtgtttgaccgcttaaaaggcatggccctggttctctacaatgaaattgaatatgcacaagcagctgtaaaagagaccaaagggaggaaaatcggtgggaataaaattaaggtgtgcagaatgactttaaacagaagcaaaacaaagtcctattcaaatctcaccctcttgggctgggcgtggtggctcacgcctgtaatcccagcactttgggaggccaaggcaggtggatcacctgaggtcaggagttcgagaccagcctgatgaacatggtgaaaccacgtctctactaaaaatacaagaaaaattagccgggcttggtggcgcgtgcctgttaatcccagctacttgggaggctgaggcaggagaattgcttgaacccaggaggcggaggttgcagtgtgctgagatcatgccgttgcactccagcctgggtgacagagtaagactccatctccaaaaaaaagaaatcaccccgttaataactagcattttgtaggctgccagccaggggagtggtttacaagacacgtatgctgtatcattagtgtttaaggggaatattacaattttatgctcagctacttgtgggcacagcatctttaaaccattagccacagatccttccctaaaaatcttctcattcaaagaagtgtgcttctcagtgttcgggtgctgatgctcacacagacactctcatcgcaggcttgaccacagttatgggtatctgacacccagggcctcatagtatcagtccagcatcctgaatgatatgtctttctttcctttcctactctcctgaagagtgggtagccacttaaagcataactttatgtccagtgtatgtttttaaaaacttgtattcatggtagtttgaaggaatttatgcacttaactatgaaataactatgattgttaggttgaaaaaagtattttaaaaataagatgataagctatttgatagctgatgagcatcatatgctttagtaactttgaggcccagctgtgaataaagtttaaaatgttcatccatattttgttttatattctaactgtagttttggcaacagagattgctggatttagttgatctgattacttaattgccatttcagttttccattttgcttttttcactccttcacaattgggtttgaaactttataaatttcattcttttatcacggtttatacagaatttgagagatttcaggttaatatagtttcagtgatgaggactgttttacttgagatacattgctgtttcctgaaattttctcagaagggctatgttgtgaagaatttacaaatctgataacatttttccatcattaaaatttgaaacttgcatcaaacacctctttttttttttaaaggtggattttgcaaatcgggaaagtcagctggctttttatcactgcatggagaaatctggtcaagacatcagagacttttatgaaatgttagccgaaagaaggtatgtattttaaacttaccagtgtagcttgagttttaatagttttaatacagaaacttaagatggcattaaattttatttttcactctttacccctactttcatcttctagaatagagaatgcttctcttttatcacttcatatggaaacacaggtttatttttttgaatctagtttccaggtaattcctatgggtttggagcaacctgtctggatttctcactgaatgctcctagaacttgaaagagttactgttttgccaggtgataactttatgtacttttttttttgagacagggtctcactctgtcacccagactggagtgcagtggcatgatcatggctcactgcagtctctgccttataggctcaagtgatcctcacacatcatcttcttgattagctgggactacagacacttgccaccacgctggagtaatttttgtaaagatgggttttctccatgttgtctag

SEQ ID NO: 51771 - DNA, 4561 bp, Homo sapiens
atatctaaaacgttgtttcaacatataatcagtctaaattgttgtttttctataaactaggtctacaaaattggctgtgtattttacacatctcaatttagctagatttcaagtgcctagtagctacttgaagctatagtggatagctactacaaactaatcatttcacaaatgattaaataatgtcaaaagattttttagaagcaggaatttctgatttcatatgtatgattttatgcataagtgatgaggaaacaaaagaactaatatctttgttattttttggcagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaaca

SEQ ID NO: 51772 - DNA, 1037 bp, Homo sapiens
gttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcac

SEQ ID NO: 51773 - DNA, 1679 bp, Homo sapiens
gttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcat

SEQ ID NO: 51774 - DNA, 1364 bp, Homo sapiens
cagactgactctgtccctttgccttccttccctacaccagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaaggtaagcatgagcaggggctgcccttcctggcccccaagttttatgccatgtcaaatgtcctaagattccctagttaacagacccacaagctacagcctctggctgtgtccagcatggctcagcgaggggccatgagctcacttcctgtttgtttccctgtgagcagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtaagactctcaggcccaggtgagcaactgccccacctacagggaggaagacgtaggtagtccctgccagcccatctccctggcctgtcatggaagcattaactgtattcttgttgttgttgaaacagtctctgtcgcctgggctggagtgcagcggtgcgatctctgttcattatagcctctgcctcccgggttcaagccattctcttgcctcagcctcctgagtagctgggattataggcacgcaccaccatggcaccaccatgcccagctaattttttgtatttttagtagagatggggtttcaccatgttggccaggccagccttgaactcctgacctcaagtgatctggctgccttggcctcccaaagtgctgggattacaggcctgagccactgtgcctggccagtaacggtattcttgaagtgagcaatgaagggtccactatgcttctacttggtggggggatgtaaagtac

SEQ ID NO: 51775 - DNA, 1861 bp, Homo sapiens
tacacccacaggtggggctgatcagggtaggtgggcctactcatctggtgcccactagatctggccccagaggtgggcaaaggggcattttggacagaagtcagtagagcacatggggcggggcgccatcacccatcctgaagagaacccagggaaccgctgagaacacaggttttccatgagtttaaagatagggccccagggggttcctgtttatagttttctgacacctgctaggtcttccagtagacatagtcctggcacatttgctggttggggactgatttggcctggctcttagcattgggcctcttcagggctccccaatggaagtggagttgtgggggtgaagacagacggtcccactttgctctctatcctgtctccagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaagtgtgagtgtgattgtcacttgggtgggaggacgaaccatgggtccttggcttatgggaacagtcagccctcatcccgcttttgatccccatgccaagtctgtacatgggaactgtttcccttctgcctcctagtcagtcagtcctcctccccaaggataattttatcttgtacaaaggagatttttgtcacggacactgaacttaaccatttctcactcttgtggtgtcttcagagtcctaactggttcttaggtaatgtggaaggaaggcacttccaattttgatacagaatataaccacacccc

SEQ ID NO: 51776 - DNA, 1038 bp, Homo sapiens
agcagatctgggggagggcagatatgtttagttttgaacatgttggagttggatgcctgtaaaacattcaagtgcacctgttcagctagtagttatcaccatcaaaggtcactgaagtcatgggaggggatgagctcacctagggtagggtatgcaatgagaaacaaagtgtccaggatatcccagagcagtgccaatgctgcagtaatgcttggatacaaaccttgtcgtttttccttcttaacattgtgtcctgtctcttattgagctggagttcttgagagcagggcctgaggctgagtctgtgcatctttgtgtcccagtgtcagcatgctatctggcacagagcaggccatttattcagcacttccttgggccaggctctgtgctaagcactctgtatttgtctatgtttgatggatgcatgaaaaggcagctctgagggagcaggtaccctttaggttctcatcagattttccacttgtgtgtcattgattcaggtaatgagccggacgaggggagccaagctggagtttacacaggcaaactgtcagaaaagagtagcctgggctgtctggaaatctgaggtatgtctgtaatactcaaggatgaaacaaatcagatcagtttgtcctttttctctaggttcaacatgattcaaatgattctttcctgatagccttttcttcaaaattatatagtaatgacaaaatcccagttacagtttggttgggaaattgttgatcttactattattgttttacctgcagagagaggccagagtggatgatcactgggcaatgctcacgcctttagttaggtgaaatctacagtggtggaaacagaagtttattccttgctccttaacattctggaagtacacagtccagagctggtagcacagcttgctgtgttctgtgagatcatctgggagcaggattcctttgataatgtggcttttcttgctcaaacttaggcttccatctcatggtccaagctggctgctgtagctcctgccatcatgtatgatctccctag

SEQ ID NO: 51777 - DNA, 1024 bp, Homo sapiens
aaaacacaactgggatctgcagctttgaagccacaagtagattcatatctccggtccaccacttacaagatatgtgaccatggacattgatttacactttttgagtctgttttcccttttttaaaattaggagaataatactatcttataattggtgtgaggatttaaagagataatgcatgtaaagcgcttaacacagtgcctggcacacagtaagagctgaacacatgatgttactgttatatttggaagagaaaccaaggcaggggtacaatgaggacaactctgagcgccgaagtactgtaaggtggaacttttggatagctaggcgcatgcgtctgtctatgggcgctctcctagcgaggacgctgcgcatgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtgagtgtcaacaatcgcccggggccggggaagtcccgggagccggggcggaggcggcggaggatggggcgcggtgggacgccggtgacggttgtgtgggggaggggagggaagtggaatgggacgccaaccggggctgaggggacaccgctgggcgggagattgtggggtggcggggcggggggcgtcgccgggcgtgctggcggggagtgggcggccaggcgaccgcccgggcgagggggcgcgtgtcacctcccgggctggatgacaccccagctggtagcatctccgcccccgccgcacggctgtcaccgccccttgaccccgcgcgctgtcgagggtgggcgttctgcggccgcgagggagcgcagtgccggggcagctcctgtcggccggccggggcgggagggagcggggctgcccgggcctaggaggagctgacagaggaggccgacgctgtccctgtataaaagcatttcattcattcattcgtactgcgg

SEQ ID NO: 51778 - DNA, 1080 bp, Homo sapiens
ggcaagaagctggggtccaacctcgaggacccaaagccccatccatgccctggcttccatctctgttaggtgatcctgtctgcatgggagcagccccaagaacacaggcctgtgggagggagaaggaccagccccacccccaaccccacttggccttgcctggaggccccagcaggcgcaggacggcaggagtttcatgcagtttatcacgaaccagctgtattggaaaaaccccatctatatacagatgtggcatggctctgccctggcacagccagctggctgggggcacggggtgggcaggcagcctgctcgctggcgtggggcttggaggctggtagaggggaagtttaccgtcacggctgtctcctcttggccttgctgagccctcgggcaattagttccacttagataggcacccttgcctgtgaccttccctctgtccctcccactccccttggccaagagggttccaggtccctggtccccttgccctgcagagacttcatagatcagagggtttgtctgtctgtctgtcctgcagagcttgcccatatgtcctgctggtcccattcccctgacccacagtgggttctttagatcttccttccctgaccccagcccctgtactctggattaagtgacggaggccaaatctgaaatctgggcatcatgtgtcaggccagggagtccctggcctgccctggatagagtggagggccctagtttgggaggatggtccacctggggtctggggtgcgtgggggctagaacctgggctgagatgtcctggagctgttgtaatggggttagcgaggctttgctggcaggcgtggggcggggggacagggaaagggaagggagaggcactcagattttgatctccgtccggaaggtctgctggacgtgttctgtatgcgggtgacgccgtgcccggatagtgaggctgccgtcctcccgcagagccgaggtcaccgacgtcgggtccacgtcctccggcagctggcacttgtgagcgaaggtgttcatgacagtgccgtcagccgccagctggggaaggggtgacccgtcaggcaggct

SEQ ID NO: 51779 - DNA, 1005 bp, Homo sapiens
actgagtcctccagtgaaccccctacccctcatgggggtctgtccctcctgagccccaccattccccggggcccatcacttcctcgtggctcctgtccccagccctgcggcctcccttatccctctcctctcaccaagcccaggccttggggcacttcccacagtgcccaggctgtggcctcttacaattcccaccctagcccccggcagcagccaggctagttattccctcacatcaggctggcccctgcctcctggcctgagccgacctgtgtggctctgccccggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcgggtgagtggtgcccacctcaggctgactgaagggggtcacagtgtttgggcttggctgggggtggagggcacctccaaaaagaaacaccaccgcagctgacctccgacatgggggctgggaggggctgacacacagctgtgctctcatctccactctccccagtgccctgggtgaccttgggcaagtccttggccttgaggcctcagtgtctgtctaggggtcagctgggcttcacagcaggaggatgagtattgccccgtgtacagattgaggaaaccagagctcagagaggtgccgtgtcttgctccaggtgacacagagagtcagcaccagatccgagaggtctcctcccctctccccactcctgctgtccttgctgggactttgggagcaggaggtggaacgagaatggaaatgggctttgaagtcctcactcaaccagataggaccagagcagcttctggcgccagaaaagcagaccaaagaggctctgagagtcc

SEQ ID NO: 51780 - DNA, 1025 bp, Homo sapiens
ctgccttgctctgaacctgtttccccatcgggaaaatggggctgtttataccagtgattttcaaccttccaagtttttccttgggggtgacatacacttttataatcaaatggaattatccagggaaggctgctgggtctgtactccaatctcattattcattaatggatggccagtcactgaccacctggcagatactggttttccgtcatctcacactcagctctgtccaaggtgggacaagacccaagtgaagctggtctgggggacatgggggaccagggggttggggatttggaactgggccatcagtaatgtggtccccaggtttcctcccactgtgggttctaggagtccctcattccaggaacctctccagccctgctcacactccagagccgtgggtccctggttcaagcaaagctcccctcagatccccttgctggcctgggtctgacatccccgactccgggacctgatgggagcccctctgcctgcagctcccaccatgtgagggtggagcacttcatgaaccacagcatcaccacactggccaaggacacgccgctggaggaggtggtcaaggttgtgacctccacagacgtgaccgagtatcccctggtggagagcacaggtgcccagctggaagggaggaggaagtcgggggtaggggatgccctctgcctccttcttgaacctgtcaggcagacaggatctgcatccaggctctgtgacttagcaaccaaccgtgtgaccttgagcaagtcacttcacctgagcctcagtttcctcatcagcaaaatggaaatcatggctaccctcccttggggtggttgacatgtctaaagagagtcggctgggtgcttgtaaggcagtccctgggcagctgctggggtaggagcatggggacaccaccaaggtcttccggaagcttggccctcaggcctgtttcttcataatgcacctccctccctctccctctctacttgccagagtcccagatcctggtaggcatcgtgcagagg

SEQ ID NO: 51781 - DNA, 1042 bp, Homo sapiens
catgttggccaagatggtgttgatcacttgaccttgtgatctgcccacctctgcctccaaaagtgctgggattacaggcgtgagccactgcgcccagcaccagagttctaatttcaaacctgagccttctccactctaccgggttgcagccctgcatgtcagaggtcgttcatagtgggggttaggaaggtgtcaaacacaggtcaccaggaacgtaaccagggagcagagatgatctgaggcccaggaggaagacttcctggaggaggtggtcccagagctgagacctcagggactactaggaattaaccagcgaagccaagggagggtgatgcagagtgaggcgcgggggcgtgaaaccacatggttgtgcaagggaaccacaagcaatttggtgttattaaggcatgacgtgaggtgctggagaagtctctagggccttgtaaagcaggcccaggagtggggatttcaagttgagggcaataaggagtcattgaaggtttcaagcagggagtggcatgattgttgtcactggtagaggcaggtctgcaacccagagctcctgactcagcctggagctttggggagatacaggagaggcgctggcaaaagtcgagagggtgttcggcctgccctggggtctcaaagctggcatgctctgccctggcccctgctgctgcaggagagctgccaccctctgggtcctggcccactgggcatccatgagacacctgactgtgtcaggtgcggctggggttggtgagctatgggagtgcagggagcacctggctgggccttcctcccattagtgttgggccacctgagtgtgctgggcatgatggctgagtcaggccttcctggtgcctgaccctggcctggcctgacccaggtggccactgtagctctgtggctgggctatggctactgttgctaccactgacaaagctgttggcccagcagggaataagcctgcagcttgcaaatccacaaaaatctgggctatgagggcacatcaagaccaggcctgagtcccattcccaaa

SEQ ID NO: 51782 - DNA, 1083 bp, Homo sapiens
cagtttggggcagtcttctccaagatgccctgactgctgcccaggagagagaacccctggcctaccccgggcacctctctccacttggttggctctcagcctgcagtcccacctggtgagaagtgccacttactctctgctggccctgggtttgcccctttgtcaagctgccccttggcagctcttctccccttcccaactccagcattgagacttttcccggcatggccttggcacagacacctcctcctgtcccaggaagggggagaccctatcctcttagccttttgtgcctctaaaaatagtggccagtttcaacaacccagcttgtgcatggtcaaagatcatggcgggaacagaccgggaggctgggaggttttgggaaccgtatggaggggatgacctgggcctcccatggttctaggtcacagaagttctgggatttgagcctgttcatgaacattctctagggcctttggaaattgctcagctgggctcccaacctgctggccaaggccatagcctccctcaggggacagtcggtgatgggaagcaggcaggaacagagccgaccagaggggaggcggggacacgtagggaggggagatggatcacaggatgtcttttgctgcccgccagcccagcagggccacaggcttgggctctgcacacatacctgggttcaagtcccgcatctgccacttcctagcgggtgaccttgatcaagtttgatgggattgcatgggtgcagcgcagatgacacgactggtatacagtgggtgctaaatcctcattgctctcctcttttcctccactcccttgctttcctcccctagcactgtgcaaatgccccctccttttctcctttttcctgggaacatccaccagaccctttgctcctccaggggctcccaccaaggacaacacagcctctcttctggggaccagagctgagggcacggagaagtgcttatgggaaacacatgttcttagaagcttccctaaatagcccagggtgctcctcgccaattcctttcccacgagcagggacggggcagtcttggatggatggaggctgtgtgt

SEQ ID NO: 51783 - DNA, 1037 bp, Homo sapiens
gcctgtagtctcagctactcaggaggcggaggtgggaggatcacctgagcacaggaggttgaggctgccgtgaggtgtgatagcgccactgcactctagcctgggtgacagactgagaccctgtctcagtcaaaaaaaaaaaagtcccttccagtgaactctggacacagacccttaggcatttgccctttgggcagctctgaaggttgggtggcagctcaagaaaggcccttcctgtctgtttctgggatgttcctgttcccctcccctcccctgcccacctccataggctggaggctgcagagggtttcagtggctttctgcaacagcgcccctgaccttcgtgccccgccaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccggtgagttctatgccctctgcccatgatgacctcaattttccttctgcagactcttgaaccacttcggtagagtggccacccaggtgaagctggtagggggggtgctgggggctaagaggttatgtgtggacttgacttagactggacacgatggcccaggaaatcctaatagaagcaaccagcttatgtgtctgtgtgcagggcactgcgtgagcacttaatatgttttcattcatttaaacaacctacgagatgagtcctccagtgatcctcattttgtagaagaagaaactgagacacagggcgattgaatatcttacatggctggaagtggtcaggctgggattgtgacctcaggatctggaatctctgctcgtagcattttatgatgtggtagttattggtggtggtcctgttagtaggagtggaggggcagcagtagttacagatgctgagcgctcccaacgtgccaggaggtctcattgaac

SEQ ID NO: 51784 - DNA, 1900 bp, Homo sapiens
ggggcagccagggtgttcccagggcactggggtggggccacaggcttccgtgggcagctctgaggggtccgtcccccacagcctggtccaagtctctgaagatcacgtgaccttctcctctgactccagagcaccccccatggggcccctcctgagctgcctgtgaccccaccccttctccttccagaacaactgaagcccctgaagacatacgtggacccccacacatatgaggaccccaaccaggctgtgttgaagttcactaccgagatccatccatcctgtgtcactcggcagaaggtgatcggagcaggtgaggttggccccctgccaaggggccctgaggaggcagcggtggtgacacagtgtgggagccctcatgccggggctgaccagggcactcccctgaccctgtctgcccacaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatgtgaggcttggggcctgcccacactgggtggagaggggccacttagcaggggctctgtctgtgactgtgcccacctcccctatacctgtgcccaccttccccccacacctgcacccacctcctctacaactgtgcccacttctccccaatacctgtacccacctcctaacacctgtgcccaccttccccccatacctgcacccacctccttacacccgtgcccacctctccccatacttgtacccacctcctctacacctgtgcccacctctccccgatacctgtacccacctccttacacctgtgcccaccttccccccatacctgcacccacctccttacacccgtgcccacctctccccatacttgtacccacctcctctacacctgtgcccacctctccccgatacctgtacccacctccttacacccgtgcccacctctccccatacttgtacccacctcctctacacctgtgcccacctgtcctcaatacctgtgccctcctccccaatacctgaacccacctctccccatacctctgcccactcctccgcctgtgcccagctttccccacacctctccccatacctgtacccaccctccccacacctgttccacctctccccacacctgtgcccacctctcctacacctgtgcccaccttcccccatatctgtgcccacctctcccacatgcctgggcccacttacctctcacctgtgcccacccccctacagacaagcccatgatgatcatcactgagtacatggagaatggggccctggacaagttccttcgggtaaggatgtgggttgtagggggcggggatgcctggccattgagcccggggctggcctggcgggttcagggctggcctgcagctgagcgcctgtgctccggcaggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtgtaagttggggaaggggacctcaagggagaagcggccttcgccctgcatggtgtcctctcacctgcacacctgggcagtgcttcaggaggcagaacacctgtaggagtccagggaggggtcgtggggcttggctgcaatggtcctggggccagccagagggcacagtggt

SEQ ID NO: 51785 - DNA, 1059 bp, Homo sapiens
tgcacgaattccagacgctgtgtgagttgggggaccctgggcatggaccaggccagggcccagaaccaagcaattgagacatcttgggaaaggaagtgaatcaaataacttagaaatgcccctttctcggtcaccggcggcctgggacagcccttcggggactgcccccaagcctggggagggggaagcatggaaggctgaggggtggaggagccgggatgtggattcacgacagtggtgtgaggaagttcaaatccgcatctcagaaaaagccagagctttgagccccacatacctgcaatacctcccgtgagaccttcgggaaggcctccgcttgaccgtctatgaaatgggactaagtaccctctggagccttcccaagtgcaagcacccagcacacagtaggggcccaggtgtcttgggtgcagcgcgggtgttgctgtaatttgtgggggaactcccttgtcatcagctgatttcttccaccagccccggagggatctggcaacttggcggtgattggcggcgtggctgtcggtgtggtcctgcttctggtgctggcaggagttggcttctttatccaccgcaggttcgtcagagcccataccctggctccacatgggcttgggtgggaaaatggggcaggaacctccatttcctcatctgaacgatggggcccacaggatgctagtcgagtctaatccctgcctccggatggtgcgaggatatacgagttagagtgtgtagcgaagtgcctggcacgcggcggggccgggacacgggggtcattacctctgctcttgttgttattaatgatgtgtccacacttcctctggacacgcaggcaggaatccccgagtagctctaatgggaatgccttcgtcacgactgcttaaggggccattctggggcctagatcctggagagggagtcctggctcgctcacttcctccctgttcctccacccgccttctccgcaccctcggccctgagagtggagcttgggcagcaaaagcggggactgggccgcattctgagcaccccaggtcctcctaggac

SEQ ID NO: 51786 - DNA, 1073 bp, Homo sapiens
tgggcaacaaagacacaccccgtctctaaaaaataaaataggccggacgcggtggctcacgcctgtaatcccagcactttgggaggccgagacgggtggatcacttgaggccaggagttcgagaccaggctgcatctctactaaaaatacaaaagttagccaggcttgatggccggtgcctgtagttccagctactcaggaggctgaggcaggagaattgcttgaacccaggaggcggaggttgcagtgagctgagatcccaccacttcactccagcctgggcaacagagcgagactccatctcaaaaacaaaataaataaataatgaaaaaggagtgggagaggagagaggctgaaaatcaggcatcctaagtttgagttctggtttccttcttgggagcttggtgaccttggacaagcttttttgtctctcctcacctccaaagtggaaccagcgctaatagtgcctgtatatagcaggtctattgcgaggactaaatgagggtacagtgcttagcccgagccctgcgcatagtaggtactgtcattgggactccaggctctgtgcagagcaggagtcgggtcccgggcctcctctgtcctgctgcatgacctgggacaagcccccttccctgccctatgtgcctgagctcttgcagggccaatgctgagggtctgcagaagcaggatggaccaagggggtgagagcggctgtttgtgtggtccctgggccagggttgggaggggacagggatgcagcctggctctgagagcagagtcatcagcaggaggtcactatctggcaccttacagagctgggtgtcctttgagtcctgttcccctgactcctggtccccctctgcacctctgctcacacaggggactggatgacgagagtcttcgctccagattctgtccctgagagttagcaggtttgcttgggtcagggcacttgaaattgcttccctggagggggttgtccttaggccattaggggccaggttgtccccagggtcttggacaaaagctgcctccaggcacagatttttcctgacggcaggggtctgacttct

SEQ ID NO: 51787 - DNA, 1058 bp, Homo sapiens
tcttgctcccattgtacagatgaggaaattgcggcttagagagcataacccacctgaggtcacatggagtcccggactccacctgcaggctcacaacctaatagagaggtttggcttccagacatgtgccagaaagaccaggggccagattccagctcagccacttatggatgcagcccccacccgcctcaggcctcagtttccttcaccgtagaacccggagagcacgaactggaaagcatcttcctagtgccctactctgccacctgggcctcagtttccccaggcacctgcccacactaacctgtatcttccccccacagtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccagggtgagtgacggttctgggttgcagggaagggggttctgcattcccaggttctggtctttagcttt

SEQ ID NO: 51788 - DNA, 1006 bp, Homo sapiens
aggcatgagccaccacccccggcctgtttccttctttttctgcctcccaaactgggtttggaggttttgctgttctgtgttgggaggaaaagaggccggatctggagccgttgggcagtggcaggtgttgggggtggcatcctgtctcagtctctggagtgacagggcccgggttggggtctcaaccgggacttctggttgcaggagctcatggcaaggatttctgccaccctcaatatccgccccaccaacgtttggtcctcccccttcctgggggactgtggttggagagaaggggagagacagctggaatcactataggcctttctcctcggctgcccatgggggggtgggggattaggcgggtgctttgctgctgcagtccccaagctggcctggaagcctggagctgccttgtccttgtcccctgtgtccacctctccccagcctgtgtgattaaaccccacccccacaccccatgggatgcagggggaaaggcttgtgtattgcactggggtgggggtacatttttgcttcgactctgagtccccgtgaaagagtccctagagaagtgtgcctaggtgggggtgggcatgatggcctagctggcagctgctggtttcagttcctgggaatcaggctgtatgtggtgggtctgcctgggggtggcttagggggcaggcaggaggacacaggtgcctttttcacctacccccaggctgcttcagacttctttcttgccccctcacccctaggctatacttggttgcccacgtggctcctgttaggtcatcaacagccactgaatctgccctcatttttacaaatggggaaactgagggaggcccgagcccttgccaaccagggccttctggacagaggaccagacctgagcatcccgcttcttggctgccagagccaaggccctgcctgctttgtggttggtgtcatggtagattttcctgggaagcaggcatagctgggcaggggcctgggcgggtggcag

SEQ ID NO: 51789 - DNA, 1057 bp, Homo sapiens
acgcccagctaatttttttgtatttttagtagagacggggtttcaccatgttggccaggcatgtctggagctcctgacctcaaatgatctgcctgcctcggcctcccaaagtgctggaattacaggcctgagccaccctgcccagtcacatacaacacttatgtccatacacacactcacacacagtcatacatacatcaacactctcatgtctatacacacgaatgcacattcaacaaaatctcacaccctcatacacatgcacttattctcacaggcacttgcacactcacaggctctcagaggaccaaggctctcctcccatcctcttggtcaaaggctttaattatccccaacgcctgtaattaacccttcctctcttcctgcaggagagatgtctggacccgcttcccaagagtaggcaccaaggcgagaggccaagatgtccacatccggcagagaagacccacgtacctgggtagcaggtcccgggcatcaaagcgaggatggggtcagagaggaagaggtaggcaaagggagtctggggcctcccaggaaatcaggcctgccacagttgctcttcctggactggtcaaatggtgattggccaacaggcagccgtgggtggctgggcaggcgggccagagcaaatttcccgtttgtttcactcacactagccgcttctgtcaggaagggagatgagctcatgtctgaggaagttttgtgaagaggccttatcaaggggcaggtggtaggcaggtgtcctccaaactgtcaaaacctatcaacccatgccagggtcgggggccaggggtgccccttgcccccttccccaaaaagaagcagtggttcaagcagagaccaccaggattcaaatcctgcttctactacccgtgagctgtgcaccctttgggcatgttgtttctgctcttggagcctcagtctcctcttctgtaacatggggatgatgacccctgcctcccagatgagaattattaataaataagatagtgcatgtctgatccattcccagaggaaatgaacctattctcagatc

SEQ ID NO: 51790 - DNA, 1050 bp, Homo sapiens
gagtacctgccaggtgtcacccccttcctgagtcctgacagtttggctgcaggcctgcgtggaggcttggaaggaagaagggaggaaaggaggaaaggaggaaaggaggaaggggtcagggaagcccctctgtttgttttctgtctctgagaacttcccagtctgactctagccccttcccctccctgcaggcactaacacacaagtcccccattcaccagaaatctgtcccaggctccctggctgccatgctccctggataaacccaccaggatgccctcagcccctgagggaagaggagagagcttacactcctccgggcccctatttccacgcccatcaccaggcctgggccctcacaaggctacacacacaccaggaagtgccaggaacacagccacgccagagctctcacagatgcctgtgcacacacacacacacacacacacacctttccaggcaaacttgcatacactttcctaatggccaggtctcaggggctctgtagggaccacctcgggacaggacatggtcttccctcccccattcccattccccttcctgccctgtttccctctgtctgtccatccatcttcatcaaccagtcccagtgggcccctgctcactccctccgttccccctccatccgtccgtccacacatgggtccatctgtctgtcgcctgcctgtagctagccctgcagtgagcagtctatccctacccagccctgcccatcacttctgccacaacacccctgcaagatcctgtccctgtcctcagcagggtctctcatcatttctctagaacccacccatctatccccccaccccttcagctgtgtccttcatctgtcaatctgtccatccatccagccatccatccatccatccatccatccatccatccatccagccatccatccatccatccagccatccatccatccatccagccatccatccttccttccttccttcttccttccttcccaccttggcccagcccctctcagccccctctgcatcccatccatcacttctcagacaggcc

SEQ ID NO: 51791 - DNA, 1356 bp, Homo sapiens
atagtctttgggagatcatgaggcagcgggtaggggtggactccgtgagacgacctatgtcaagtgtgttgcttataaagtgcctaggaaatagtaagtgctcactaaatgctgcttggattgacttgggaaggcaggacctctctggagtgtggaagaaaacagatagttaccaggtgtcttcaacaaatttgttatgtcccagggcctgagctgagtactggtcctcagatcaaaaacaaagcaaaagcaaaccaaggcctgctccatcccttccctgaagatgcttgcccaatactggaaacttgtcaacaaccagtttcaagtcagcgtgaaatatgttgggagacacagaaaggcaggagggcacgggtcaaagaatagggttgccactcgtcagggggtaatcttgtcaagtgactttccttctttaagcctcggtttccctctccatgtaatgggcgtgaaataaccacctccctgcactgttgttcacattcacgaggttttgggcacatggcccggcatagtggctcatgcttgaaatcccagcactttgggaggccgaggcgggcagatcatttggggtcaggagttcgagaccagcctggccaaaatggcgaaaactcatctctactaaaaatacaaaaatcagctgggcatggtggcgcatgcctgtaatctcagctactcaggaggctgaggcaggagaatcacttgaacccaggagatgaaggttgcagtgggctgagatcatgccactgcacgctagcctgggcgacagagtgacactctgtctcaaaaaaaaaggttttgggcacatagccaagatcactaaatagaagggatgatgattgtggtgttgctgccctggaagttgtctctgggcccatttctcctcttctgagcctgtgctggaacgggtctgaaggtctgggatgaggctttctttttatggcagagctggaggtttccccaccaagaacccagtcctgtagacctcagatctcaggatcaggacaagggactggggcaccttggggtgtgcttgtgcttggagagacatggtcagccttcagcctggatttgggcatttctagtgaccacagacctaggggagtgacagaggtgtcctaacccttagcagtgtcccgtctgacaggagaggcacagcccctcacccccaggagcatccagtcagaggagggagacagcacaaggagtcaccctctcaataagctaagacttcagaatggcagagctggaagaccccttagagatgtctcttgagtcactaggagcttggtctggagagattcacttagggtcccaagggtggggatgcactgggggaca

SEQ ID NO: 51792 - DNA, 1307 bp, Homo sapiens
tggcgcgactgtccgcgcggaaggttggctctaggacctgactacacgaggccgtctggaagcgaggacagcaagccgctgagcgagaggcgaggggagccgggcttgggtgcgggtagggggcggagccagcgggacgaaacctaggataggacagggccggatgaggagcggaaccattggaagagcaaacgcctggtgggcgcggaacaaggcggggccaggatcaggggcgggacctggggggtgggcggggctctgggaagaacgcgtcggggcggggcttaggagaggggcgggatcgaggacaggaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggtgaagaagtggtctggcctggcccggggtggggacggagccagtggttggccagctcccagatctggggtctccatcctggctctgactcctcaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctgtagggctgggggctctgaaaggggcgggggcgtggagggagtctcaggcaggtgtaggcactgagggctgggtgacgtaaggtgactctgggaggggaggggtccctgaaaaggtctctgtgaccaggataaggtgagatgcaaccccaaagggcagtaaggatgtgctgagaagccccctgaggaccccgtggatggccagggttgtggatcccaggaattcaggcctacctgtgattccagagtcctccccattttccagcctggagaaccccaggttccctggcatcctggctcgcctggaggagtctcctgtgtgccagcgtctgccccttacctccttccttatcctgcccttccagaggatcacccgcctcaagatgttggtggaggtacctc

SEQ ID NO: 51793 - DNA, 1050 bp, Homo sapiens
tagtaccacagggttgttgtgtggttgccactagaggtggtggtggtggtaacatgcctagcatcaagctacgctcaaggtaaatgctcaggaaatgctaatcttgctttgttgtttctcaccactggatgctgattgttccaccatgttgaaacatctcccagcgtcctgggccctttgggtctccctggacatacaaacgaaacttgctttgccatagctagggctgcatcttcctggtgtaccagagtctcctccagggccagtttctgtttctcccatcagactgagaattatcccgggtcaaggactgtgcctccctcatcaaactagggacccatcagggcagggatgtatctcttcttcctattccttcctggtcccctattcctcccatctccacctctcccatggtgagtggctgaccctggctccccctcaggcatccagaccaccgtggtattttggccagccaagctgcaggccagcagccgtgtcgtcatgtttcgttttgagttctgggactgtggagagtctgcactcaaaaagttcgatcatatgctgctggtgagcaggcatgtgggcctgggtgggttctgccaggggccgattgggtattaatgagctcaaggcactgctcagagacctgagctggcactggagacagtcccagcccatgcttgtcctaggaccagccgctccttgctctgggcctcagtttcccaatctgtgaaaggagggattattcctgattcttctgagggccctgcagctgatggggggtgacatggttatatgcctctccatcaccaggcttgcatggagaacacagatgccttcctcttcctcttctccttcactgaccgtgcctcctttgaagacctccctggacagctggcccgcatagcaggtgaggcccctggtgtcgtcaggatggtcatcggctccaagtatcctttggatatccttggcaagtcacggagccagggggtcaggggcccagcctctgcccaggcatggaattcagcacctgggcttttacttaaaggg

SEQ ID NO: 51794 - DNA, 1669 bp, Homo sapiens
gcgtttctcaggcacaaagcctgctgcagctggccctgggtcctggctttcagccagcatctggcagcctaagtgtactgataagtgtgttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttcctatctaaatataaagtatattagaaacctgaaagtacagaatctcaaccttacagtctttcccttagtcctgtggccttcctaagccagctgttaacgtgttgattccttccacttcccccaagtaggcaggcaacagatatgttgattgtcttagaaagtaatctggttcctctgaactccattgaattccagtttgacgcatactgcctggaaccagactgtttgcttacagctttttaagaaaaatctgccttgtctgcccccattatggttggtcttggtagctcctgggcactgtgggcgtgtaccatgggaaagtgattcaacacagtgaaggtgattgtctcctcaggcctcctgaagccacctgtgcggtgggacttcacgtgtctcggccaaggcgagcatttccacaatgccgtggatgctgcagtcaggccagattgaaccatgaccccatttttcacatgataccaattttgtcttaaaattcactgagaaaaatgagactaaattttttttaaccctcaggagcacctgaagcaaatatttatccgtatttattgaaaattcattttgtttctacttgaagctttaaccccttccattcctgcaagtgtgccttttgagagctcccatggcctagtgacttcactggtcaccttgtccatcttacttaagaattttagtctctccctaccctcttggacagagcttcctgttctcttatttcacaggttatacagcagagcgggttttgtgttttcattcctatttccacccttcatttggttggtggactccacaacctcaccctaccctacactttgggagcacaaatttggtgttgaaacaagcttaaatttcattttagggcatactgggcttactctcctcccagctgtctgtggattgatttgattttaatgttcgagttttacagcaacagctgaaaaccatgaactattctaggaactgtgttggaactctttaaaataaagaaaagaggaggaggaggaggaagaaagaaaaccaacttaagaagccttgactttggaggacagaaagccaccagccaatggagaacaaagagatgtttccctttcctttctttcaccttgtcattctgggtttccttctgcttcactctttccttcccccttaaaagtggtattcctggttgg

SEQ ID NO: 51795 - DNA, 1856 bp, Homo sapiens
tctgcttttacttcagttaatagatggttaaaaaaataatctcattaggcactagtgtctggccgcagacgtggctcagatgaggcctcgtggaaagagcagagggagggtctcaggatgacttctagggaaagtaggggaagaaagatacagcctaagtgctaagtaggagcataacactttgctgcgcatctttataaaggtcccttcattttatatcagctcctcagacagtagtaacagtattttcattttagagataaagtcagagttagagaaaattaagtgacttgttcaggctacagagctgggattcagcaacatggtctctttctggttcagaagcccctgaactctgagtagggcatctctaaaacctgctccagcccacacagtctgtgaaagtgaaaatggtgcaagtttgccagatgggccacaggcatgtggaactccccagccaccattatggtccctgggagctcctaactacctttatccttctgtccttaattcacaggagcaatgatgtctgggtccttgaccttgagcagtgggcgtggtccaagccgaacatctctggccccagtcctcatcctcgaggtggccaatctcaggtgctcaggaattaaaataactattcagcaaacactgtagcgtctttcagttaggacgggagagggaggagggagtcaggtaagatgccaatatgcactaagccaaagaaaatgtatcattcttttttactggtatttatttttcaacttctaatgggtcatattatttatagtggttttatattatgctcctccccaaagcatttactttgctgtgtcatttctcaagagaatcctgcattttatgtggttgacattcatgttaatatttgatcaacaaagaatgtatcctttcaggtgaattatcagtaatttattcacagggatcagaattgatatgtttttaggagaatggagaggttatggtaactagaatattcccatttgggagctaggtaggctattctcatataccagtgaagcatagaaagtcagaaacctgtgtctttgtaggtttattttcaatgtcttcccctcctcagattgtcatagatgatgcaactatcttaatcctcggagggtgtggcggtcccaatgctgtgagtattgcttctgtggcattcccatgtgcatgctactaagtgttcaaaacctgtttcccctgtcttcttttctaggagtatacaagactatttccatggcattttaatttaaggaatgctttttgggtatagcctttgtattttctggcctttgtttctgcttttttttagggttgtggggggatccttttaatcatagatatttgtctcttgaatattcatatctatattcttcccattcctatttcctttttaggctataaagtttactgctatcatattttcaaaggggagagggcagtggaacaaaaaagcaggttgataactgtcagagttcacacagtatttaagaaagcagattcagaaagttgtggatatgtattatttatcctctccttcaatccccaatacatacacataaaattatgggcaagtgtcaaaaccactcagttgattcatgggtcacaagcacaattccatgtgctaagccagtggtaatatatgaatgaatgaaagcgtaagtggatgcatgcacaactgaataattaactgaggattttgctatccttctgaagagtccacatcctttcaagaccagacaggagagctttgagactgcaactctgtgtgtgtgtgttttggaacgcatatcacacctgagtcttgttattggttttttctcttacagctattcaaggat

SEQ ID NO: 51796 - DNA, 1071 bp, Homo sapiens
tctccaagacttactctgaattgtttttcaaacatatatctcttaatgacagcaaccgccgtttcttgtaatggaagacttagtacgtggcgcttgttagctgttactgatcaggaccatagggaaaggtagcaggtggcaggtggtgctttgtcagcaaaccaggccaaagaagccatgatcttgtctcttgtcatcgttttctcatctctctccctccagaccgtttacattcagaacttgaaagaagataactttaagcaaacttgtaggaaaggcataaatacattatgccatcctctacttattatcccaacaaatctctgctgaaagtgataggattatcattttaaatggatgcctacttactatttttacataaagtgtgtggtgctgacttcttgacttcctcctgtctttttacattaggtggaactgcattgtgacaacccatgggccacctcccatggctggccactcctcctgtgtgatagatgataaaatgattgtctttggtggctctttaggatcccggcaaatgtaagtacatttggtttgctccatatgagcctgaaggtaaatactcctgggaataacaggtttaaaagtgaattagggaccaggtgcctaattcacacctgtaatcccagcattttgggaggccaaggtgggtggatcacctgaggtcaggagtttgtgaccagcatggcgaacatggcgaagccccatctctactaaaaatacaaaaattagccgggcatggtggcacacacctgtagtcccagttacttgggagactaaggcaggagaatcgcttgaacctgggaagtggcgattgcagtgagccaagatcaccccattgcattccagcctgggcaacagatcgagactcttaaggaaaaaaaaaaaaaaagtaagttagggtcagtattcctgagcatggctctaattaatccaattagttatctcatcctagcattctgttctttaatcccttaatcacagaccaataaattgaaaaatttgctctataaaatcatagttatatagaatctctttgacatatggttc

SEQ ID NO: 51797 - DNA, 1080 bp, Homo sapiens
aactcagaagctatttctcattcccccttgaggagatgaactcttgaactatggctttttatttttattcttccttttctgtttttgggtaagagacagggtctagctttttgtccctgagtggaatacagtggcatcatcatagctcactgcagcctcaaattcctgggctcaagcgatcctcctgcttcagcctcccaagtagcaaggactacaggcatgaaccactatgcccagctattttattttattatttgtagagacagcgtctcactgtaatgcccagactggtcttgcactcctagcctcaagtgatccccctgccttggcctctcgaagtaccgagattacagacatgagccatcgcacctgatgtactatgcattaattgattctacttttcaaataaattgtgcccctgataatttcctcttttctgtagttctctctagaagtgatgatgggttgtgggttttatatttgatttgttggcttttatgttgtgtcccttttttgtcttctctcccattttagtaagctttctgaaatcccactgctgaatctcagaatgtttcttgctattgaatttacatatgtgagttacagggtagttgcattttatgtgatgaatgggttcttaaagacctcatataatgaattttaattctaataatggattgctgatatttctgcttactggctaaagtagttggtggtaccatgtgacaccagtatgaacatggtttacagtttactgccagcttttacattagcgattctttttttaaaaacaatattattctattaagacataatttgatagctgggcatggtggctcacgcctgtaatcccagcactgtgggaggctgaggcgggcagattacgagatcaggagatcgagagaatcctggccaacgtgatgaaaccctgtctctactgaaatacaaaaaattagctgggcatggtggtgggtgcctgtagtcccagctacttgcgaggctgaggcaggagaatcgtttgaacccaggaggcggaggttgcagtgagccaagttcacgccactgcactctagcctggca

SEQ ID NO: 51798 - DNA, 1881 bp, Homo sapiens
tattgatttgtgcttcaggtttaatttgaaaacaaaaacaataggagaattggaggaaaggaatgggaggacagagtacatgtgttggcatacctttgcttagctctagaggataatgatgcagatttagatcaattatgtagctgtgctgaaatttccctcatttgagcacctttaatgtgaattattatgtgttcttgctggacttacactgttacatcattgtcaacttgcttagtgtgctcagaaataaaattttcatagctttcctctggaccttgttttaaagggtaatatattgatccacttggagacaagaggctggtaatagaaatttggtacttggtaacaaaattgctgaatgtgtgaaataagctttgaaaaatatatgttatggttaaaatgttggaagggcctcagaattttcacagcagttatttgtgtattttctttctaggtgcatgctattatgatgctaatcagtctatgtatgtgtttggaggctgtacccagagcagctgcaatgctgctttcaatgacctctggagacttgacctaaacagcaaagagtggatccgacctttggcttcaggtaagagatgaaatgctgatctttgcctccttaccaggtgactcccttggcatggaaactctacctgatcatttttggtgttggtctcaaggatgggttactgggactcaggtccttaagtttaatgtgccatgtaaatgataatagtaatatgcttgtgtaagtctttgttttttgttaaattatactttatcattagtaatggtgccctgccaaaattgctgtactgctgtgtgaattcatttgcatggttttctcaagtatactcatacaggtgtgatacatcatttggtaggaggttgaagtaagaacagaaacacagagtcgtgagaactgtagttgactgacagaagctattgtcctagggctaaggtctctgaatatctgttgttgttgccagctcagatatttggggagtgtatgggacgtgcctctgctagttactcttaacaacccaggggtgtgggaagattctacagtaggtacattcctacccagtcccactatgccagaaatctggcagaaagaaactagattattttcttatttttgacctaacctctcctgggggaaaaaataaaaacaatggtttttgcactcatgaggcagggcaatttgaggaggcatagattggaggggttggtgtgatggagaaatagtgtccactgagtataaagtattctgctagattttttggcaagcttttcccaaaacattcatttggctttttagtattaggactcagtcttaggactaaggacatttgggtttccattgggcaagttccttatttatttaggccttgccttactactttgattaccagataggaggcatcattgtatattagaaagggcactggactaagagtgaggggacatgagtttcatttcctggcatagtcaccaattctccatgtaactataaataagttattgcacttctctgggagaaatgtggagtagtactaaatgactatttttaaatgggctaaaaaggctagtttatgtttccctttctataaccgctactgtgaatgtctaggccagggacttaaacctgtttatgagaagaagctgcattttgcttccctaaaacttaagttcctgttctttccacctacattaggcaaatataggaggagcctactgagtggataccatgggtggagctgggctttgtgtagatgaagttctttattaaaattattggcatttggagggtaggagggtggtggtccagtctgcagatggccacaccaggaggaggagctattatatccccttctc

SEQ ID NO: 51799 - DNA, 2266 bp, Homo sapiens
tagtatctttcctatggaaaagtctgggacaaaaaagtcaggtgaagtaaaaaggccaattctagggccaggtgcagaggctcacccctgtaatcccaacactttgggaggccaaggcaggtggatcacttcaggccaggagttggagaccagcctggccaacatcgtgaaaccctatctccactaaacatacaaaaattagctgggcgtggtgggcgcacgcctgtaatccagctactcgggaggctgaggcaggagaatcgcttgaacctgggaggcagaggttgcagtgagccaagattatgccactgcactctagcctgggtgacagaacaacactctgtctcaaaaaaaaaaaaaaaaaaaaaaaggccaattctagctttttggtgaatgtgtgcatagctaatcatgcaagctttaattaatgtagaatgtccttttcagattgatgtagggggtctcctgagtccccaacatcatgcattgaaaaatgtttcagtgttgtaggtgtcacatatagtcaggtagtttcatacacaatgctcatcatgctcctgcaggagccagcaggcccagactggataaccgcccttgcttcttcatagttacgtaattagagaccttatcaaatatgttctggcttgtaggtgtgagacacatgacagcatagtctctttaagcatgggataaatgcctcaggatctttccctggagacaggtgaagaaacaaaagagaatttgacgtctgaaaatgcaaaagcatatcattcatttagtgagcatttattgaatgctccatacaccatggaaaagatgaaactactggaagatcttgcacttgagatgattatagaatagtggagaagtattcagaactgtgaagaactgtttgcttgctctgtgtgtaattaaattgtgactatttgacttgtattttaatagggatgattagtatgtgtcgtaaactaagcccatttcagaaaacttgaagagatttaccagttggaatagacactctcagtattatttgttagcccagtattcatactgtactgtgagctgtaactgtatagcacattctagtggtctagatgttctgaaaggaaaattttctatttaggttgagaacttgtgaaaagggaaattactactggagcactgggagttgctcaaattctttttcctaaaaggttcatttgaacttgttgggtcttcctccctgcccctgcccctctcagatcaatctataggtgtcttaaataaaaaataggcaataagtaaagttcagtaggctagggtgcttaaaatagttgagtgtggccgggcatggtggctcacgcctgtaatcccagcactttgggaggccaaggcaggtgaatcacgagatcaagagattgagaccatcctggccaacatggtgaaactccatctctaccaaaaatacaaatattagctgggcatggtagcgcgtgcctgtggtccaaactactcgggaggctgaggcaggaaaatcgcttgaacccaggaggcggaggttgcagtgagccgagatcgtgccactgcactccagcctgggtgacagagcgagactccatctcaaaaaaataataataataataattaagcgtattattgatagttattttctcattccattatatctgagttctaaatatagctgcctaaactgactcccttcctctcccaactttgttgataattgactgctggtcactgaaaatacagtagtgtgtgaaacttgccattttagtgccattagctttgcatactttgggctgtgccttcctcttccagaaacctttgtttgctcaagagaagcaggaaaatgccaattgccctattttagtgtgggattaaaatacatgtggtaaggacctcagggccccgctgttggctgggttttcagtccaaatagagaagaaaaatgtgggctgggtgcggtggctcgtgcctgtaatcccagcactttgggaggccgaggcgggcggatcacgaggtcaggagatcgagaccagcctggccaacatggtgaaaccccgtctctactaaaaatacaaaaaattagccaggcatggtggcacatgcctgtaatcccagctactcgggaggctgaggaggagaattgcttgaacctaggaggcagaggttgcagtgagccaagattgtaccatttcactccagcctgggtgacagagcaagactctgtctcgaggaaaaaaaattaaaaaggaaaaatgtttgt

SEQ ID NO: 51800 - DNA, 1028 bp, Homo sapiens
aacagagcgagactctgtctcaaaaagaaaaaaaaagaaaacaaactttcctgagttatgtatttcataatccattttagccaggcatggtggtgtttgcctgtagtgcctgctacccaggaggcagaggtaggagtattgcttgagcctgggaggcagagattgcagtgagctaaagtcatgcatgccactgcagcctgggtagcagagcgagaccctgtctaaagaaaaaaataaataaacaaaacataatcaattgtaaactaattattatctccatatttaagacagagaatgctttattatagtttccaactatagatatttactgaacacctgttatgttctagacattgttttatcatactctttcataaggctaaattatcccccaacacctttgctttggagtaaataatatcaatgatcttgatatgttgccttatgagataaaataaaagggactagagttacagtgtgagctaattttgtaatttttaatgtcacctaacctccatgaactttgataaaatggaaggattgcctttcagttttaaaattgtatttcctttctttgaatgaaaatcagataaatttggaattcctcaaagaaacttgtcttataggctgggcgcggtggctcatgcctgtaatctcagcactttggaaggccgaggcaggtggatcacgaggtcaggagttcaagaccagcctggccaagatggtgaaaccccatctctactaaaaataaaattagctgggcatggtggcaggtacctgtaatcccagctactcgggaggctgaagcaggagaatcacttgaacccaggaggcagaggttgcagtggccgagatcgtgccactgcactccaacctgggcgacagagtgagactccatctcaaaaaaagaaaaaaaaaagaaacttgtataaaaatgataaaaacaggtaatagacacagttttaataatttgatggataagttaagtgtctggactgaagggtttgctctttctgtcttaggtgtag

SEQ ID NO: 51801 - DNA, 1007 bp, Homo sapiens
tttagtagagacggggtttctccatgtttgtcaggctggtctcaaactcccaacttcaggtgatctgcccgcctcggtctcccaaagtgctgggattacaggtttgagccaccatgcctggtcgaaaaacggttatttcttaacccatattctcagaatgttattactttttgcaagacccagagttagtttttccttcaaaatttgaggtcttagatcattgttactggccaaggaggctagttgctcttccctttgctgtcggtcagtcagatccttgagttagaagaattgttggagaacaagttttctggtttacgattataccagaacttggctgccactctggttttcagtgaagagaaaaaatgtaatcaaaagcctttggggatgggcttggtatttgagctgtacctgtcgaattaaggtggctcacaagtggtattggaaagtgctgaagagcagatttcacactgagagtggaaacgaaattacaaagagcttggatgtacatgcctgaattgtttttgagctgctttcagtggaatactgatatttatgttttacctattacagctgttgagtggaatgtcatggccagctcctcggacagtgaagatgacagtttcatggctgtggaccaggaagaaactgtgctggaagggacaatggatcaagatgaggagccccacccagtattggaggctgaggagactagacataataggtccatgtcggagctgccagaagaggttttggagtatatcctgtcctttctctcaccgtatcaggaacacaaaactgcggcccttgtctgcaaacagtggtatcgacttatcaaaggtactgtggataggagaaaggtttatttattgatttcaaatttcactgatttatttttagactccaaatttagtttttttcctcccttaaatgtattatggttataaaatctagcattagacgatactacccggttttctttcttaccctggttagtttaatga

SEQ ID NO: 51802 - DNA, 1026 bp, Homo sapiens
accagagatttgtattaattctgaccaataaaatattttgacaacatctagtaacatataaaggtaggatctaccattttctggatatactaatgatgtaattttttttacatgtcccaggtagctgggattacaggcgcctgccaccacgcctgactaatttttggtgtttttagtagagacagggtttcgccatgttggctaggctggtcttgagctcccgtcctcaggtgatccacccacctcggactcccaaattgctgggattacaggcgtgagccaccacgcctggcctaatgatgtaatttctattataaaataactactgggcacagtgacttatacctgtattcccagcactttggaacattgggacaggaggatcacttgagcctaggagttcaaggctgcagtgaactataattgtgccactgcactctagcctgggcgacagagcagaaccctatctttaaaaaaaaaaaaaaaacccttgcgagctcagcacaaaggtgttctgagtagacatgtcaataaaccttacactcatttgaatgcctagtactaagaagacaaagatgcctaggccaatggtcctgcctccagggagttcagattccagtacattcattcagtcacgttggggaagctgagaaggtgtaacacaaatgtgaagggtgagaaggacttcttttaaacagtttcatgaaaattacattcattgagttagtatgcttacgtgtgaaaagtttgtagggcttcttttggcatgaaaacaagaaaaactcagagtttcaaaatgcctctatatccttgggggaatatgagtgatgattttattacctaatcatggaagtgaaaaagaagggctatgcaaattggtgttgggcatgtaattacagaggaattgcatctgagctcacccatgtgtgttctccttggcatctgtggctagggccaagttagcaaacatgccctcaaaggtatggggtttgatgtttttgtggagggtgtaacagttgaatggtg

SEQ ID NO: 51803 - DNA, 1021 bp, Homo sapiens
ccagaagccatttgattaaataaagcccttcccacgattgttaatgtggatcagaaaagatagtgttcgtgaaagtgctttgtaaaatgtaaaataaaaggtaaatgtaaaattgattattcctatttatgaaccacctactgagggccctccatatggcgggtgttttgggaagtaggtactaatttaagacagcttttggtctgaagttgcatatagtatggctggggagccagacaaggaaacccgttaagtgctatgtagtgttaagaagtgcactgaatccaaccaagagagtcaaggaaggcttcttggagcagggatggcttttccccaacctttcctattattctgcagagtctgcctttagtgagtgacttgctttttataaaaacttgaaaaaaaattctgtcatgggttcttttccccttttattcattcactgtcatgacagttcccacacagtatgccccagttatggcttctgcattctcaaaaatccagcagtcttgggaaaacctttctatatgagtcatatacacaggcaacaaacacaaacattgcagctgcaattaaaatatctcagattactaagtggtgacaactttagagtgatgatgcttttttgtttttgttttgtaaactagtacaagaggcactgtgtttttaatttgatgacaattaatacagtaaatatttaattgttattccttacaatgttgattataggtggttattagtactgtctcctttttcccaacaataaataaaatgagaagatcttaattcctttttgattgaagctgaccgcttaagtgagaattacactaaactttctttttcttttttatttttttgagaccaagtcttgctctatcgcctaggctggagtgcagtggcgcaatctctgctcactgtaacctctacctcccgggttccagcgattctcctgcctcagcctcccgagtagctgggagtacaggcacccgccccacgcccggctaatttttgtagttttttt

SEQ ID NO: 51804 - DNA, 1140 bp, Homo sapiens
ggcttctcttggcgagaattgtgtgtgcaaagggaacggtggagggtgggaacgaatttgtaagcgaagagaaaacgattgtgagatcttgatggtcgctgcagagtaacttcagcgctgagttcgtttgaaaccttcggtttgttaagattcagaataaccaattgctttgtctgttaaatctcccgatttctgttaggaaaataaaagcctcatttcttaattgccagagtctggatttttctgtggtgggattctgatcgatctagatgaagattctgacacattaccagttttacttgctggcagttgctggccccgacgttgaaactatgttgttcctttttgagaacaacttttattgctgtttaaatgctaattgggagacttcgattgtgtttctgtcatgtagggaagtcggtttgaagccttgtggtctctttcttgaggaatgatggcttcactgaacttgtgctatgcagaattgttgaggcgattgcttttgcttggacacaccaaaatatcttttgtaacaaattggctttacttctgcttaagaatgatgacatcatggatttaaagaggcaaggaaaatttgggggaagtaccatcatttagaattgaatatttagaattaagtctgtatatcttatggccattagtgatgctgtgttaaattgctaactttgagtgtattcacgtgtgtaatctgattgggtgtcttttctattgtatgttgtcattttatacccagtaactgtttgcttttgacaagccagtataaatagatgattcaatctacattgatccataggcatgttgcgtatcttaaaaagcttttcattgttaaaatgacaactgtttaggttattatttgaccattttctttctttctttctttctttctttctttctttctttttttttttttttttgcagtttctcactctgtcatccaggctggagtgcagtagcacagtctcggctctctgcaatctccatcccctgggtttaagcgattctcctgcctcagcttcctgagtagctgggattacaggtgtgcgccaccacgcccgctaatttttttttttttttttttttttttgtaattttagtagagacggggtttcaccgatgttg

SEQ ID NO: 51805 - DNA, 1030 bp, Homo sapiens
aggcgtggtggctcacgcctgtaatcccaacactttgggaggctgaggcgggcagatcacctgaggtcacgagttcaagaccagcgtggccaacatggtgaaaccccgtctctattaaaaatacaaaaatgagcttggcatggtggcaggtgcctgtaatcccagctactccggaggctgaggcaggagaatctcttgaacctgggaggcagaggttgcagtgagcagagatcgcaccactgcattccagcctgggtgacagagtgagactctgtctcaaaaaaaaagagttcatagtgttggtaatgagctaacccagctaggggaaggcagcagatgatataaaaatgtaattggaccagtggttattataaagcactgacaacctctctgatttccctgtatcttgcaagtttccttttattctttttctccaggtcaaggcatgcagctagtgggaagaaaatgcatcttgaataagttaaaggatgactggtgttctggattaagaattgaaatttatgtttactttctacccccatgagccagttatccaaacattgccccatcagtgatgctggatggtgtatgagtccataggaaggtgtcattaaacattaaataactattgcataccaggcatggaggccctgtttagtgggggagtcagacaggtccggcagcaccttcaggaagaggcataagtggggtaccatggctggatcagagaaagtcttgtaaagaagacgatgcctaagttaagatttgaaagatcagttgaattaagcagtggtaagtctgggagaggcaggtagagtgtagggccaaagcaggcatggatgaggaggccgagagacaaatacacagcattgggagggctacaagtatttccttctggctgaaggggagagggttggcagggttgagtggaaagagatgagaccacagaggtatgtaggggccagattgggaaaggcttccttgtacttggttctggaagcttgaactttgtcctgaaagtgcaaggagc

SEQ ID NO: 51806 - DNA, 1133 bp, Homo sapiens
atttttttctttttttttcttttctttctttctttttttcctttttttttttttttagacagagtcttgctctgttgcccaggctggagtgcagtggtgcaatctcagctcactgcaacctctgcctcctgggttcaagcgattctcctgcctcagcctcctgagtagctgggattacaggcatgcgccaccacgcctggctaatttttgtatttttagtagagatagggtttcaccatgttggccaggctggtctggaactcctgacctcgtgatccgcccgcctgggcctctcaaagtgctgggattacaggcgtgagccaccgcggctggccagttttaatatttttaatttaactcagtatgtccaaaatagtataattgtaacatgattattattttaaaatacgtgaattgtttaaaaatatgtgaagcatccctgtaaaatcaaacctggggtgataggacttggggtgtgtccctctctgggattagtcaggggaagtagaataattacaggagcattggaggtggccagtcctagtcataccaggccaggacactgtcactgctatgctactgatggaaacaaggcagagacgaaacagaattaaatcaacatggaggttgtttggagaagtccatggattgtacatctgaacttgaaatggccagtggccaggcacagtggctcacacataatcccagtactttgggagagtgaggtgggaggatcacttgagcccacagttcaagagcagcctggagaacatagcaagaccccgtctccaccaaaaaaaaaaaaaaaagggaaaaagaaatggctaatgatgcgggagacatttttatctgatagttttagaccagattttgctgttgtagattgcttctacctgtgaattctttgactgtattcccaagtgaaattgggaattctgattcccaaggaatcagaatcccatccatatttgtggtatgggaaacaagaccccttgcaggggagactggtccaccaggagaccctgtagcccagggacctgggcgccagtgtccctcccaaggcctgaagacataaggctagcatgggccgtggctggctgtgtgggagttcagggccggaacaggttggaagg

SEQ ID NO: 51807 - DNA, 1048 bp, Homo sapiens
tcatcttctgaaatgaaaactaacagagaaaggcaaatcatttgggaaaagttacttaaatggtaaccttgttgccaataaaagagtattttctaattcaaagtccaaagcaagggtccctcttagatctctgttcaatataagattgctctatttcttgggagtcgtgttggtgacactggagaccagaggattccggttctcagagagagggatgctgtgatggagtaggacagtacagtcttttggcttgtatactgaggcacagagtggggaggcctgctgtccttggggagtgggtagcagcagatcaggcaccagaaagggtgagacaccccctctgacccttgtagtgtaacaggtgtgagtttgttcactttgtctcttgtgagcttggctagttcgaatcagtcccccagggcatcatcaccccaggctgttgtgtaaacattcgtacctgagaaggtacaactgtaatggtgcttatacttgctgtgctttacactaagacccagaatagcctatttcttcctctcctctgcctttctcacctttcttttttccttgtcatcgacctcttaacgttacaggagtaaacctaccactgtaatctgcttcaccttacagacacatccctatcttttgtcacctttgttccttttgtagcttgtgacagtaacaaactgggttgtttgaggtgaccccttccctgctctcctccttgggaatgatcttatccgcattgtactcctaggtcccataccctaacttttcagccagaggcacatttatagcaaggttaagggcatcagcagccagtgaagctgagcttcctcctctggtgagttaaaattgcaaatgttgacatctgatcccattcaccttgtggttgtggctctcctttacctcccataaaggaccagccctgtcgagaaccaccttcctccccactgtgcttcttcatgatttcctgcctccgctctttccttctggctttgcttgttctctgagaccgagaagcttgtgtcccatttctgtagatgtgtag

SEQ ID NO: 51808 - DNA, 1020 bp, Homo sapiens
ttactctaagcctttcggtaggtgccagtcacagagagttcaagtccgtaacagtaaaaaatacattattaaaatattagatatgaccataaaggaatgtaaaagggagagtttattctgaggaccaggtgatgcaccatgctggtgggatcagaggagactttataaaggagaggtagacatccaggctgggttgtgcaggatcaatgggagtttgcaaggggaggggacattgcaggcaggtggaacagcatgctgagttctgggggctagtgatagcaaaacagagacagaaggtaaaagaaggtatgggtgaggcatgctcagaagctttgactaggtctgcaagcagttgaagggtttaaagtagggaagtgacatgatcagatttatgtttaattttttttccaactctttatttcataaaatagagtaagtgttcctaagtttaggtttagaagttgatatgagtggctctgtgaaagacagattacaggtcagaaaactggttggaggctatgcaaagaacccagctgaacaatgaggtttagaactgtcatggcggccatggggctagaagggagatggacctgcagagggtatcaggtccccaaaccccaaaatctagtccacatttgttatgttgaaggacacagtcatgtccctggctagagaaaggacactgcccttagctccaaaaataaagactaagtttttatttgagagagattttttcctctttttatatacatttttttcctctaggaaatagacagacggttggaaaaaaaactgaagatcacacaaaaagagaggtaaggctgctgtctggtctgagggctcatgctctctgtggtttgagagccgggcagtcagtggtgttctccagctggccattaggattagcaggtcctagcaggtcaggctctggggcagcaaacccttccctccaaattggagaccaggacgtggtggcttgaggctttagggttgaggctggggtgttgcacctgcctctga

SEQ ID NO: 51809 - DNA, 1049 bp, Homo sapiens
gctgcgtgtagagtagtgagaagcaagcagagtcagggtaggaaccatgcagctccacttgctgatcccagcctgctggcactagttcactgtgccgcattggctggagagggctctgaaagccttgccagggaggaggtggcagtttgctggcatgctccctctgcggttggtagtcaccgggggcactgttgtgtagagagtgaaggcacagatgagcttgtgtcaaaatctgcctcttacctcttctttagaacgacttgacctctctgggccttagttttctcatctgaaaaaatgggataataatagtaccaaccttatcaaggtgttgtgcaattcagtgagtaaatgagcataggatgtggagagcctgggctggcagagtggaaagtaccccagataagtgctttgatgatattttctgggtctccagtatgcccactgtgatgtttttgtgaattttctaaattcctttttactcttaacatttttttctctgcagtattaaaggttgcatcatataagtttatcactttcgaatcaaacagtattcattaagatggcctccttctaactttgaggggctgctatggtttggtattctgggacttgaagaaaaaatctgcgtaccttctttctagctcttcataattttgaagagatacctgttctttttgttgtttctcctctaagtcttcacctttccagggtggaaaaatagtcatatgagtcaaccgttaaccgcagagtttggagaggagtgggagggaagaattggggggcgggggatgtgtccctctgctgagctcttgattccagttctttactttggcctaacactctggagattccaaatggttctgcggagcatgtgctatccatggtcactgcctctgggcagagtgggccctcaagcactccccctgcctacaagtgcatgatggcagctgagcagggggaaaggatgctgtagctgctagaggtgaatgtgcaccaccgaccctgcctgctcacaggggcctctcaacttggaggtgccctgagtc

SEQ ID NO: 51810 - DNA, 1028 bp, Homo sapiens
cttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgtcagatctttgtcctcatttcagtccctgccctctacctcttgctgtggccgcttatttaaccctgggggatttccctctgcccagtcccagggaaagactgtctttggtaaaacacgaggccgggtggtatgtgggttgaggggaaaggacccacccctcttggggctcccagagaatgagagccctgggtcctggggctctgtcgggggagcatgcagaggccacctcctgctcttccacagggcctgtcttagagccagtggagagagagaatggctgcttttgtggggctcccagtccagagggggatgtgctcacctgaggagaggcctagccctgtgctttgagaaggcacagaaggtcaagactgcacgcaggggcacctgtagcagaaatcccaaccccgcgcagggctttgaggtggaaccctgcactctgagagcccagtggtggctgggtgacaac

SEQ ID NO: 51811 - DNA, 1005 bp, Homo sapiens
agctaatttttgtatttttagtagagacgggatttcaccatgttggccatgtaggtctcgaactcctgacctcaggtgatccacgcacctcggcctcccaaagtgctgggattacaggtctgagcactttcagcttgtactttcctgtgtgccccatgttttctgcattgagtatgcactgcttgataatcagacccagacagtgacttctaataaccacgcctgggctgcaaggcatggacctgctccgaaggtccctgcccaccctactcctctggcctccacaggagatggtcgtgtggacttcaaagacttcttggctgtgatgacagacaccaggcgcttcttctgctctgtgggtgagcagggatgagcccagcgtagtcagaactggaggaggggctgggaggttggttgcggggagagaagagggcattcaggactgcccagtggtaacggcagccactatcccatgtctccagaacagaacgccctgtcggacatggctccccacaacccccacactctactctttgagatcctgtccctgctggtagagatgctggccttaccagaggcagtcttagaggaaatcacaaagtgagtggggccggttgttgggggtgaagggttgtggacacagaggtggcatctagcattttggcactgagaacttttggtagttacgacttttagtcacaagtgaaagaaactggaggctgaggcacgagaatcgcttgaacccaggaggtggaggttgcagtgagctgagattgagccactgcactccagcctgggtgacagagtgagactctgtctcaaaaaaaaaaaaaagaaaaaaaagaaaaaaactagaataaaactagcttaagcaaaaggggaatgtatggctcaaatcactggttgggtcctcaggtctagtgggatcccagagaccaaatgataccagtaaggctttctctctccacctatccatgtctgtgcgcactggctttgagctcagct

SEQ ID NO: 51812 - DNA, 2290 bp, Homo sapiens
gaggctgcgtataagtttgaatttctacaattagtttgtggcacactgctaataataataataataataataataataataataatataaagttctagccaactgattattatagaaatactaaggcctacttagagaccacatgaggttttggaaacatgcaaaccgtaagttaaaaataattttgttttgcattataaaaggactacaaccatagggccacccaccacattgaaaaccagaagagcattttgctgccgccgagcgtggacgcaggcggatctccgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaatagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgcaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcatttgaagaaaaaaaataagtctgtttgtcatatttaagtagcctgtggctatttttatactgattttgatatcatgttcttttcatagtcgtattttgccaccgtaaacataaaaaaaaaaaaaaaagatttccaaaatgccgttttcagaacctgggttttaatagcagtattgaatttgtaagcttagtagttgcagaaattgaacactaggtggcactcagttatcttaacaggggaagtactgatataattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccaatttctgaatgaaaaagctacagctgagaaataaaataaaatgtcatgctgcagaatatgttatacccttattttgtgttaaggatatattttattatgcgaatggttttgtttttgttttttgtttttgttttttgcttgtattgggaattagctttactggtaacttccttatttagtttttagtggtcaactctaataaaatgaaactagggctgagctagttagccctcactagccaaactgaaactgtatgcaacattaaaagaagagatccatcatgtagcttgtgacacttttattttattagtcaccggggaacttttcagtgatgaaaatacacagggtaataaaccttcacatggcttcaaaaggaaaacaagcaaat

SEQ ID NO: 51813 - DNA, 1054 bp, Homo sapiens
gggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgagg

SEQ ID NO: 51814 - DNA, 2278 bp, Homo sapiens
aggccctccaggatcgggtggattccctgcagagacaggtgggcccctccccaaatcacagccacagtgttcacatgccctgtgccaagagctttgtaggcactacgcagtcccccaacaaccctgtgaggcaagtattacccacatccccatttcacagatggacaaatggaggctgagaggtgatgtcattgtctaagatcccatagctagtaagaggcagagccaaaattagaattcaggactatttgatgacagcatctgcatacataggagtcatctgggacaagttagagatgtaggtttcactcatttccctttttgccttgactgctaggaagctcagctctaactggaatgttaaataatacggctagccttgcctgaacacccaacaaggtcaaaaataaaaaaattttagggtcgtggtggtttccctttctcttccacagcagagaggagagaggagtgaggacagggaggagaccagggagtctgagacaactaggttgatggcactctgggcactagtagttagccagcaatgggatggggcccaggtggcagtaggctgagccagcaggagtgcttaggaacactgggtctcaatgatggaggcccagagagaagtgggaagggtgtggattgggcatgccaggtggaggtcacagtgggagcagaggtatagaggccagatgggaacagccccgattgttctggctgtcctcctgccaggtggccgacagcgaggtgaaggcagggaccctgcagctgaccgtggagcggctgaatggggccctggctaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggtctcgggcccagggtctggctggggtgggcccagtgagagagtcagccagtaagagcaggcttggaggggggccctggtagagagccagccaatggggcagtcagttggagccaatgagagcaggctttgaagggagggcgtgggcccagtagaccatcagccaaggagaagaggctctgggtatgtcccgtaagaagacaaggctactggtatagacttggggggacccaggggcagggtttattggggagagttggggtctgagtgggtcccaccttatgcaggtcagtggataggccgtggatgggtttggtgtgcaccccaccctccaggtgagatgactgcctgttttatgctctgtggacctgtccagaggtacagaatagagaggactccttagggctcccaggccagccaggcaccatcagcccctgtcccccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgagggccagggtgtgccccctctgtccccaagactgtgaggccctaggatagggtggggacgttcccacccatctcaacctcatcccaaaccctggtgcagcctccagtaaggaaacatggttcattcagagcatagtcctgttatacagatggagaaacagactgagagagacaggtttggcttcaggtgacaattctctgatgtgggcctcaccgtcgcctgctctgtgagtgggccagcctcattgtccccaagcttcagataagtatgctcaggcccagagggattcggggcctgcctggcttctgttgcaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtaggctgctccccaggctctcccctcacttcctctggggcctaaccgtggtggatcccactgcacatccccagggtctgctacctctggtggggttaggttattccatcagggttcaggaacctgagccccctcagtaagctcctcctggcaccctgatctcctgtggctctcctgcctaggtggagcgggagaagcttcgtag

SEQ ID NO: 51815 - DNA, 1044 bp, Homo sapiens
aatttagcctccagccaggcacactggggacaggtgggacctcctggagctgcctggggggcctggtgatgccagcctacggcagtcatactgcccacactgccaagagcccacatgggcaagggccaaagacctccagcccaccagcaccaccccctactccaccccaacttcagggcgtgcctccatttttccagctgtcaagaaagcccttaccaagaggcccaggctctgtgggctccagctctgcatttcctggttctggtgtggagacagaggtaggcagacatcactgggaggggtctcctcagggcaaggggagtcacctctcccagccctggcagacccccactcccagggttgacagggtggggaggggtgaggcaggagctgagacgggtgggagcagggtctggggcctacctggggttggggctgggatgacttcctgttggacttgctgctgggactggaactggaactgttcctcggagggccgaggagtcacctctgcagccaggggaggataagggggtctgctccctctacccctcccagggggtctccccaccccagctgccggcccgtcctatcctacccctagcccgttaccttgataatcatagtagtctgggttgtctgcaaacaaagatgaaagtggaattggtgggagtaaggctaatcccccagcccctggggcaaacaagttccctcctgagccagggaccaacccccagagttcccatcagcgtgtccagtgcggtccctggctgagccaggcacatctgagcagccaggcctcggtgacccggcaaggcccttaccgatctggtcgctatagtgggtgtactggacgtggtcagggaacggcggcagcgggtccaggtcatactggccctgagccagcaagcctgctgtggggaggcaaagcatgtagggtaccccatcgggaggggcaacgggggcccgaggcgcttctggagagtggaggcgggggtcacaaggtcaggcccataagagcctaggaccccacaagcagattcc

SEQ ID NO: 51816 - DNA, 1602 bp, Homo sapiens
gaggcctggtctcatttcctcttccccaagccctagcaagcaagctcaaatgttgcttcacggatgctgaggctgggagatttggagtgacgtattccaggtcacccaacagcttgtaagtagcaaagctagagtttgaatttgagtccaccgggctccaaagcccacattcttaacccaccattcagtctcccatgaaggaagtcttccctgagtctagctcaaatctctctgtgagccaaagcccccagacaccaaacttccctgcctgcctgccaggtcctggaggaagagccggctgcagactcagcatttgggacccaggtcttggcagtgatgagacccccactttgggagccccagctgcaggcaatggtgagctgaggggggcctgttgggtgcagggcagaggggtgggctccccagccagcacctcagctgcctctccaaccctgcaggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacaggtgcagggggaagcccctgagtccccctggttgggcattggcacagaatggggtgggtacccagcctctgtccctgccatcccctccttgtgacacctgcctctccctggcagtgcccaccgacttcgcccagatgctgcagagctatacagctgctggctaccgtgtcgtggccctggccagcaagccactgcccactgtgcccagcctggaggcagcccagcaactgacgaggtgggcctgtctcctgtcccacccactctgaggactaggcagagggaggctctcacgcaggcagagcccaaggaagatgccctgcctggtggctgggagaggggccctggccactgcatgacctctgatccaggtctgcccaccctccagggacactgtggaaggagacctgagcctcctggggctgctggtcatgaggaacctactgaagccgcagacaacgccagttatccaggctctgcgaaggacccgcatccgcgccgtcatggtgacaggtacaatggcatgtaggggcccgggctagcagggcagaatccgccccttcctggcagagaagaggggcaccagggattcctttttggggcatctttttgggcccttgcttcaggccaggtcctttttaaacatttcgtgaatcttcacaatatcccccccgcaagtggtaattgtcacccctgtttgacagatgaggaaactgagactcagaggagtggagtgacttccaaggaacccatgtgcgctgtcagacagcctgggttccaggtggcacctctgagaaatggggataatgatgtcagcctcagaggctgtgacaagctcaaggagcaggaagagaaagattctggccgggcacggtacttcatgcctgtaatcccagcactttgggaggccaaaggagaaggatgtcttgaaccctggagttcaagaccaacctgggcaacatggcaaaactccgtctctacaaagaat

SEQ ID NO: 51817 - DNA, 1141 bp, Homo sapiens
tgagactgagtccatacctctgtgttccaggatagttcctggcagctcttcactgtccaggtgcagactgaggccatcggcgagggcaggtgaggcagccccattgccccttcccagaagcccctgctaccctggcctccccaacttccccaaccctcggcccccccataaaggctgactctggcgcctcccatcctagggagggaagatggctctgtgagcacagggaggtgccagggcagctcccagagctcgagagtaaccctcacctgcttccccagcctggagccgtccccacagtcccaggcagaggatggccggagccaggcggcagttggggcggtaccagagggtgcctggaaggatacggcccagctccacaagagcgaggaggcggtgagtgtcggacaggtgggttctgaaaaagtccttgcccctctctcggcctcggtttcatgatctgtgcaatgggagagtcagacttcatgttctcccaccaccttttagttctgttgtcccaaacatccaggatgctgtctgagcacgtttacactttcaggcctctccccacctctctgtctggtgacaccagtccctgccccctacccccatccctcggctcccagcataagcacactgcttctggggccggggccagcttccaacccatcctctcctctctcccacccagaagcgggtgctgcggtattacctcttccagggccagcgctatatctggatcgagacccagcaagccttctaccaggtcaggtaggagtcagggcctgtgtggctcatgtcacctcccagagtggcactggtttgggcacagacggtggcatggcatggcctgggctcccctctcagctctgatgcttttgctgtctgaaaccttgggcaggttactgagcccctccaggcctgggatctctgtctataaatagggcatgaagataacttctgcctcctaggattgttttgatggtgaaatagataataatttatgtagagcttggcaccgaatgtgatctgaggttgtgacaccactgtgaatcagactatcagctctgtactcagactgtctgcttggggtttagtcactgctctgccacctacaaaaggcttaagaaacatgagctca

SEQ ID NO: 51818 - DNA, 1333 bp, Homo sapiens
gtttttaatccatttctgttgtttccaaactcagaaagtccggtttgtgtttgggacttgttgggcagattgacccagtgtggcaggtgtgaaagtgcaggaagccagagccagctgccggggccacatcctggttctgctgcctatagtggcacgtccctgggcacatggcctaactcactctcctcgccttggttccttacctgtaagtggaacttgctggagtcacctcacaggattactgtgatgatcagttaaggaaagcgtgtaaggcgcagggcctccgtcaggattggcagtggcagtcactggggatgatgttgatgttcccagtgaaaacctgagggcccttctgctgagcccagggcagaagcagctacagactcttgctgcttcagcccctaggcttttgaatctctcccgtcttgacctcattccaggaagctggaatttatgggagttgtttttgtgttcttgttttctatttcttttttagacaagtgagaggttcttgtttattaaagggaaagtgcactatacgtggatttaagaaccctgggcagatgtttacatttcacttgcaagatctttattaatctgctaaatatctgcaaatcaccccttggattttgctaagaaaattcacatgcaagtaggcactttgttcatgcactgaccccaaaggtaacatttaatcagctgaagacatagcagagtctctcccgtcacaagctcctgcctctcttttctccccatacaggacgggctctacgagtgcattctctgtgcctgctgtagcaccagctgccccagctactggtggaacggagacaaatatctggggcctgcagttcttatgcaggtgaggtgctccttaattgctttaagagaaattgaaactcaagcatccagaagtccaagaggacaatagattgctgtaagccagccattctgaggggcctggtttccttcattgccatccagtccaaacagggtaattggttgcattgtattcacttgctttcggtaaatctggggccttgtctgcaaattgcctttgtttcagtgcagtgagggtcaccccaaaggggtgcaaaccatgccttgcagatgtttaaaatgtatttccgtttgcctggtggtcagaggctccccctctccctctcataggatttgtaacataagacttgtagcgagcaagcaggggagaaagcagtgtctttgaagggcagctgcccagctatgagattggaagctgtttcccagctaatgaaagcctggatttaggggttgcttagaaagaaaatagtattgatgttcactgcaaagaaag

SEQ ID NO: 51819 - DNA, 1733 bp, Homo sapiens
tgggaggatcacttgagctcaggcattgaggactgcagtgagctgtgattgcaccactgcactccagcctgggtgacagagtgagaccctttctttaaaaaaaaaaaaaaaaaaaaaaaaaaaaacaggctgatttttcttcaaaacacgtgacacatggagctagaactgctgtggaaactccatggtgccagcagcgcccaggcctctggcctcctccagtgccatacttggcatgtggcttctaacctcaaggttgccacatggtcatagagtagtttttggaactcaagccattagaaccacattcgaggcaggaagaaggaaggaagggagaaaagccaacaggcacctctgtcagaggaatgttgcatgtcagtgctgcccctgatggcacagcaaggaggatccagaagaaagtatttggggcaggactgattccggatatgggtgaggatgtgttaaatgtgtgtctctttcaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgtgagtttctgcatctctctggttttgtttttatttgcatggggggcagtgctatgtgtgttacgctattagtttttcagggcaggatttgtttgagtatttaaggctcctcttctagtcagatagtaaatagatgggactgtttcctatattatggcaggaggaggaccacagtgtcactgagagattaggaaaatctccagatctgagacagtgtggccagagtttaattaaagaatttgaatggcagaagataaacgcctagaaaatcctccagcagctcatttggtgaggtttgtttgagaataatggggcacagaattttagaattggaacattcccagaaatgaataatttggccataactacaaagaaatcatgtggaaaatgccagttgggaaagcaacagctgtttatgagtcccactttaatttctacctccctatatttgaacacctttgctgacgtggtgttttcaagggcagaaaggactgtgggattggcaggtttcccaagtaggtgagggagaggtttcctaaccatgcttaacattgtgaccatttttccttttgtaatctttgcatatattcatgacaaaggaaaagagtctggcttctgcctggcatagagtggacgagtagtcagtgtccaagaaatggggtaaataaagctgaggtgatgatggaatctgatccttttcttcttcttcttcttcttcttcctcttaaccacaggatttgagcaacttctatgcacagtacaaatccattgagccttatttgaagaagaaggatgaatctcaggaaggcaagcagcagtatctgcagtccatagaagagcgtgagaaactggtcattagtccctatttattgtttcaatctgaagaatttattgcaaagatgattgccaggagtgtggcttggcagggaacataagctgatgcaagccatttagtgtattctggagaggaactggcacaagggtggggcactcatcctcttagggccgggtgagtagtgtgaacccgtgaatggcccagagtggaccaaggagctagagccctgtgccccgcctgcaggggcgggtggttgctgtgtggctactccatcttttt

SEQ ID NO: 51820 - DNA, 1099 bp, Homo sapiens
attaactcacctccagcaatcctgtgggatgcaggtgctgctctctgcactcagtggattaaatgcctaggcagaaattaaatcatttgcctgcaagctggtaagtggctcagccatggtgcagaccagtctcttggctgccaggccggcactccaggtcccacgcccagggatgctccgcttagtaccatgtcactgcccttgtatgttctaggaggctcacagtgatttgactgggggactgtgagtgattgggtgtcttttattctctgtactatgtcttctcttatggttatgtattattaattactatttaaaactattgtctacatcctaaaaatcaaactaaaatttgaaataaattatttggaaaaactttgcagggagcttcagaagtaaaaaacaaaaactcggccactgtatggaagttgtgtcatacttgtctactactactttagctttccatttcctagaaatgtgtttgcactgtgatcatcaaaatagaactgtgcagtacttaaaatgtaagaatctgcaaaaacaaaactacagaacaaattccgaaggtgacctgagaagaccaaatggataagctaatacatccaggtgtctccgattatattatgataaagtgtagggaggttgaacgttacataaataccactggatatttttctttgttagatgtggccccatggtattggatgctttaatcaagattaagaatgaagttgactctactttgaccttccgaagatcatgcagagaaggtgagcatttcattcctgttgggctccagatacttgtggtcttccaaagaggcttgggctggccaaagctgatagagacatctggaaaacagctgcagctctctgctgggtgaacttgctgtgcaacctaattccttttcttgggtaaatgcatccaaaattctaaccatggtgcaagttctggtttctgagtttactttccttcaggagcattctatcctgtggttactgcatctggcggtccctgtgagctgctccacgcttcaaggcctagctaggacctgctggctggcaccttccatgctgctgagctcttttattaagggagc

SEQ ID NO: 51821 - DNA, 1022 bp, Homo sapiens
atagcaagaccctgactccacaaaaaaaaatttaaaaattagcctggcatggtagtgcacacctgtagtcgtagctactcagaggctgaggcaggaggaccgcttgagcccaggagtttgaggctgcagtgggccataatcatggcactgcactccagcctgggcaacagagtgagaccctgtctcaaaaaaaaaaaaatggggctgatatcggtaagaaacctgcctgtgatgtgcagagactgcctatggacacctgtgctgccatcatcagtgtgaggggaggaggatgggggaccagggaatggggaacaagacagacgttcttcttcctttgtgctcttgtgtttctcgagttttctgcccatgtgcacaaattgtcccctggattcgtctaacagttctccttggtgtccctgcaggatgaaattgagtttggctacatcgaggccccccataaaggcttccccgtggtgctggactctccccgagatggaaacctaaaggacttccctgtgaaggagctcctggtaagatgctgagggccacttgcgggtggagcatgatcctggagattctcataagacagagtggtcaggagaccctgggccgccttgacacattcatctgctgcccagagcctctgtttctcctctgcaaaatgagtccacttgggatagctgcctctgaggtcctttcctgctctgataactgatgtttttccaaaacatagagagttttctagtgggaaatgggaactaagggaaatagagttaagacctagttccagaggccctggcccctgctgctgcccttcccctccaaattgcagcaaaatgagttaagtttcaaagaggaaaaaaacatagttatgcaattgtcaaaagtcatggttccaacttccaagttcatcagcactttgaggctatggtttttggtgcgtgtgtatgtgtgtgtttgtttttgttttctgagacaagagtcttgctctgtcgcccaggctgaaatgcagtggctcactg

SEQ ID NO: 51822 - DNA, 1068 bp, Homo sapiens
gctcagggtcgggtggctgtcctggatgacctgtgggactctcttcctctccaagccacgctttcctcaactgtcccttccttgtgggatgcaagaggccacggcgagcgaaggcatgtgccaagagctgccactcaatgtgagtcagcgtgctggtcctccctccttttctccagggggcctaggacttttggggggagcctgaggacatgcttcgctgatgtcactgtgtggagtgtacaaatggccaccctgctgctcgttggttctatatgggcatccaggctggagagcagggggtggggagatggagatgccaccagcaggggactggttcctagaagagagggcgagtttgggtggtcccagaggtgttcttcccagaaaagagagcaggaggcaggaggtgggcatggagaatgtggaggggggcattgacagtgttctccaccacccatcagataagacctggagcctcattaccaaagacttaatgagattcgctttgttttcttatgagccaggcaaggtgccaggggaagcggcttccagccccaggctctgcagctggctgctgtgtgacccagagccaggcaccacacctctctgggccttagactccttatccatgagcttcctgcctgcaccctaacattcagtgtcattggccgagttacccaatggctcccagcctcagtttcttcatctgcacattagggataagtacagccatccacctgggaggtgtcaagggggtgtggccgcagcacccagcccatgcacaagttcagtgatcattacctgtctcccccagccctgcctgagtgccaggatcagcaggcttgggaagggggagcccccagggatgtggaaagtggagagggagcacatgggctctggggcctcggggctcctgggctctgttctgcctgtctgggagctgtctcctgctctcccttgcagtgtctctgtctctcttcgttctgttcctccctctgtccttcagtttttccctctccatctcagtctctggttgtctcagtctctctttgcacctcactgtctctg

SEQ ID NO: 51823 - DNA, 1064 bp, Homo sapiens
tacatagacacagaggccagacacagaggccagagcactgattagacacctcagtgcgccaggcctcacgctgtgtgcatcacacgtgttatctcatttgatctcacgagagatcaaatgggatgactctcacccacctttattcccaagaatgtgaggctcagagaggggatgtcactggcccagaggcctcagcaagattgcagtggagctgggactggaccccagcttcctgccttaaactggggtgaagcgggcgttagacctgcagatgggtcaggggagccctctcctttcccttggtcaaggcttgaggccctgtgcgagccctgggcttgggtttgaatcacaagcccccacatatcctacctgtgtgacctttggcaagtcttctgacctctctgagcctcagttttctcatctgtaaagtggggatcataatgcataccttgtgggggtcaccgtgagggttaaatgagatgctgaacctgggcactcccctcggggcctgctcatggtaagcgcttactaagtagcagccatgaggattgtgtgccattgactctagcctccgcttccctgtccagtctcatctgcatgggcacaccatcaggctgagaaaatctggacccctgggaggtccccatttcacgcagtcaccccctgaagggcaggattggggctggatggtgtctgaatcccaggactggctggttcgctgctcagtgaacctataaaacctgactgatggtgggtgggtgggcagcaactgacccagctccccgctaagccaaagcaagaggattcctcatccagtgccctcgggcagttgtacatttccagtgacaggcgttaccacttccagtgaactcaaataaaggtctcagttcattccactgtggcaaccagaccctcccactccttataccccaagatgtgcacagtggccaaggcaagctcagacaggtggaacccacccaaggcctgggaaagtcagaggctgctgactcggcaagaccattagctgtgaacttggctcctgcctgtctgcttccctaagcagg

SEQ ID NO: 51824 - DNA, 1149 bp, Homo sapiens
tcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcttggattttgcatttctttttcggttggaacggagctctgtttttcttaactccttatatgtgtacctcctaagccctggcacccacagaaggtggtgccaggagacatgtggccccaggggagcttccaggtttaaactgcactggttgaagtgagtggatcccccaactctgccccatgaaatgctaggggagtgggacagagtcagtacctcagttgtccaattcagaagtggagttctttgcattttcactggggctttgagaggaaaaaaataagtcatgggaggcatccagcgcggtgactgcatgtgcacccactccccagacttcagcagggggctctggtcaggccccggctgtggcttcaggccagtgctgctctgtgcaggcattgtggccaactgcccaccagagggcaccaggaggct

SEQ ID NO: 51825 - DNA, 1536 bp, Homo sapiens
ttgtccccccaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaa

SEQ ID NO: 51826 - DNA, 1784 bp, Homo sapiens
attgcccaactctcaggagacatagccctgttgcttctgattaaggaaagggttaagacttgtaacttaaataaataaacagaacaaaaaaggattggaaaatggagtccctggcagagaaaatagcaaactgggcttattgaatgcatgccattttgctacacttgctcctgttgcctcctcccccactgctggaggcgggaggtagaggatctttctgctggaggcaggcaaaggatatttctttggtttttggagacagggtttcaccatgttggccaggctggtctcaaactcctgacctcaagtgatccacccaccttggcctcccaaagtgttgggattagatgtgaaccaccgtgcccggctggtaggggatcttgaatgttgctgttcctttgcccttagcatttgcaccaggttgtctgcacagaaacgatgacccctcttgttgcctgttggaagtctgtttgttccaaccctgtgttttctttccttgcagctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggttagtgatttctgccccctggcttatcagtgctctggtgcggaaccgtgtagccattgtcctgtccctagaccacgaaccccaattctctttacctcccagtgttctttatttttttgagacaggaactcgttgtgttgtccaggccggtgtcgaactcctgggctcaagcagtcctaccaccacagcgtcctgagtagctaggactgcacaggcacgccaccacgcctggctccagttatcttttagacagaacacttgtttgccatcccgtcctcttttcaccctgataatactgaagatgagactcagctctcgatgtctggtcacgctgggaacatgttttgtcttcccttaggtggtctgtttttctggggggccaccaacacctcccgtgaatctaccatgtacccaaaagcagtgcaggacctctgcggctggagaatccggagcctggcttgtgggtaggtggcagcatctcctgtgggtatgaggtctcttcctttcatgggggtgtcagacacacccatggggtgcccctccctgatggggctctgtttctgctgcctgttgggctgtcctcagcaggccatctgacacactgaatcccagagtccgggggtacaggaggggagagggcccatttgctgctagaacagatggctgttccctgtcttgtgggaagaaagtcattttgaaggtttctgttcaaagaaataaacaagcagagcttgatgtattcctacgctgcaggttgaaaattatacgtagttggaaacgtagcaggacttgagttgctgtgacactgggaagacgacattgtcttggcagcagtggtttgtagttcatttcaggacacctgttgagttagctagcacttcttgctgaggagttggatttatcagctggcaggtgtgggtggaacagtatgaggggcctctgtcggcgtggctttaatctgttgaaggctctagccctgcccaaatcattatgcatgaaggctgctccctctggaacaggctttcactttatcctgatctggtctcctcttcccaaagcgacctcccactgagagagagctgtgcaggatgcacagcaagg

SEQ ID NO: 51827 - DNA, 1100 bp, Homo sapiens
tcttggtcttttaggggctccttgtggtccctccagtggggtagagatcttacttgatagaccattccttgatcagcagcttcaacttttttgactgcaacccattgtaagaaataagttttcttttgcaacccaatctgaacgtataataccttacctggaattgttgtaacatggtgccattattatgtgtagagtattctttgtcattctgttctattcgtttttaaaaaataactggtcttagctcacaaaattgatttcactgacccactcactgtgctgtgcctaagattggaaatgctgcctttgttgaccaacgtgtgctggtctaaggcccagaagggccagattggggtgctgccggggctcactacagagtccgtgtgagcacactgacacgtcccttgtgcttgtgctgctgctgatggccggctctgtggtctctacaggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacggtgaggctcggcttttctcacttcctgagagtcgcaccaggatggaaggggtgtttatgctcaagtttcctgacgcttggctttggctaggaactgatcccaggtagacatctgcttgcttcttcaagagggctttgcaccttggccaaagggtccttggtcccagggcagggttccctgtcactgcctcctatgttaacttctcccgtgatttaaatagacacatcttaaacacgtagatgttttgccgccctcacctgcaccttaaggtaagcactttctgcttttggcttttatctaacataacatcacagacatctttccaggtcagtagatggtgccccatactggggatgtgagtcgtttttaatcagtaggttgtcccccccgcccccccccccttttttttttggagacagtttcactcttgttgcccaggctggagtgcaatggcgtgatctcggctcaccacagcttccac

SEQ ID NO: 51828 - DNA, 1074 bp, Homo sapiens
tctttacatatcttctaagctttgtgttctagaaatgccttcagcttttgccttcagaattactgagtttattaaacttccgtttgtaacctagtaattgtttcccaccaacatgcagagaggtagaggctttttatcagtctttaaaaaaaatgaaagtctcctttcttgtcttttcagataatgtacaacggccagccaattaccaaaatggcctgtggggctgaattcagtatgataatggactgcaaaggaaacctctattcctttgggtgccctgaatatggtcagctgggtatggaagtacattttttaaaagctctgtaatctaactgtatatattcagaactagagatcagtgtggggctgcacacacgtgttagaaatgtgggtaattgatctcagataatagcctttgtccgttaagtggatctcacgttcagcagaacagcgcgtcctcattcacaggattatggagtattgcaacactgcctcaatggaaaagttgggactggagtcctacaaaagatttctttttttctgatttgggaattcatttatataaagggatttcaaagttaaaaaaaaatcagaccaccttcattcaatttcacatttaaagattatgcctttattgaaaatgagaaaattacggaaaatgaacgttgttctggaaaccctggcctgggcgattatttcgggttgccacgtgaggagccctggtggaccccctccccgtgcgtcatccctagccagaatctagttgtccagaaacttgtttcttcgatctcattggtggaaaaggagaattcaggcatcagttctcagttagtggggggagtgtcttccgacctgatggtctccattctccttcccatcggaccctaagtgcggttccctgaagtgcgcttcccggttgtggctctgcctccactccagcccctctggggaggcctccgcgaggtgtggcgcgggcgccctctgctggccgcgcgcgctcctgcagccgcagcgcctggcagatggaaaaggtaaaaatagcgccgagcccgctggccttagcctcggggaaca

SEQ ID NO: 51829 - DNA, 1054 bp, Homo sapiens
atacttcagtttgcttttttggagttgttcggctttcccttctgtttttcctcacctgggcactcgggatgggttccagttcttctgttagcctctgtccacggcactgtcctctgcagccggccggcccattcctgcccgtgtcctcttccagatcattccaatcatagggtatgggctaaggctcattttatccccagcccttttggtgactcccggcctctgcctccagcggggcatattggcgtttgtccccaccctttgtcgctggtcctctggctagcttttagtccatatgactgcatttttattttgggctgtttgaaccgttttttgtgatttcatgagctgctgtaccaaagtccaaatatattaacatctgttgtcttccctgcacatggctaattttgtaattctgttgaaaaaagctaaagtgtgtctggcccaaatttatactttatagtctcttgatgacatgctgacattgccacagtttttgttttctcccggttggcatagatgtgtgtcccttcccccagagcacccctcctactttgtgttccaacactgaacacagccttttatgtcagtgttccaaacttaaaatacctcagttctgatctctcgctgagcttcacttgcgtggtggctctgaaagcgccctcagttctgaccctgtgggcagggacaatgtatgtcccgccatcaagacgtgtgatccccgagcagacagtgcagttggtgaggacagggttggaaggtgtcacaggcccactgctcgccactctagaaggcagggggcggcgtctggtgtgagtagagtaccacgggagggtggctgacgcattgctcatgtggggtctccatctgtggcccgctcaccctgtcctgccgcatctcagtccactgagacttgcacttgttgctctgtattcacatgcctttcacatgaacttgggcagctcccattggaagctggtgtatctgcctctcctgctcgagtgccagtgctggcccttcagcccgccgttctttaattagagcgagtcagagg

SEQ ID NO: 51830 - DNA, 1955 bp, Homo sapiens
tgaagtatgctggctgctgtgacagcttgttccttgagagccgggcccctgggaggtcctgtttcactcaccattggctcccgggctcatggacagcggcatgagggtgccatcaaaggccgcctgattcagacccctgcatacccaccaaagctgtgttctgcctggtctcccttcagtggagaaatcgaaccttgttctctactgttttcttcctgagtccccatggaaaggctctcggcagagtgggcagcagaagtgatgtgaggctcctaaggtttgaggtcgcaggccgtgcttgccatgtgaaatagagacttggccctaggatgagctggatttaacgcccctgagtgtccggcaggcttcctgcaaatacctctgtacatcagtttgcgaaggaggcatgtatttgggttttttttttagtgttttgcaaaagctattttaaagggaagtcaaaggataaaaatgagcctgggcttagcaagtgagcggctgtgggcaggtttggggttgcccgcattgccacttgccgatgagggaggggagtgtggggagactctgttcgtgtggaggtcacaggtgacataagggctaactgaatgattttctttcgtttcgtgctgtcattggacagccttggaaagctaggtgcagacttacacactaattcttttttcctttctctgtctctgcagaaacttgaagggtcaaagtgcaaagggcagcttttgatttttggggcaaccaactgggacttgattggtcgaaaagaagtgcctaaacagcaaggtatgagaatggtgcctcaaaaacccattgagtgcttcttaagtgctaggttctgttgaccacctgcctggtaggtattcccttcatttacaaatgcattttcacagaggccaagtgacttgcctgaggccacacagccactgtagtgatgagctggatttgaaccctaatcttagtcttttaaaggcacaattttgaagtgactcactaattccgttaagattaatcaggaaaatacaagtagtatcctcaaatgaacattgccaccttttccatcttccctctcacctcacttgttttcattaaaatgaagagaccaggtctgtgagatggtgtcagaatgtcctagacatttgtcaaatgtcaggtgtcaaaatttcaggcattgcagaagagtccacgtttctttgcaagctgccaaattgttgcaggaactggtttgacagaacagtctggagcgggggaaagcagagaggtccttaagaagtaatgttttgtccccagttacctttggaaaactggtgtcttaagggaaaaggcccatccaggagaaggaaggctggcatgtagccaacttttatggcttcttgatttcatctggaaagactcccaaagtgctttccagcattgctttgccccatgaacaaatatttgcacgctggctcgtcttggcaccttaaaacaggggcgttggaaatcaccttgttccatgaaaacacctgggggccagctgaattagaaatgggtttaagttgcaggtagcagcagcgcgttgtttggaaaatgcccagccttcaggcccaagccagagggggccacgtccacatggtggcttttgtcccagggaagcacctcctggtctacagtaacgtaagcccaggtgctgatggcgccttgttgccagtcctgtgcccgtgttgcatcatttctcaaagccgttcttcaactgagcagcccagttgacattgaagatacagaagcccagggaagggcagtaaataccaaaggaagcgagtggcagggccagggttggagtcccactctctagttaactctgttgcctcccgcgcatgtatgttgctgtagatctggtgaaaaccagcagcctggatgtcttggtttttgcaagatagcaccacagcaagccacacagtagctct

SEQ ID NO: 51831 - DNA, 1175 bp, Homo sapiens
gggcactgtgtttccgtgccctctgcagaccacccacctggtacatgttcagctctccacaagctctgtgacctggtccttacaggtttttaacggaggcttcattatgtaggcatggtagattaagccattgatcatcactttaaccttcagtcatctccctcctgaggttggaggatggggctgaaagtccctaggctcccactgccccatccggaagctgcctgggggctgccagtgtcagtcattagcatacaaaaagacattgctttggagattccaaggatttgggaagttgcatgccaggaactccaaatattgatggcagtgtcacactagggtagattcagtcctaattctttgcgcacttcataacctcctaaagcaagtaaaggcagcagccttggccagatcctacaaaacaggtgagtgttgcaagctgcccaggtctttgtagtttttccagtcttgggttgccaaggttttgtggaccctgagacagatgtgttgaatctgaaaggagcaaataaataaaactgaaagccaacccggaagtctgtttcagttgatggcccttaggtaattggtcgatgccggcattgttcccgggggtcttacctccccggagcagcggtcttctacatggacctatgttaaaaggttgactctgggccccgtaaacgcgcaccttgcatttggatcataattcaaaaattgctttagactagaaatcccattttgttgattgaagaagctcagtgccttttctgtccatttctgtgtgtctctgcccaggttatgtgaccaagttgctggaggcagccaggtgaaatgacatgaaaatcactcatctcattgggcagactgtttgccaggctgtctgctgcgtggcctttatacacaagcagggtcgcagacactgagttcgtccaaaaaaacaatccgtaggcccatcagggaaggctggattccgcctgggagggcacactgagcttcagacacccacacacccactggcacccccgccctgccccgccgccccgggtggagcccgcaagcgcgggagtctctcccacgattggctgtttctggtctctgaggaagaggagcaccccttaagtgagaaggggtgctgggagttctctgttactctatttaaatgttaattccacata

SEQ ID NO: 51832 - DNA, 1676 bp, Homo sapiens
tcagagcaaaagatccttaccccatgctgagattgacccaaggaggtagagacagggagtgtgtgagggacactggctctccctggcccacctctgtctccagctgtgctgcttgaagctgctttgtcaatggaaatggcacatttgttagtcttttttttttgaggcagagtctccctctatggccaggctggagtgcagtggcacgatctcagctcactgcaacctccgcctctcaggttcaagtgatttttgtgtgctgatcagcctctcgagcagctgggattacaagtgtgttccaccacacccgaataatttttgtactttttgtagaggctgggttttaccatgttggccaggctggtctcaaactgctggcctcaagtgatctgcctgcctcagcctccttccaaagtgctgggatgacaggcgcgagccctgtgttgggttgcatgtttgtaagtcttaatgtgagtaaacagcagtccattgcagcttttaagttcctgtttatacacataaatacgttattattttacatatgtgtataagcaggactctaaaagctacatcttcctttctctatccacttaaaaccaacaggggcccatgatgcccatcctttgggctgtcggtgctgttctagaatcagagcacctgggaggctgagggttcagcatatgatgcccctttatgcctcatggaaagtgcacaccctacatttaagttttgcttttttttttttttttttgagctggagtttagctgttgttgcccaggttggagtgcaatgttgcgatctcagctcactgcaatctccgcctcccgggttcaagcaattcttctgcctcagcctcccgagtagctgggattatagacgcccaccaccacacctggctaattttttgtatttttagtagagacggggtttcaccacgttggccaggctggtctcgaactcctgatctcaggtggtccacccaccttggcctcccaaagtgccccacgtttaagttttgttagcatctactgagtttggtccatgttcggggctgggtccatgcagccccattgcctttccataggcctagggcagccctctgccccttgtcctgggttggcctcctgcccagtctccctggccccaggtttctggtctctgtttctctgttgagcagtcctagggaccctgtgtgctgccacaggcagacagcagtccttgttgcagaaagaaccttttttactgagcattttgcatgccttgccccgctcagggttgctaggaggaggtctgtgtgaaagcagccgcccaggaaatgtccaaaaccatattgccttcagtgaccccaaagctgcaggtgtcgggcttgtagaagatgagccaaatacttacattgttgaggggcagaattgccttgagtaaaagatgtgcattttatagaacattcttatggcagatgagcgttgtcattgcctaggtgttaagaaaaaattcaaattcttttttcctccgctctcacggccacactcaacaaccaacaccagacttcttccgcaccccccaccccagatggagtcttgctctgtctcccaggctggagtgcagtggtgtgatctcagctcactgcagcctccacctcctgggttcaagcaactctcctgcctcagcctcctga

SEQ ID NO: 51833 - DNA, 2022 bp, Homo sapiens
gagaggagagcaagtgacggtgagatcgtaatggaagtggggtggagaggtggagggtggagaccggtaggaagcaagcaaggcttttttcacccgtcccaggacacgcgaacgagatcaagcctcactgcggttcactagggtctatgcaggccctcgcacccctgcctacctcctcagaacccagcctcttggctcttctcaccccagccccaccagacagcttccctcccaggaggtgtctctcaagatctcgaaatgtggagcgtcccgttcactccacctggcctggaatacttttcctgccccctttcatcgggtcttattcatcctttaagttgttcagcataactttccacctgaatgccttccctggccctggactaggataaatcccctcgccataatgttcctacacaggcatcactttgtaaagcttaccactgttgtaattacttgtttactgatctgtctttccgttaggctgtgcgttccactggggtggaaaccttgttcactggctctgcagccccgggcactgtgggtcttgcatgtaccgggggctcagtaaatatttggcaaaaaatgaaaaagttcccctcaaagccagcttccagtgcctccacggccctcaaattaattatgaattaattcactaatacagcaaacctttatgtgattcttccgtgtcacagcaccttgttacatactgaggacacatccacaggcaaataaaactcagcttctctctgcacaggaaaaaattattcaaattgtattcatctttcattccaatcactcaattagggcacgtcccttgttggctgctgcgtgagcgaagtaactattttccagcgagtgtcctcatgtgacctgtctagacgtgcccaggaaaaacaatccaacatcctcctaagccgcaaagaagtccctgacgcgcaggccgcactgcgtggaaggcccaaagcgcgctcgcgggcccgcgaaaggcgcaggagcagcggagccgaggcgggcggcgaggcgcgcggcgcgcggcgcaggctcgggtgggcagggcagggccaggccgggcggggcgggggcgccggcaacgggtccgccggccggcagggggcgcgcgcgccccgcgccccgcgcctcccgccccgccgcgcgctcgcttgccgcgcggccgcacatgtgtttctgttttgtgttgtagcatttgttctggaagctcgtatttacattttaagtgtatctggtgagtgggctggagccctcgtctgggccggaaaaaaaaaagccctccgatccgtcttttagttgcttctcttccttttttctctccggtttctcatcactccaaccaggtagggtctgaaaatcgacagtgatcagtttgtggggtctgggaaagtttttttttttttcctttttttaaagagaaaaggttaaaaaaaaacctgggggaggggggctgggtgattgaaggaataaaaagaggaaggaaggcggatccacgtggtttaatcggagacagacagagatcccattgttcaaaatcaattaaaaaaaaaaaaaaaagcagacaggggagagcgcagggacgccggggagctggcggcggccctggacactttgcagtcgaatcggagaccggccgggccgcacggccggcaagggggctgggagagagttgggcaccattaaagtttttatttttcgtgtctgtgcgagcaggtgtttggggctggggtccagctttcttcgggctcttcccccgtcgccgggggcagtccgccgtagggattcggctaactagagcccgaggtcggcacccctgagctggggccgaacgggggtccagggctgatgcggggtgggggagagcgttgcattaaatgccatgagtgggtttggggggagactgcggagacaaaagcagcaggtggggtagccggggagcaggggctcccttaccacccaggtgccaagggggaatcctggaagtgtcccgaagccttctttaatgaaaat

SEQ ID NO: 51834 - DNA, 1027 bp, Homo sapiens
actgtttcccttggcagtgcccctccgtgagctccagctctttcctgccattcttccgtctgtacacctgctgggttgcagggacgcacatggacctccctttccctgcctgcctcatcctcctggggggctttgggtaggtcccttcccatctgagcctcagcttccctgtgtctaaaaaggaggtgaggaaacccacctctcaggctgcctgcagcctaaacacactctcatgctaagtggcgagggcccagcagcgaggacgcccagcagctgggaggcgggcatccctgttgtaggtggggaagctgaggctctgatgggcgagttgatggcacacagtatgtgtcatgccagctgctgtcccctctctggcttccaggtgggagccacggtgccccatcacagggacacccctgatgtggggctgagggtctggggttctctggagaagaggggggtcagttcagctgatggcaggtggcttcctccggcacttcagcttcttcactccttctgctgggctggatcgccggggacaaaggggttaatgtgtctgggggctgggagggaaggaggaagagcaggaggaggaggtagaggaggggggctggagatagagtctggggccgcccccctcccacgctgtccagccacttctccaggctggctctggtttcccaggcaacagcccccaggggtcccctctggcctggcctcagggtcggctccttcccacagagacctactcccagggccccctccccagtgctccccactcttcctgcctgcagatcctcaccaggggctccctaggaggtcagtgcgggagggtgggtgccaccgactctgggctcaggacagagtctccattgtctgaggctccagccattgaccaaacttggcccctgccccagtgaggcaggcccccttctcagagctcccctccccctccctggtgaagaggaaaggaagttggagccgcccccacctcgggaagccctttgagtgtccatcaggtcggtga

SEQ ID NO: 51835 - DNA, 1039 bp, Homo sapiens
attcctggaaggttgggggctgagcatgatcctggactctggggccagatttcacctgtaagccagaggggatgaggacggacacccagcaggtccctgcaggtcccttggcactggcaacaggaaggtctgtggctgcagggttttctgggaagaaggatttgggctgcacagctgctgatgtttctatgggttaatgatttatgaaggctggaggctggggcctttctggggctgccctgtgctctgagagccactgggctgaagcacaggttgtgagccagtgacttgtctcagtagctgaaactgcagccctgactccagctaatgcgatttctggtcttctttccacaggtgtgtagctgggacggtgctggtctgagctggaccttgtctgatggcttcctccaaccctcctccacagcctgccataggtaccgtacccagggcttcctgtccctctcatcctttcttagaagggggccgctgggggccggcggagggccttgctctggagcagcatggcgccgggtgggaagtctgctctgctggctgctggccctgcctgggccgcatcctctatctcacgttccttgtctacaaaatagaagtaactttctgctcacggaggaggctctgagcaagggtcaatccttttcctgtctccctgagatccgccggagaggtgaacacacgggggtctcaggctgaagcttataaatcaggggtgaggaactgaggttggaggagagggttgcgccatagggtcaggccgttgaacagtggtagcattgccgcatttagtgaaaaaaagagaaagtaaaagaaaaatacagccaggcatggtgtctcatgcctgtaatcccagcactttgggaggccgaggcgggcagatcacttgaggtcacgagttcgggaccagcctggccaacatggtgaaatcccatctctacaaaaatacaaaaattagctgggtatggtgtggcacttgtaatctcagctacttgagaggctgaggcaggagaattgcttgaacctg

SEQ ID NO: 51836 - DNA, 1050 bp, Homo sapiens
ctcatgtccaccctgagctctcgctgggggagtcgtggttgaaagagcagccctgagtacccagcagtgcctgggaaacgtgagcgccacagatcgctggcttcctgtgtttttcctggactcaggcctgcacccctcacctctgagtgcaatagccccatggactctggccccctctggagttgtttgcttttcctgtttagttttgcctttatccccctgtgacctcagcacttttctgtgggtcagggttttggctcctggccctggtcgcagggattctcatgggctccctgaaggtacctggcctaccccttcctgggcttttctggataagatggttgtactgcctgttggctagtgtctctcattggggcctggagccaggggaagtgatggggcagccgtattctgggagaggacagggagactcatcttccctggatgtatcaggggctgagaggatcagggcaagaggagaccaggctcagcaaagcagtattggcacaggatggaaacagggcgctggtggcctgtggcttctgagactgctaggtgtgggggacataggggctcatgggaagggcaggtcagcaaggccggagtgggtccgcagcgtctggaggaaatcttcaagatttcccagattgccgcagacctagtctggagttgtttggaatcctgggcttctccttacatgtgctgtttcccaaatccggaacatttgagcctcctgcgtcctgtcccgcagggtccatgcgggacgtgaggcatggcagataccggctctccgcccatggagtcccccatgggagggttatggggaccaggtctttctttccattaaaaatctttctttaaaggtcccttgccaaatccataaattggacaagctggtttttgtgttttctttccttcttttccttctccgagggtagaaacaagggctcccagtttccaatcagagccaggacctttggatcccaggccctttgaggacccccacagcctcttcattgaagaaggcacttgcagggtacctggttggca

SEQ ID NO: 51837 - DNA, 1046 bp, Homo sapiens
tagtcccggctacctgggaagctgagataggaggatctcttgagcccaggagtttgaggccacagtgagctatgattgtaccactgcactccagcctgggcgagacaatgagaccctgtctctaaaacaaaattgccaaggaggctcacaatgagcgctgagaccatacaaaagcagtgctgggagcaaaaggaagtgagcgggcttgtgcacgtctgacccatttcttgggttttccccattttctcaggccctccttgccctacgagggggaaaatgtattatcatcttcgtttcatggttgaggaggtagagctggagccccagggcccccatgttctccctgaccccccctcgccccacctgggttcagaaattgggtctgaggctggaagtctggtaggcttggcctcagggcctgggctcaccggctgccgcttggccagcaggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaaggtgaggggaccgggggtgtcgctcacctcagtcagggcacggagaccccttcagggagggagggagggagggagctgggtagtgagggccaggcctaggactcacgtctgggtcccagggattcccgggtatgtgtggtgagaggggagccagaagcccaggtcatcccgaaacaggaggtgactcgtagacattgctgttggcagccctaagcccgggatgggcatggctggtacctggcacaggtgctccccccacccccttgctatggcagacctggtcaattgatcctgatgctcacgggctcagactgggcttcagagtcctctcaacgccgcactccaggtagcccagccacttgcttagaggtggagcctggatcagatccacttgctctccccgccttctgggactgatgctc

SEQ ID NO: 51838 - DNA, 1995 bp, Homo sapiens
caaacttacagagaagctcctatgttacaagccctgtgctgggccacagggccggggagaagacacagttcttgccctcagagcattttcccttttccctaagacaggagacctggatttactcccctcccgcctctccgccccagcagcccagattccctgctgcagagacccggcccccagctgcctggcatggtggggttggacacagctggagcagattccgggcaggatctggctggactgctgcctgggacctggggtgccgcatcccgcctgcccgagctgtccgtccgcactttacctgagtctcctttctcccctgttgtctgtgttttgtctccttcctgtcccgcctgctcctctcacctgctttccttctgcctggccgcttggggctccagctttctccagacctgactaggctaaaggagagatacgccaggactaagagagacatcttggctttgagagttggggggagagacatgcaggagctgaagcacaagtacgattgtaaggtattgtctgtctgtcccctcaagccctggatgggggctgtttccagctgcagctacctccaagggttttcctgctgccctggtaccacgaagcctaccaggcccacccttgagtcccagggctgtcctgagacctggaccctggccacccttgcatctgtgctggaactggcagatgccttaagccacatgttcccttccatgttctcacccctatctttctccccacctgcaagtgaaaccctgatagtccacaagaattcccaggagggttttcaaactttaggacccttgcaatcacctggggtgctgtgttaaaaatgcaggttcctgagttccagccccaagggtgccacttacgtaggtctgggacgaggctcaggaatctgcacatttcataatctgcacagttggggttacacattgaaaaacgtgagtgttgctgacattggatgttcctatctctccacactattcagaggaatccaggataaggaagtctgtaggagaaatcacagtacttgcttaaacttttggatgatgatatcgacaacagtagcttccattaactgagcacctgctctgtgtcttggctaaaggcatggactttcgaggtctgtgggcctggtttgaatcccaatctcaccacttcctcatggtgtgatcctgagcaggccccttggcctctctgagcctcggtttccctgcctttgaaatgggggcattcacagtaccagcccccagggtggctttgaaggtcaacgatcaggcctcttgggtgtacggtgctgtgctgggtctagaagctcagtggacagtggctgttgttatctacatgcctgaccgccctgtccttgtggcactctgggcagtagctgcctttctgcatcttttagtgtcaagtacccggctagtggccacagcagtggttcacgacagagctgggattccaacttgggtctgcagtgtgccagagctcaaacgtcctccatcctgcagtgctgcccgctttattggaatgtgaagccttccaggaggaggagagcagaccctttacagttacgagacctttcacagatacccgcgagaggcctgcaacccagggtaggggcggggctaacctctcaggaagccaaggcttagagaggtgcccagagctagagaagggcagagtctaagactgggcctttcccccgcttcggccacacactgtgggaatgggtggattcggcaggtgtactcggggacaccttctagggtgttggcctgttcttttttgcccaggaaaatgccaagagaagggcctcagatgatcccttgaaagaccactttgggggctcgcaggacagcaccactgatggctttctgccaggacaggaactggattctggaacagaggtttcagatctctgagggtgtgaccccctcctcccaccccccaacaagaagaagatgagcgtctatgccatccctt

SEQ ID NO: 51839 - DNA, 1072 bp, Homo sapiens
catgttcaacattcgtggagtgcatttttctgctcagggagctttcccagacccggaatgtttggtgctcacagaccctggcaaggatcggtattgctgttcctcagttttgcctggggaaatggaggctcagtgacgttcagtgacgtgcccagagtcatgccattggcgggtggcccagggctccaggtctccagcacccctcggccccctcctcaccaggtcacatcatctcctggattagaaatctgctcacatagtctgtcctgaaaggaaaaaaatcggttacagcctcctgttgcccctaaagagggagatccccgggcatgaacgcaccttctcacccccactgtcgtccttggcctttgctcacggacctgggagggaagggtctgggtggttctgatctctgcaggccgaggcctggggaggcgggtggccctcggtagcaggcatcccaggccgtcccttccctgatgagcctctctacctttgctcagatgacccagctcatgaaggccgccaagagcgggaccaaggatgggctggagaagacacggatggccgtgatgcgcaaagtctccttcctgcacaggaaggacgtcctcggtgaggcgctgcccgagcgggagggtctggtgcccagctctgactgggggtcggggagggtgggattttgctttacaccccagaggtcatgctgggtgggtaccacttggcgtatggttcctctggtggtgggggttgggggctgagtcccaaatatcctggtaggtcccagtgtgcctccccctcctctggcaggcgtggcctgtcccttctgggagagctgggcctcttctttcagcgtccctgctcctgcttttgtcacggccgtcttggcctcctgccccctgcgctgtctggctcacctgtcctcatcttttttgttcctgttccctccttcctttatccatccacccatctctccaaccagctgacatttacggaatcctactaagcgccacagcctgtgctgcatgcagggacccacgatgcatgtatcagcagtgcctctggggccagctgttgg

SEQ ID NO: 51840 - DNA, 1054 bp, Homo sapiens
caaggagacaaggaatcccagtacagtgggctcacagctgatggaattctgggatgccagttctctttggaaggaaggaggctttgtctgctgcctgccctcggcacatggcctgatgcagcagaaggaacacaggcctcgagccaggcaggactttgagagcctgtgtcatcctagaaaattctgtaatctccctgtgcctcagtttcctcatccgtacagtggggtggctgtctgtcttgtagggctgtggtgaggatgtcctaggtagtatgaggagagagagagccccatgtagcagacgttattcttggtgggcggtcagtccctaagtggaggcgtttggtgccaggacggcctcgtgctggcctgttcagaccctggctctgcggctttctggctgtgtcgccttgcactttttcccctcttggggcggcagaccataaatgggttttcatctgtaacatgggttgagccccacccgtgcacttggtgcggtgctcagccagagtgggtgtgcacaggcctggcacaggctgggtgctcagtgaatgtccatgttccctctgcattttggggagcactgacccccgatgatggagggagcaggccaagtggccattctaaactcattgagatggtccgaagacaggataacgtggccaggccagctggctgggaactcttcctgggtcaccctcccaaccccaggctggctagggctctcctcagccctccccaccccgcccacaagcccagcgccttcctgaagtgaccctccctgcagaggcgatattaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtaagggcctattggggtgtctctaccccctcccacccttggggttgctgccg

SEQ ID NO: 51841 - DNA, 2795 bp, Homo sapiens
ttccagatcgccctgtcctcccgcgtggctgagtgggattccaccgagaagatcggggacctcttcgtggcctcggtaagtgtccccaaactttttccccagcccaccaaggtaaaaccacaaccagtctgaccccggggccatgcagtccagcctcctgcctctgcctgcttgccttgttcaagtcagtgggattagagggtggcagggtcttctgggcctgatctaggggtgagtgtgacaccttgaagtggccaggatgtccttggatatacctggcaggccatggtgctgatgaagccaggtggctgtcctggctcctcccaggtggcagcaccccctggcctcccagtcactgtgggcagccacctggccggtcacaagctctcttaccgagcacttgaggggtttcaagccagtgtgaaatgctgtgaaagaccacaactttggcccggagaggatgtgccgcagtgctggggaaagggcactggctcacgatccgggggacctggttctggtcccagctcagttctgcaacctagggcaggtccagggcccactctgagcccaggcttgccatctgtggaatgaggggtgcactggatttctggcttttctagctgaagtctgcggaccccagatgttcatggggtgagggaaggtcaagttggtagcactctactttgatgtgttttaggtaactaggttttgctaaaagaaaaaaacttttttttgaaagccacagcgctcgatagagtcactgaataggtctgatgttctgggtgtatatcaaggggctctggagagagagttgattgactccaggccgaccatccctcccttggtaactcaactctgggcacgctgcccggtgagaggccaggagcactttccttaaaggtggagggcaaggggcattcgatttcctgaacgtgaatgcagtagaaggggtgttccccctgcccttctcctccctccacctgtgggcttgggctgctgcactggggatggagacctgggaggcgaaggtcccctgggctctcctgtggcaccaccccatcccacctgtgacctcaggccagcctctctacctctctgagctccatgtccacaccccagtgggggtgatggatttgcacagctcgaggtcccaagggagtgtggggtgagtgcaggcgcccttctgctccctgccttgaggcggcctccctggcccacacctgcctcgtttccttctgctccctgcattgaggcggtctccctggcccacacctgccttgtttcagttttccaagtccatggtgctagatgtgtacagtgactacgtgaacaacttcaccagtgccatgtccatcatcaagaaggcctgcctcaccaagcctgccttcctcgagttcctcaaggtgggcctccatggtggtaccgtgcctggtcagggtgggcagggagattgctcaggaggaagggagcattttggccccagctttgggtatgacatcatagctttggcctggacagctcccctctttcttttggggcagcccagtcccatgggaagaaaatcgttccctcctgcccctgggaggagcgtagccaagtgtctgtaagcaactgggatcctggagctttggcagggtggagggaagacctgtgtcatcttgctgaccctttgcctcctgtgccctggtgagtgggtgggtctgcctggctggccctgtggtgggctgtggctcccgggttgctaagctggttccttttcctcatttataaaagggtgaggaaattccttataggggtatcttgggcattgcttgggagagtaaaggttaaaggcttcgaaaagcttctgagttctcatgtgcccagcctctgctgatttctttgggagtgtagtctggtgagtcagagcccctgcctgtagggagcctgctggctggcagaggatgcaactgggctaggtgccaggacacgcacacatgtgccggcagcacaggttagatgccacggcctcagtggaggaacccactgtccccatcaaagagaacaggggatcaggaggagccaccatctgacatgggccctggcgggggatggtgggattgtgccaaataaagacagaggagagcctatatcaggtgtaaggatagtggagcaaaggttagaggcaggaggagagggatgggcaggtctgtttggattctgggagcactgatgcctgttggggagtcccaggagagaaggcctgagtgtgcacactaagaggcggctgagttcagttgggtggttctagacctccaggcccagggcctaggatgtaatatttcaggtaatggggagccattgaaggattttgagctagggtagatggaagtggaggcaggtggagaaactgtgggattgcagcatatgggggccaggaccaggtaacaggtgtgtggatggagtgggggatggatgcaagagacaggacagaaggtccccctgtgccccgccccttaccctagcccaaatctgtctgcatttagtttaagtggagggaatggttgccttggccacttctagaagtctgacatcttgaataaattgctgagtttcccagttatgcctttagttcagagaccttaagatgactgctttagtctcctgagggtgcgcggccatgcaggggcactggtgggagagggatccctggctgcagaaccacggacctctctcagctcttcttgcaagcccagggataggcagggtcttagggcctggggagaggagcccagaatggggacagtgtctggact

SEQ ID NO: 51842 - DNA, 1081 bp, Homo sapiens
ctttatgggtgattgatcggttgatgtctctcctctcagcctggctgcagctctgtccaggagcctagggtacggtgggcattaataagtgttccttgaatgcatgcaggatgctaaattgcagcagaaaggaaccctggtgcccgaggcatcttctgtgggtgagaaaggcactggggtttcacttccccctctgtctgctgtctgacccaggaggctgcctcatgggccacccacaattctggaaattctgagggagtgattgcaccacctactcttgccgtctgggtgctggtccgtgacagctgtgcccacttccagatgctgtctctttcctcagctctgctgggtaggaagagtcctctgccccacgtgccttcctcggaggcaccttctgccctggctcaactgcactccctccccgccgcttggggcacagggttcctttctgctggtcatgcggtctagcatccttcatgcactccagggacgcttaggggatccctccttcggtgacaatgatgtgtctgtggccgcattcctcaaaccagagtcacgtactgccagaccccttcgaaaggggaaagaagttcttgtggaacccttcattatattgttattcaaatatatacaaacgcaaaactccctgtaatcaactccttctgcttatagcccttgaagaaccataaaaccaacaccaaatcacaaattgaataaaaataaagctacaaaaccataacattcaaattaacagcattaatgtaatgtgatggatgatgttgttttgctgaaaccaatttgttcacagtgtggatgtggctcaggccctggtagagcaggttcctctgcgctttcgtgcctgtgccacagggtgccctgtggggatctgcatttcccatgagctccccagtttgggtcactgcagagcccctctgatgtgagcacattgtccacatcccaagctcgccatgctctttgcttgttaccaggtgaccattcaggtgccatagtccatggaagccttgatatcaggcagcagagtgtggctttaaactcattccacacaggtgactcagataat

SEQ ID NO: 51843 - DNA, 1017 bp, Homo sapiens
ccaggcttctggggcctgcagtggctccctggggcttggagggctcctcatggcccagttggtccttggactctgaccagctctacccacctccttcctcttgctgtaggggaggagaaccagccaggctggctatgcccggatgaggacaagaagagcaaagccccattctggtgcccgatcctggcctgctgcatccctgccttctcctcccgggcactcagcctgcaggtgagtggagcggatcttgctgagccgacctcgaaggtggctgcggctccccctcgcctgggagaaccagagtttccagggagcgcccacagcagggaaggctcaggttccagctgtggcttctaaattcttactgacagatttggtcaagcctttttgttgcttcgggaatcagctttcccaccacaaaaatggaggcgaacgaccactgtgggtcaagtgaatggaaaattccattattttgagataataaacagcaatgatctcatctgttgatggcatggctccagatcatgccgaagcggctgtgccagccactgtgggttgggtgctttgtggttcgccaggcgggagccggctttggcgcagggattgccctcatcatggaatgctccagcgccatcaggcctcccgtgtattgagcacctgctgtgccccctggttctttcctgctattctcttattttaatatctataagaaccttgcgagtagatgtttctctatccatttcacagataaggaaactaaggctaagacaggtgctatgattttccaaaaaggacatagctagtaagaatttgaaccttgccctgcctgatcacaacacccagggtcttaaccatgaggatgttcagccttcacgggttacctgcccttataccctgtcctagctcgccctccatctagagcaattactgcctcccctttcccagggagatgaggtcatctcagctccagggataggagcaccagttggggacccaggcccagattggtgagcccca

SEQ ID NO: 51844 - DNA, 1072 bp, Homo sapiens
tagggagagcggcacctgggagggggtgctggagacagcagctgcctgcctcatctcatgcagcttcatccaccaaggtcttcctgggcacctctggtgccaggcactgcatttggagttgggaggtgcaacctcatctggggcaacagaaaaccagggagctaaaaagagagtgtgccttttgcaaatggtgacagggctgagaaggaagtgaaagggggagctgtgcagaggacctgggtctcaggatcttcacccctggagtcaggaggcagggctggctagtgccctactcatgcagacattccagcccacctttctatccttgggcttcctggcaaagcctcccttgattcaagtgaggtaccctccactatgttccttgtgctgcaaattgtgccctgtcattgctgcttcccttctgagagtgatttgttcctcatcatttcccatgatctagcacatggtatatccatccatccatcatccatccatctatccacccacctatccatctatccatccacccacccacctacctatccatttatccatccaacaagaatatatatttaatccatccatttatttatctgtccatccatccacccacccacccatccattcattcaccgatacatccttccatctatctgtctatcatctgtccatccatccatccatccatccatccatccatccatccatctatccatccatccatccaacaagaatatattgagtatgtatctatcatatgctagacacagaggtaaaacaatggtcaacacagagaagggcattttaaagggatggagtagatgtttactttatattggttgaaatgcaccctgcagaggaggaaatagaaagctgactgagtatttagtccaccttagctccttacctgatttcctgtgggccctgaagcttatttgttgccatggcagctggggataaatgacctttgtgaaggcaggatgtgtgtgggcaggagaagggatgcttctctcaggggatggggtccttgggaaagcaggggctgaggtcctcctctgctccctcctgtggt

SEQ ID NO: 51845 - DNA, 1544 bp, Homo sapiens
cagcttccagccacgaacactactcacctctggccactggggggcgctcaaagccttgcattttcttggctccagcctcctgctgtggaccagcatccctggcggagccctggccgccttcgggtcactcgcccctcctggacaccaggcccagctgcagaggccttcagaaacctgagagggcagtggggttggagaagcaggccaggcccagagtcagacagagccgagttcaaaacccgtctggcctgtcaccccttgggtgtctttgtgcaaggccttagctccatgggtcgccgttgtcacgttggttaagtgaagtcaacacttgcttccacacactgttgtgttgtggcaaatggcatcaaacagtaagagccacggacacagactcctctgtagctgagtgaattggggtagttatttaaactcgctgtgtctcggttgtctccgttatgaacagggataataatagtatctaccacacatgcttgttgggagttaaggaaataattcaaggaaggagggcctggtgtgcggacacagaacgctgcgtaacaaccgctgtcaagaccctgactgtgtgcccagataaatattcttgcatattgtattgactccctgcaacatccggagaagggcaggcgtggttatcatgcccagtgtgcagataagggaaactgaggtccagagaggcgaagcccccgtccaagttcacacagaagttctgaggccgaggactgccctgctctgcctgcttcccttggtgctcacgctggctggccgggcagagcgctctgtgtgcctggaggtcgaggggagtccctgttcccctgcttctttgcggagcttggattctgcccattttaagtagggcataagggcagaaggggaacctgttttatagatgggaaagaggtggggagggagggaaaactgggcctggcagagcatggggtaggccagggtatggtagggaaggatggggagggggtgggagtctagtttggctcttgtgaccacaccccagcagtggcttccatcacgtaccctggggcccttccggctttggagacagctgtgccccatcgtgccaccaagcagctggctcagaggggaagggtctgcctgtgatgggctgctctgtactcttaccagggacccagtggagggcaggtggggtagcagggctctgacaagctcacagctagctgtgtcctgccttctagtcccccgccactgctgcctgtctctccagagcatgccatggcccaggctgctccaggctgggacccagcttcctcttcaacccccctttcccacctggcaccctgacaagacagggcagccaccggggttctgtgtggcatcaggtgtgacttctgagaagaaacaatcttggcgcgcgccgcttggatgccggagaaaatggttcttgggtgcgctgatcatcccaggggaggggaggaccttgcttgggccaggctcctaggtctgtttggttttcagggatggccgactggggattcattgcctctcagaac

SEQ ID NO: 51846 - DNA, 1054 bp, Homo sapiens
atgaacagacatcgtggagaggacatatgggacgggaggtgaggaaggggagctggcacggcaggggcagtcctgtccttgtgagccaccccccagtcttagctggtagcagccagcccccgatcctcgcctcccctccactctgtgtgtctcttccacatccccctcccctctgagcccggcagcagggagagggggagggcagatgcccaaggggcagctgcccagtccttttggaacttggcaaggaacaaatagagccatggacatggatccgctgaatgtcagctgctaggctgagggcttaatgcagtggaggtcaggccctgggtgtaattagggaggctccctccctgggtggttgggaagaatgaatgaggtcacatgtgcagagggtgtaggctagtgcctaatgcacactcaggcagagtggccgctacgcaatggtcctctgtgagcctggcagcggggtagcagggaaggtccacaggaggcaacctctgcaggaggcattcccggctgcccctgcatgccttgtctgagtgggcttggatggtggtcagtgtgggctcaggggctgggttggctggccttcccactgatggcctcagtttccttcctgtaaaatgggggataattatagaacctgccccaggactaagcagctccgtgtacatgcaggtcccagggctgtgcctggtgggaggaagcaccacgtgtcagttgttgtgtcattgtggtcacaggacttgctcagggtgactgggaccacacactcgttggtggagccaggatctcagggtgcctctgattctgaagcccccacctggtctgccgtcctctgccccatcagccccgtgttccattgggtcttgtgggtgcgtatgtccgcaccatcctccctccagatggcaaaatatctgtgagcagggccagtgtcttatcctctctgtattgtcctgcagtgcaagtacaggcattgacttggcttctctctctcctttgctttctttctccccaaaatctccccttttttcccacgccagctcttccc

SEQ ID NO: 51847 - DNA, 1029 bp, Homo sapiens
gcagtggatgggaagcttgatcatttgtatcttcttttttaaaaaagtttttatttgttttaagatcaaaatggtacatatacttgcaagaaaaaaaaaaaaagcatggagtggtttatcctgaaaggctcgtccacactccacatctcagtcctgctttttggaagagaatgcttttcacctgttctttttttaatccacctggcactttcctcaggacccaaacttgttcactctgctgcttcttgatgtatcaattttgggacatcacctgttgtctccttgctgtgaatgatgaggatttggcccatattacccccgttccttccccggtcattctctcggttgcctttgtcactttaaatcatttacataaaccacaacttctttcatgattttcggctccatctttcccttccgtaaggtaaagctctgaggggccactgggaccatgcctggtcctgtctgctcgtgagtgagcgtgtgcatgtctttcctgctcctcactcggtgatatcatgctggtagtttgcaactggccacgttagaatgtttacaccatggaaattggcaaacgctgcaaaccaggattccctgccagttgttaaactttggccaacacagcacagctgggcttctaagattccagttgttaaactttggccaacctcatagctgggcttctaatgttccctgagtagcttgagcttttgaagaatgtgagaatggctggcccaggggtgggggcttgtagggaggctcagctggcaggcccagccagtatcgacactcctccctttgtgccacagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggtgaggctgcctcgggcacgggggagcggacagtcacagagcacc

SEQ ID NO: 51848 - DNA, 1094 bp, Homo sapiens
cgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttggattgaggttttgttgtggttttttaaagcatgatgggaaagagatagagagagcagctattggtagagagggtttattcgggacccaggagccactcttaggcttggtgggagggtggagctgctacgggaatcagctctagaacttcacagtccaatctggtcaccattagccacaggtggctaattaattttcaaattaatgaaaaatcaaacattcaatctctcagtcaccgtagccacatttcagatgtggcttgagtggtgagtggtgaaggatgagacggcacagatatgaccatttctgctatagaagaaagctcacttctgctccagaaggggctctgggagcttcttttgtgaatatgttttggaaaaaagactggttcaccccaggtctggagtagcatgggggcagaaggccttggtgtctaacagtgcaagccagaagcga

SEQ ID NO: 51849 - DNA, 1033 bp, Homo sapiens
tcctaaaactggttgtggtgatggctgcacaactctataaatttattaaaaccactggcggggggaaagacctcacagctgcccctgcatagctcttgcactttcttgaccatttgttgcccactgctgtgtcacttgcaaccctgtggaaaggtccaagtcatgaagaagtgaagcctccacaaagccaggaggaaatgaggctgcctggaatagccatgtgagtgcgccacattggaagcagctcccctgggtccaggcaagcctttgatgactacaaggcctgctgacgtcttgactgaaaaaaccttcaagagactctgagccagaatcacccagctgagatgctcccagtaccccaccctcagaaactgtgaaagaatatatgtttgctgttttaagatgctaatcttggggtcatgtgttacacagccatagataactaacatgcactatctcatggtgaccctcatagcctaaattttaagtagatatctgtatccacattacagaggtacagagactgaggcccaggggttggtccaagataatacagcttagcaagagatagcgctggggcttaaaccagcctgaccccagagctgtggtctttccaccacacttctctaagcatcccggaccaggccccttgggagatcccaagaaaggaggaaaagttgggatctctgccctgcaggacctcccaggctgatagggcaggcaggggagcaaagcagagggtcctctcagtcacgctgaatgacggtcccccacctgcggctccctgtggctcccgttcagcaccacagctgccaaacccatttcattcaattctgcaaagagctcagaacaccctgagtgggggttcctgcctctccctcgaagcagagagcagcgaaattggacagtaatgtgttgtcgttcaaatatttcagctggagctggggtgaattatgatgccatcccactttattcagtgtagcatctttcataagagccgtgtctcagaaacactttggagaaggaaataata

SEQ ID NO: 51850 - DNA, 1119 bp, Homo sapiens
agcctcccacaccttcacccacactgtgcatggctcactgtggactggcacgtgctcagaggaagcctgggcaggaccccacgtggggcaggaacagggccatgaagaaggtgtggccagcgtggctgggggatgtcaggacgtgggcagggatatcccctgggctggcactggagcccatgtcagtaggctctggagatgagggacaaattccagaaaagagcccccaggctcagggaatggggtatgggctctgagagagagcagggggctgggagaggggaggagggacccttgggtggacagtccgtccctgcagggggtcagattgctctcagaaagatcatttttgaagaacaattaaatctctcctaaagcaggcttaatagttcttcttctggggctgggtttggggtgtgtctccctcccaaccccctcccaacaccctcccctgtcaaatatctgatctccaggtttccattcctcgctccgaccgctcctgcttcatttctccacccagtagtcttcggcttatcagaacaccaccacccaccccagaccccagacctgacccacacgcacctgggacctggaaatcccggattctagtcccagcaatgcccctgcctgttctacccctgcctcagtttcctcacctgcacattgagggtgttgggagagtgtccctgggcccaggcgactctggaagtctgcgacttgaagtgacttgaagccgaagtctgtgctctcctgtgccccctcccccctgcagctggcgcctggctcagtaggaaagaggccaaggagccgccaggattgcacgctgcctctgccatcagtcactctgggtggactctgaaaagcccatttggtttattaacacaaacactcttggcataagcccgggaatggcaaattggatgggagttcacggaagtcaggggatgtgtttatcacctcctgctccatcacctgtcgctgctcctggcagttggggaatggccaggcctggtcgcggggagaagcaggggtcaataaaatcacctcagaaagccacttgtgcttggccgcaggctgctatctgcccagtagccaggggcccgctctctgatcttggtt

SEQ ID NO: 51851 - DNA, 1037 bp, Homo sapiens
taagcaccatggtggcagagacagcctctgccttgttctccaacgtatcgatgcactaacccaaagcctggcacagagtggacattcagtaaacacctggtgagtgcatgctctctttatttactttcctgcctgggttatctgaatcacacttcacctccaggctaagctttgatggctcgactatcatgcccagccaggtggcgaaactgaatgcaaaaattccttgtagaaagctgggaaatccagctttcaattcctcccatttctttggcttgattttaatgactgatgttttttaggtctttttttttttaaggtaggggagggttaggcggtggcagcttcattttaatcagaagctaaaaggctcattggtttttctgatatcctttgaatggactccttctccacagacagctcctcacagctgttaggacttcaaattcctcatgcattgatgggggcagagaaaagatatgaaaggcttttcggctgacacaaaagaggggaaaaatgtggaataaaaacgacaatgtggttaatacataaaatggtgaaatttctggcactcgctgtatcattaatctgtctaaagtggctttgatctcctctgctttaattaacttgtaattataacgcgatgatttctgcagcgggcagaatctgggagctgggccctgaaagagacttcagcctccgagaggcagcctaacgcagtatgtgtggcatccgcctgtcagaaagaatgcttcccacatctgcccttgcacacgtgcacacacatgcaccttcagaacccaggcttccccatcacatgctgtcatgggatagtagctatgtgttcaaccagctgctcagatcctacatctgagttgggggttactgggcagcatgtcacaggttaagttggtagagaagcaggagatatcatctctgaatgccatttcattctcatgacaactttggcaggtggctatgattagtcctacttcctggatgaggacactgaggcacagtttagttctcttgtgtaa

SEQ ID NO: 51852 - DNA, 1032 bp, Homo sapiens
ttgcagtgagtcgagatcgtgccactggcctccagcctgggcaacagacaaaaaaaaaaaataaataaataaataaaaattaaaattaaagaaaatgacatcatgatatatgtcatgaatcttcaggatagaaggactgggcagggagagcagtgaggcagcagattgcaaaactaaggctctgagtggtgaagccctgggtgtggaggcctctgccgtctgagactttcccagagctcgtgggagccaagctcacatgtgagggagataaggagattgcctttccaagaaggaagccaacagaagagaaatccagctgaagagggaggagagagaaatccagcttagaaagacacagtctgagtccctggatcaggctgtgcctgaagtccatcctgtcctagacttacgagttgattgagcaaataaaatccccctggcctaggccagtctgggaatgggtttttcatccccagatgaggggatgaggtttcactgcctctaggctccctggcaaacaaatgcatgtttctccagaagaggttaaaattaaaagggaataattcaaatagtgatttttttctagtaatttcttcttggggtcacttctgatcatatgtttaaaaataaggtgggctcagggctgagaggatcctgtggtctgtattctcttatccaaccctcattggcctctttgatactctctgcttgcagtgctctgggccatgaatcaggaaccagagaccaacgttctgctgttgaaacgctgtgtgaccttgaaaaagtcacttaccctttctggagttcaggctaattggtgcttgtggcttcaaaaggggtctcaggtcccttccagctcccaggccccttgcctccaagcctgcagcagtacatctcgcctctgagcccctgcagatggttctctctctgcctgaaacaccatttctccccagctagctggaatcatctttccaaattcagcacagctcactttcctcagggaagccttgctgacttggctcctgccccaac

SEQ ID NO: 51853 - DNA, 1065 bp, Homo sapiens
gcgtgccatggagcgtgtggttatcgtgtgcagggaggtatggacgcttccggggctggggagttgtgagcagctcagtgtgtgtgtgtgtgtgtgtgtgtgtgtgtcccgccgtgtggacttgctcccgggttaggctaagacagctagaaggaggttgaagccgagcgggttctccggagccagtgagaggtggctccgcagccccagggtccgcggccggcctcccacccagtgccgccgcgtagtgggtcttaaatggagctgaaccctttcgcgcagtgagcagagagccaacgtgaggctaaaagccaggagggagggaggcgggaccagcgaagagccgcaggcaccgagactacaggctccgcgtccgggatcctcctcggagcctggtgccaacctcagcctggctggagtcagagcctggctccgcctcggaggggagcgggacgcgaggtgccaaaaagtcgtctttatgatcaataaggtctcgaccccgagccccactggatgatagaggtgggcatcacctctgtcctatgccatagccttgtcccagcaggaggtgcctacctaggctctgagagtgcctgccaggaaggggtgcccccttaaaaataaccccaactccttctaccccgaagtccttggggagtgctgggtctgctgatgggagaagctgcagaatttgagcccggaaggtggtcctgacagcgaggggggaggggttggtgtaacccagaaggaatgcaaaccctgtactttgttcccctacccttggaacaagagactttcctaagtggatcaaaatgtcccccctcaactttgggaggagggctctagagggaaaggttacatgggggaggtcctcgttccagcgccgccgagagggcactggggtttgttgaaaggcactggagccctcacctggacattgcagggggcgggggttggaggctggggacctaaggtaagcacccctttccctgggaatgcgcagaacagagagacgcggcagggtgaaggagaggactgatgagaagggcttgttgggaaaccctg

SEQ ID NO: 51854 - DNA, 1053 bp, Homo sapiens
gtgagtggagaagatgatgaatttggatctcctagggggtggatgaagaggcgctgagattggtgagtttatctgaaggggcaggggtgggatgcaaaggtgggcacgatggggcgagtttcttactttttttctagctctcattggccagtgcttaagccatcacatagatttcaatcagctgtaacagatataaccttgaagtgtgaggttgtcaggaaaaagaagaaaggaaggcggggaagtggggagagagagagagaaagagggagcaggctggaaaagagagaaagggagtgtcagacactgtgacaacagcgtcattccctccatcgtgtcctgttgacctgccgcaggccagccccaaaatgcatacagccaggtcttgcccaatcagatattctcgttatccccttaattattctttacaattaagctgtatgttctccatttacagaagaggaagtgaaaccataaagaggtcccttggccaccgaaagggagactcgggtttcagccgaatgtctttcttcctgagttgaaatccctgatccacctcttaccataataaccatgtgatattgaacgagttatctaacttcatgttgcctcagtttctgcatctgtgaagtggggataatactgcagaactattagggttgtataagccttaaatgagttaatgtacataaaatgcatagaacagtgccaggtgcatattaaatcctgtataagtgttagctattattctattgttattattctacgagcatagattgttcagttaaaaatcttgtccctccctctttctcccagtgccccttcctgccagcttctccttccttttaagagttaagccctggggtcggcttctccggccagcaagtgatgtcatccccccttccccttccccctaccccaccccagggtctggcctcccagaggacgggtctgtgcctgttttccagacccccaggcaggcagcagttcggggagcgagcgcagggatgcttattctccgcccttcctctctttgagaatctaagggcataa

SEQ ID NO: 51855 - DNA, 1075 bp, Homo sapiens
acttattgaactgattataatttcttgccttattccattgtctaaaatttccagaatgcttgtaaaaaagggtttccctgtcttattcctagttttcataggaatgcatttataattttaacattgcatatgatacttcctgctggcttctgataaatattcttttttgttatgaataggaaggttacttctattccaatttcacctagaatttttataaagaaaaattaattaaatgctccttaaaaatctattgaaataatcatatggtttttctcctttaatttactaatgtaatgaattatgttgatgtttttcctaatattgagcctccattgggtttttgtaatttctttaaacaaatagcttgtgtagcaaattaaaagagctctcaagtatttgtttttttattattataaatgggatctttttcattggattttctgtgggtctctgggatgtaagaatgcaattgattttttgtggctttatcttgcatcctacaaattagatgaattcattttttttctctttaataagcatgtagtgctttctctgagttgtctaggcatccagtctccccagctgatatttttgtttccttctttcctgtatttttagatctattgcatttagcaatgagcaagcatgtgttgagtgcctactatgtgccaggcactgggctaggatctgtttcctctgctgctgttgctgctgcttggcagggtgggtggttggagtaccctcttcagctggaatattgagagcaggggccttatgagggaatgaatcccaggaggtcccaaaccacttagagtcagatcaggattcaaacacattaaccctcaggtcaggctgcctcctgaccgatgactctccccttcaaggggcaggggtaattaaccttgacaaagaaggggaaaccaaagcttgggaatgcagcagtcatttctggcctggaggtgaagatagatgcccttaccctgcaacctggccttgaatggtccagctctctgaccttctttttgttcttgcatctgggacttgctgctattaaacaggagtgaaagtccca

SEQ ID NO: 51856 - DNA, 1044 bp, Homo sapiens
gccttggtcaggccgggtgcagtggctcatgtctgtaatcccagcactttgggaggccgaggtgggtggatcgcgaggtcaggagatcgagaccatcctgataacacggtgaaaccccatttctactaaaaatacaaaaaattagccgggcatggtggcaggcgcctgtagtcccagctacttgggaggctgaggcaggagaatggcatggacccaggaggcggagcttgcagtgagccgagattgcaccactgcactccagccggggtgacagagggagactccatctcaaaaaaaaaaaaaaaaaaaaaaacgccttggtcagaaagtgttccagcctattgaccttgtgaaatcagagaaaacccatttggcaaatatgacttcatcttgtaaagaaagattaaggtgttttaattataaaggatattaaaataagagctattgtgtagtgggggcctactgcttagccatagtaccaagtgttgtatgaatgttacatgtgtccacttccctgcatcctcattgccacttctcacatgcaggccaccatcatccctcatcaggaagactaggagagcctcttagctctcctagtcaggaagattgggagagcctccatatacacacttctgtccttagcagaaacagctgtatgatccccaaatcttgtttcattatcctcttcctgggcatccagtaaaactacactttctcagcctccctcacagttgcatccgtgtggatggacacaatgagtggaaatgacttaagccacctccagactggcccataagagcaatccacatgactctcttggttttgtgccccctttggatggtaactgtgcatattgagaggatggaactacaagacaaaatgagcctggatccctgagtcacttcatggaagagagtagctctggagatttgccagactcatatccaactttccgtgaataagaaataaacctttgttgtaacaaaccattgagatttgaggattattttgttagtggggcacaacgcaggctctcctgactag

SEQ ID NO: 51857 - DNA, 1051 bp, Homo sapiens
ttctttatccgcctagttcacagagtacagggctcagaacaaccccaacatagttcttaataaacaactgtttaatagttaattaattaatgcttttctaggttgttgagaagattaagtaaggcagtgcatacaaagtgcttatagtgacaggcagaggaaatattcaggaaatataagctactgttattattcatcatagtatccccaacagtgaccgggaatagtgaccaccacaaattaggtgtacaataaagaattagatggatagagcaaatgaagaaatggatgggtaagcaaattggtaggtttatgggtaggcacttggatggattgttggatgtttgaatagatgaatgaataaaatgaatgcttggatggatggaaggatggatggatggatggatggatggatggatggatggatgttttgatggatggatggatatttggatggatgtttggagggatggatgaatgggtggatgtttggatggatggatagatggatggatggatggatggatgtttggatgggtggatggagggatggatggatgagtgtttagatgggtggatggagggatggatggatgagtgtttagatggatgaatggatggatggatgaatggatgtttggatagatgtttggagggatggatgaatagatggatgtttggaaggatggatatttggatggatggatggatggatggatggatggatggatggatgggtggatggatggatggatggatggatgagtgggtgaatgggtgagtgattgtcttagaaagcatccagaattcctaggggaaacttagaggagcttttccttgagattccacagtactatccttgcatcaggatgctcaggacaggtaaggaaggcaacttatatgtccaggatctttttcattccctgagcagatagacatcactttacatttcacattgcagtcttatctccctcctccattgtcattttcagagtatttcctcaagcagggtggtagcctattctccccatttacaagttagaaaactgaa

SEQ ID NO: 51858 - DNA, 1037 bp, Homo sapiens
caggcactgggtcttgttcaccaccatatcctcagctctgctccaaatggctggctccataattactgttgagtgagtgagtgagtgaatgaatgaatctgggggaaagagtgctggcgagaaggtcaggaaacatggttaactggctctgtgagtgaccttggataagcctctacattatccgtggagctctgtttgtcagctgaaatgaagggaacagacccaatgatcccgagtggctcctccatccctgatattctcaggtgtcgttcagaggatagccatgcctttgggcatcttggctttcaagctcagagatacaaagggactgaataagaggtgatacaagaaagtgaggaagagaggcagggaggctgtgcacaaggaaggaggtggtctttcttcccacaccatgtccacccctacccagaggttctagaaaaatcccactgggaagattaacctgttagaaagagcactgactcaggagtaggagacccgcaccttgatcttggctctcctcaaggtgtgacctttggcaaatcacttcatgaccctctgaggcccagttaactcaactggacaatggggctgatgacaccagaaacgcacctcccaagggggtagcgtgggtgggagttgggggtacctcaagtctggctgctggtgcaggctgctccccctcagcagcctagtagcacgtgccccaggtacgtttccctccctgaccccactgtccactgggcctctctgatcttgtccctcatggcactggcttgtacttgtctgttgtttgtctttcttccccactgatgtgtgaaccccccaagagcaggaatcatgtcctatatacacccttgactccccaggtcctagagagcatctgattcattgcatgggcttagggaatatgtctgaatgaatgcagctgtgaatgagtgaatgaatgaatgagcacactgagcttctcacagaagcagctgatcccaaggatgttgattgctagactagaactttctcttccatgtaccctgtcc

SEQ ID NO: 51859 - DNA, 1036 bp, Homo sapiens
agggtggttgggagcatcaacggatgtctcagtgcaggccctttatactgtcctccctgggcatcccccaacctgctctagcctgagcaccaccccagggggcccagacgctgctcccaggcctgccacaccccctccctacatggagccaatctcacagttcacaatggaggctcccactcttggtcctcactgcaccatcctcatggcctctaggaaatctgaccgtagcccagcaagcctagtggtaggggaggagatcatggacagttaggtggccaggtggcagagctgggcttcgaacccagtttgtcctgatgctgaaatccagcgtctttgttggggacctggaggctctgctgttctggaacggggttgggtctgcaggctctgaccctttccctgattcctggcacaggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttccccacctcggtttgtggctctgcattctttatctgttcagtagcagcaactgggcccctcctcctggcattcagcattgggacaggcactgagaggggaatggcaagggaaatggaaggcatgctcttcccaaatgaacagtggacatggagctcactatctcactcaagtcctagcatccaggcgtggaatgtggccagagacgagaaatccaaattcctcagggctgagtataatagtcagctattgatacaataatgctgcataacaaaccaacccaaacctcagtggcatgcaacaacaagcacttgtaactatgttcatgttcaggctgaagtggttcagctgatctaatctgggctcagctgggcagttctgcttcaggcagcaggtc

SEQ ID NO: 51860 - DNA, 1030 bp, Homo sapiens
tgtggctgcctgcactaattgggggcagaggagggggcttttcctccagcccttccctcccagcttgggcccagagtctctgtggggtgagttggggtctgtgctgggctccctttggggagggctggagaatgtggccaagaggagctctgagctattcctggagaagccagggcagcaggggtggagctggaaggggagtgacaggaggagaagggagtggaaagagaggatggaaaagagaagaatggagtagggggtggtgggggaggaggaagctgctctggctggctttgtccaagcaagaggagaacaaaccctcctttctcgcctcctaggccccttcccttttgatcccctcccctgctgcccccatgctgactttggggttaattttatttccgaattgagcaggcgcccctggagcagggcaccgagcttgggtgtgactaacgcctgccccaggccggggctgccgctgccgctggggtcactctaaaatatttatcaagagcatgtgtgtcctgctgcatgcccaggaacacgggctgggtcaggaggtcaccctgggaccctctggaaattctcccatgcacatgcgtgcaccctgctctcaaatatacatgcagacccccacgtacacattcacacacacacacacacagttatacacacagacacagtgtatgtctacacccagatgtacatccatacacatgtacacacagccacacctatgacatactcaaacatacactcatacactcacccctatttacacactgcacacagaatatgtgtccacacacaggtacttccaaacacacaatcacagacacactcaagcatgtgtgcatgcctcaatgcatggctatacacatgtacatacagtcacatgtttgcacactcatatacatctatacacacgcatacatattcattatacctatctacatattgacatatgcatacctatgccaaacatggaggcacacataaagacacgctcaaccatatgtacagacttgaa

SEQ ID NO: 51861 - DNA, 1046 bp, Homo sapiens
aatggcatgaggcacccaccatcgctgtggccctgctggccgccctgggcttcctcagcaccctggccatcctggtgatattctggaggcacttccagacacccatagttcgctcggctgggggccccatgtgcttcctgatgctgacactgctgctggtggcatacatggtggtcccggtgtacgtggggccgcccaaggtctccacctgcctctgccgccaggccctctttcccctctgcttcacaatctgcatctcctgtatcgccgtgcgttctttccagatcgtctgcgccttcaagatggccagccgcttcccacgcgcctacagctactgggtccgctaccaggggccctacgtctctatggcatttatcacggtactcaaaatggtcattgtggtaattggcatgctggccacgggcctcagtcccaccacccgtactgaccccgatgaccccaagatcacaattgtctcctgtaaccccaactaccgcaacagcctgctgttcaacaccagcctggacctgctgctctcagtggtgggtttcagcttcgcctacatgggcaaagagctgcccaccaactacaacgaggccaagttcatcaccctcagcatgaccttctatttcacctcatccgtctccctctgcaccttcatgtctgcctacagcggggtgctggtcaccatcgtggacctcttggtcactgtgctcaacctcctggccatcagcctgggctacttcggccccaagtgctacatgatcctcttctacccggagcgcaacacgcccgcctacttcaacagcatgatccagggctacaccatgaggagggactagtgccatccggtggcgtctgggagggagggagggccacagagttgggaggcggaagccaggggtcttccctggctggttcaactccagatggaagcagggaagccatccccaattactcccaccttgccctggttaataatttagcattccttggaggtcctttgcatctgggccatttttacccacttagtgttgggtgtctta

SEQ ID NO: 51862 - DNA, 1020 bp, Homo sapiens
aggataagtgagtggccaggccgcagccctggtgctgtgctccgggtgtcctgtccgtgtccccatccccacctcctggacgtggttcccagtaataatgctgcccctaccttctctctgtcccctcccctcagcccagacaggcagccagggctcgccacatgggcccacagcagcaggctctttgttgccggtactggtggtgccggtgccagggtgccactggggaccagtggatctgaacctctaggggcagggctaggaattggtgtcttcgactggctctgcgggatctggtgttgccccactgagtgaggtgattgtcccatgctacaaagcagggcaggccaggggctgcagaggcaggattcgaacctgggtcacatgaggctaaacttgaggcttcgcctcttctttcctccgtggcactggttgcccccatgtctgcctctatgagaaagtggaggtgagcttggagagggaggaagggtgtgggcctgggagctggagtttccgctgctcctgagggacaggaacattggaccaggacaggccactcccttcaacttcgcagtagccctgtaacgaggcgtgccaagcccctccccagaggaggaagctgggctcagagactgggtaacctgaccgaaggcccacagccaacagctggcagcatccctcatccctgactcggcctcctgttgaacctggaaagccagtgtgggctggagcaggggtgttgaggctggagctggggctggaggggagatgagctggttgctctgtcaccactgctctgctttgtagggacgtcgtgcaggaggccacaaaggtgctgaggaatgctgccggcaacttctacatcaacgacaagtccactggctcgatagtgggccagcagccctttgggggggcccgagcctctggtgagtgggtcccccttcccacaggggagctgagttcctggtgggagaccctagatgttacgtctcgaggggcttcagagtaataggaaggata

SEQ ID NO: 51863 - DNA, 1077 bp, Homo sapiens
gggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactgatggtgcttttttttgtttttgtttttaaacagaagatgaatctggtgttgggggaggggtaggaggacggaaggccacagaaaccctcaaactcattagttaattagccataaaataggggatttcatatcacctgttacatttgtagctcacaataaaagctttggaagatgacaaagcaggaatcattacacacattttactgaaggggaagagaggacatgagacatcacaggctcagtaactggcttggcctggtttggaactgatgtccttttaaccacaaagcccccatttttccaggctctccaacgtgcccacaggaggtcaccttcccaggc

SEQ ID NO: 51864 - DNA, 1050 bp, Homo sapiens
cagaaacattcggcattctagcctatttctgctacatgctagctgtgtggctttagacagttgagttatcctttctgagccaccatttcttcatctgtaaaataggtataataccaacctttccaaattgcagagaagatgatattatattgaacatctcactcaaactagaggctcaagaaatagctgttaaatgaatgaggaaaattgcaagattggacttggaggaaaatatctttagtcccaattaattaaagcctgacattaaaaaaaaaatacacatttttaattgtacaagcaatacataaatacattctgcattttaaaagagttaaactccttttggataaggcgaatgtcccctttggcttactacccctgtctttcctgaggacagccttgaagctgtgtacctgctgggcagctgcccctttctgtcccctgtatgggtccctggagcctgccttctgttcagtcatgccctctggtgtcacccccacaggcgggagacctttgactttgacgacgactgtgacagcctgacgtgggaagagaatgaagacacgctgctgctctgggaggatttcaccaactgcaatccgaccatcgacctgcagggcgaggtaagcccagcgcctggcttcccaaaggccaggactaggggtctgggggacaccgcctttcaatggtccctcatccctgttatttttctacagcccccaccacacagctaaactgtcccctttgggccaggcgcagtggctcatgcctgtaatcccagcactttgggaggccgaggtgggcggatcacctgaggttgggagttcgagaccagcctggccaatatggcgaaatctcatctctactaaaaatataaaaattagccaggcctggtggtgggcacctgtaatcccagctattcgggaggctgaggcaggagaatcgcttgaattcaggaggcagaggttgtagtgagccgagatcatacctctgcactccagcctgggtgacagagcgagactccgtctcaagaataaataaataaataaa

SEQ ID NO: 51865 - DNA, 1733 bp, Homo sapiens
gggagaccgaggcccagagggtgatgtgctgtgctcacggaaggaagtggcagaaatcagtctcctgcccctccagggcttggttcaccagcccacactgtacccattgtcccgcttcctgccccttcctctgggtgccagaactgggcatcatccccacggttggggaaccctggccaggttatggggagaagtgggggagctggcctgagctctggtagaggggcctcagagttcagaagaggagctgttggcctttgactatttttcattccaccccaaagaggctctcgatacccccccgacctaacgtgcaagtgtgggtgcccccgagagacggcgatcaggttagcgccagtgaggctgtcttccagagagggcttggggggccagtccagccgaatgaggcacatgtcattctccgaaggctgcttcttgagtttcgggttgtggtttggcttttgcttgagcccagggcaatacggtgtgttgtcgctctgtgtgtgtgactttgacgtcgctgggccagatctgggcctccctggggccctctctccacctccatgccttcttgctgtccctctgccgggaagcaggggaggccaacgcagccttcgtttgctcgtggcttgtctgcttggagtggaagctttcggtgaaccttgggccgtctgtcctttgcctttgcatgtgagcaggagggctctggtcagcatggggccgtatagcctttgtcaggggttctccatctctctggctggctctgagatatcccaggcaactctgtgtcccggtctggcctgctcctctccccaaactgtggggctgcttctgtggtaaaagggcgagccgagccggcgcacccaccaggccgcccagggcagggaagagtccaggccgtctgtgtccccctgcatgtctcccacctcgcgcttcctgctaacgccgcctgcttcttagaggacctgcacctttcctggcactggccggccccagtcacgctcatcatcctgtgagatgccggctcccttcccagttcacccctaccttccatcctagccgagccccccagttaccttgattgcttcctttccggttcaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgtgagtatccccgtggcccgcacactctccgtttccccggattgcttgcacaggggcggtgaatgggaggcttgggctgagagtagcctgcagcactggaagaatttgaattcatttcctttttttttttgagacagggtctcactttgtcacccaggctggaggctggagtgcggcggcatggtcacagctcactgcagcctcaacctcttgggtttagggatcctttcatctcagcctcccaagtagttgggagcacaggcatgtgccaccatgcccagctaatttttaaatttttttgtagagacagggtctcactgtgttgcccaggctggtctcaaattcctgagctcaagcgatgcttctgccttggcctcccaaagtgctgggattacaggcgtgaaccactgcacacagccaagactcattttcaacatttgtaatttgggaaatttcatatgttcagcctctcttggaagctcgaggaggtca

SEQ ID NO: 51866 - DNA, 2329 bp, Homo sapiens
cctcaggcttgtgttgtgtttgttttattgtgtgtgtgctttttggacctggctactaaggtgatggaaaaaccgtgcccagtcttggagggagatgggttggcattgagcaacgatctattcaagttgcacccagggcgtggggtgtgatgtcagcttctggcgctggcctggaatgagacggtgctgctgagacaggtggagtgcgggcgtctctcttcccgcccttctgggatgcgtgcacaccttgtcttccatttattttctgaagttaactcaagactcatgttggatttttccaaagcaggtatattcctttcctggggcctcagtttccccgtctgtgaagtgaggttgagggggggctagaattgcggtccttgaaaccccaggctttcttagagatgctttagggtttccttgaatatctaataaaaatgatcatttaaaagaacattaagacgttaatacagtgataaaaatgtgctcacccacctttaagttcttaatattaactcactgggttctactaacatgctaacttgttagtagtatgttttgggtatccctaagaattttctttggggaggagggcagacatttgataaacattttttaaaaagttgaaaaaccactgggctagatgatctcaaagggtcttcccagccttggcaatatataaatctgagtttgagctcccagcccgcttctgatcccctggccataagagaagtcaccgtctaagggatgagacccaggtgtctgcctggactgttgtggccatgaagggctttaaatcatcccaggatatctattacagaactccaagcaatgatgcccagaaggagcctaacccagaagggaaaggttccagggtttcccctggtccacctggaggaagctgcagctccagagacccccacttgcttccccaaaggacaacttaggctgcgaggctcagcgatcttcaagccggacgcttgttgagttccacctccatgatttctggccacatccatgtactaccgcctgtgctattacgtacataaaatattttaacaacttcattgaggtacaacttgcatatcacaaaaactgcccattttaagtgtacaagtcaagatgagtaaattcacagagttgtgcagtcattaccacaatcccgttttagggcattgcatcagcccccaaaaagatccttcatgtccatttacagaaaattccaattccaagcccagcccaggtaatcactgacctgctctgtctctagaaactagccttttccggacatttcatagaaatagaaacatacactctgcagtcttttgtgtttggcttttttcacttagagaattttttttgaagttcatccatgttgtagcatgtatttgtaggctgttcctttttatagctaaaaatattcctctgtagtatagaccatattgtgtttatgaatccacccaggtattcaatgtattttaaatttaaaacgtcaactgtataccaccgagcatcatctcatgtgccatcagtggtccacaaactgtgctttggaaacaccaacccaaaccagagcccctggcctggggtgcctgggtcctggccccagtcaccactgctttggttttcccttggcccaaccaggtctttaccacgtgggaaatgtggtcgctgaagccgcaatgaggacgaggttgtcaagcgttgatttggaaaccaaaacaaacatctctactctgtcaccacccagggccactaaaatatcttgttctgactttgcaagctgggggcttttccctggagtttcccactgagtttatctgaactcaacagtggagagttccctgagttggcatccaggagacctggactttaggtccagctctgccactaggtgctgtgtgacctctggccaaccgctgccctctctgggcctcagctcctccacctttacatgcaggagttcctgtgggtgatctctctcagcttgctctctactttaggtcagtgactccaagaggcccgtgttgtggctgatctttctgcctctggagaccacactgtgttcgctgaagcctttctctgttctgggcttccccttccctctcctatctctgccccagataactagggtccaggctccaggcataggcagcgctggccatcccatccccaggcttaaccggttcaaccgtttcccctgtcttcattggctccaaggaaggatgcaggaaatctttaaggctgtcaagaaaaaggtccctccagcctggcagctgtcacaaagttgccatggactggtaggggaagttgccctgggctggtagag

SEQ ID NO: 51867 - DNA, 1012 bp, Homo sapiens
atctaaggtcaccacctctgacggtggtgggacccacagtgggtatggggcagcaggatctgtgctttgctgagtttctgagtcagggggctgggacaggaccagaattagccccaggtgccaagtttacagggggaagtcatccagagccccgaactctcacgcaggatgggaggtgggggtgttctgggcatgggcaggagtgaagggcacagggtctcaggctcattgttctttggactctgttccttagatccctctgctgcctttggccaatgaccttgacaccccatccaccccttctgtccacaagccagcttggtcccgacaaggagtcctggctggaccccttgttaggctgttcccggcttcagagatctgggaactgtaccagagttgtatttactgagcacccactccagcaggatcaccatgcctcacgtgatctccagtccttttactgttgttcttcctgttttacagatgaggaaccttaggctcagagaggcaaactcacctacccaaggctgcacagcacgtaagtgagatgcagcctccctgtccagccagcctgagccctgcttcttcacctggccctgctccccatctggtctgggcacggattgggttagatcatcccagctcccagcaggagggcacagctctgggatccagggtttggccaggtgcccagcaggcaggcagggcagccacagccaagggttaactggccgcaggctgggagccgtgctcggggctgggcggacaaggtgcaaggccctgggaaccagctccaggccgggctgacagggagctccgcaggcacccccatcagccctcgtgccagaacaaacagggcaattaggaggtggcttttgtttggtggggcctgaatgctgggcatggagctgctggcgcttcagcccctaccccctcatgtggcgggaatctgctcgttcacgggacagggtcacatgcggagtgtcacagcagacaaaaggacaatgccact

SEQ ID NO: 51868 - DNA, 1552 bp, Homo sapiens
ctcagcggaagctctgtgctgggatggtcttcgtcgacctggtgcctgcctccgcgtctgggcgggcctgtgctaacactgctcacctctgtgtgtttgttaactccaccacctctttacggctcccactggctctgtttcagcctagatgtttcaccagcatcataccttagcacatgcctcgcgttcttcccagaaagtcagccctgggaccaggtgggctggtaaagtcctcagtgctgggccctgtgcctgttgcatgagcctgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaaggtgttgcctgctgcttcaactcgtcctcagtggcgcaggccaaatggtttcccttgaatgcacagccatttccggcgtcagcccgggaagactcatgtcagacccgctgtctccaggcctgttgtcagcgctaagtgcaacctgtctattcttggccagcaagttggggcaccacattggatggctctgatttttcccaaaacaaagcccatgccttgctcttaattttttggccttaagagctggaacccaaagacacgtggagcccagagctttcctagccctcggctgaaggaaggctcgcggagtagggcacagtcttgttggaccacagaggcctggggagcatttgacattctcatgctgctgtgaatcgggaatcccttggtgacttctctcc

SEQ ID NO: 51869 - DNA, 2100 bp, Homo sapiens
gctgccatttaacacagcacatgtttgacaagttaccgtgtttgactggtttaggtctgctggcttttaagaaatttctcctagtgggaatgtaaagactgaattaaaaccttgtttcctacctcatttattaggttccatcaaattccaagagcttgtcggggcccaaacacaagggatacataggaatcctttgcctttctttaagtcactagccttgcatttgccacgtctgccctggcgatgtctcccccggttccattttaccctgatctggaagatgagcactgagagaatcagatgaatttcatggagcatttttgtaaccaataaacttctgggtcccagggctccagaggttcttgcccacagctgcttttttccaagcagaaggctagtcgctggaactccgagatgcatacaccactgtgactcttcccttgctcccagcatgccttgctctgtccttgtgagtatcctcctagggacttcatgtgatggaactggattttcttttccaggctgacagataaggcagtgaaggactattccgcttaccgttcttcccttctcttttgggccctcgtcgatctcatttacaacatgtttaaggtaaggaggctgtcagaggcccagtgggttttggcaagagtgtaaaatgtctgcactcctgtccctgactctgcctcagcacccacatggctgctcctccgctgggcctgggggcgcttttttcctagaaacaaacaaccccaactgtgggagggattgacactggcagcctggagccttgtgtctgtgaggtacatttgttttgtttggttttgtttggtttggtttggtttggtttttttgagacggagttttgttcttgttgcccaggctggagtgcaatggcgtgatctcggctcactgcaacctctgcatcccgggttcaagtgattctcctgcctcagcctcccaagtagctgggattacaggcaggcaccaccacgcccggctaattttgtttttttagtagagatgaggtttaaccatgttggtcaggctggtctgaaactcctgacctcaggtgatccgcctgccttggcctcccaaagtgctgctattacaggcatgggccactgtgcctggcccacatttgtagctgagatcactcctgtcacctgctcccgagcctgctccagactcggctgtgcaggaagaccttccccgccgggtctctctttgctgctcttgccgtgctattgggataagctctgttgccctgagtgagtctgacttaccgcagccagcttataacaggacactcctctccggagagaatctgagtttttgagttggttcctttcatcatcggaatgagacagctcatggaagcacattgacaagtccctttgctctggggaatgcgaatgggaagtgtacggggagggaatgcagccacttgttggagcctgtagcttcaggtgacacagtgcctaataaggagggcctaagaggaatgaagtgaaattgtgtcgttcctggagacaaaacgcacgctctagggtgcctgttggtatgctttggtgtaggttgggagggctgtcctttgaggggttgaaatggcctgactgacttgaggcggaagatgaggcagcagtaagtcacccacctctcttgtctcctgttgattctcgtagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggttagtgtcaaggttttctcttttaaagatcctccgcagcaaagccccatgtcttcctccgtgggtcatccgtagctttatcttcacgaccagaggaaacgcagtatgaaccagcctgtcagctgccactgaaagccctgggaaagatgcgtaaatagcaagtcaccgataacgagaacagcagctctaacatgtactgagcaccccctctttccccgacatgggctgttcactgtatgtgatctcagccct

SEQ ID NO: 51870 - DNA, 1029 bp, Homo sapiens
tttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggtcagtacctgcttccggaagctgctgctcactatttcccatcatcagttttgaaaagctgcttagtggtacgcacgtgctaggtgaaggcatgctttgtgactgcggtggttgacaccagcccttctcccttctcagtctgtcatgtcaagagtctaagctgatggctggcaggttgcctggtcatttctgggttttctgttccgctactagaaaggtagagccagtcttacctactgtagaaaatgttaggaaggcagccaggcacagggtgataaaaccaatgagatgatcagggctaaga

SEQ ID NO: 51871 - DNA, 1025 bp, Homo sapiens
agttctacattgcttcctccaaaatgtactccacatgcagccacggtatgtcctacaacattagttcattaagaaatgggcgcccaagagtggtgggctctcatcaaaacttggcgagtgtcacgttcagtcactgcagaaatgaaaacgtcctatggccttgtcgtcctgctggccccagccttggcctcaactttcccttgtattcttgtctccgtttgcaaacctttgcagccatcaggcctgggagtactggaaggaggctctgtctcccaaactgggttttcaccaggaactcacttccatttcattgtttgttctgcttccctctagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacgtcagtaccctgtgtcccaggggcggcatctcgcagacccaccctgcatccctctgcccgagatcccctcagctttttcatagcctctcatgctagttccggagcaagcgtctggcctaaggcagcctttttgccgaggtggggatgctcatctgcattcttttagggccatgcagaaaaagcaataaagggaacttccttcccccaaactgccctgtctcccaccatgggcagcccaagaccgcatccttggactgacgttcagctcacaggggagcaggaagtgggaaaagtcaggccactgaagcctctacttcgatgcagcggctacttctactttccagactgttctcttgaatggggggaggccacaggtcggagctgtgcccacatcattagtcaagggcatatagattgttacaggtgatggtttcccatcaaggggatgcagcagagctgaggacccagttcataaatggaaaactggatttgttatc

SEQ ID NO: 51872 - DNA, 1068 bp, Homo sapiens
ccaaggcacataactaataagtggttgacacaaagggttctgtgctcttctaactgtcccaccttggaggaagcagagtcctacaagctccttttccaaagcacagacttgagtgtcagcagttgaaaagctcacctgggaacagtgaatgaatcatagtgcaacaacccttggaagctgagacttggcattgctggcacgaagatgctggcatgaagaaagggggcttttctgatggcaggtggcaccttgccagggctccagctggatgacttcctttgcttcagtggttcctgtaggaagagagaatagcagaagggcctgggtctttatccttattagaagacagctcaagggctttcctctcatgcacctgtccttttagtggaggtagaaggttagccctgttcctgagcatctccaagctagggtgggagagggtgtgtggaaatccccttgacatgccaccggggttcccctacagacaaatgaaaagggccaggtcgtgaccaagacagcactcctgaagcagatggaagagctgatcgaggagcctggcctcacgtgctgcatctgcagggagggatacaagttccaggtacagctgctgggcctacggtcggtcctgagggcccagcctgaccccttgttctaggtagcatccccctcctccaggccattttgttcttagctaggcaagatcaaggcctgcatcttaggagattaacaaaaggaccagctgtcctctttagaggcaggaaggcgagctcatccgaactttagactttgttatctttatcatcatcatgacaaatgctgctcattggattcttcctatatgtgaggcctcatgctcagagctttgtgtaaactggataattttatttaaacctgtaaaaagtctcaacttgtggttaagcaaacaaaggtcacatggcagagccagaattccagcctaggcttctcagactccagacctgggcttttaaaaacataccatgctgcctccattcagggtaactggggagaaaatcagaactttctaggcttatccaaactagattccac

SEQ ID NO: 51873 - DNA, 1494 bp, Homo sapiens
attgtattggtatattttgaccacctgagacaattaacagcactgtcacagaaatttagaaacgaatttctcaagtgaaactccgactgtttgttattccccaagaagtgccgagacatagttcttctaggggtattcctgatgactctgatggaagtggtgacttttggggctcagatgttggctgcagccacagtcctgactgcattaatggcatgttcaccctcttttctgttgcagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataagtatgttactttgatttcatatagtgaaatgagagtctccactaaaacgccgaactaggtctgtgagatgaggaagaatcctctgaatacctattagatttttgtgtcctcgttctggcttttaaggagctcagtctagttgggaagtgaatagttaaaatatactgtattagagtagcaattggctagtcagagaaggcaaagtggttggtgagatgggaggaatatgacgagatggagccacgtgtgcgcaaatgtgagtgcaagagaaggctgtgagcgtgggagacatagcaggtaaacagggagagtggcaggagccggggcagataggtctttgtgtcacgttagggaatttagccttgatcttctataggctgttgacagttgttaaccaagagggtgacatgactgggttttgtcccgcctttcacaccctcaaactctgctctttcctcctagatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaagtatgaagccctcccgcagcggggctgctttgccttcgctttgccctttccttttccttctccatcagcatcttggcataaagcttcacgtgtgccccttgccctccttggggcctcccaaccgcttctggaaactatgtgggtgaccattcaaccactgcagagtcctcggggcttgccggaaaaggatggcaactttttggtttctacttagagtactcacttctttctggcttttcagctgagctgggtggttctatgtgattctttatgacactcggagagggtcacggttaatcatgccctgggggtttaaacaagccagagtcaacaactggtttctaggtagcctttgcttccctggcctgctaataagccttcctttgctttgcagtttggatgccgacatctggaaaaagtttttgtc

SEQ ID NO: 51874 - DNA, 1729 bp, Homo sapiens
ttggagatacggaaaagggctgtcagccatcagccaggaatagggctgtcttatcctggcctattttattcccatcttcaccttaccctccatttctgcttggcttcccttctcccctagatgaagaagaagatgaagaagaagtgtataaaatggctggtgtgatggcccagtgtgggggcctggaatgcatgcttaacagactcgcagggatcagagatttcaagcagggacgccaccttctaacagtgagttgggggcagcaagttgtgggggccagcctttctgcactgggagaggcccctgtggaaagaagctatggccactgtgtcattttaccctagagggcagcatggtgccgtggagcagtgcgagccagtgaaggacctggcagttaggactacattcttaggcacaccttttcccgtcctgctggcccacttcccttctccaatacctctctatagagccagcatctgactgtctttccccaaatagctgcacttgtgttaactattatcattgttgttgtttttaaaatggattttgtaatgtaactcatttcttgcattgtagggttttgtttgggtattcatccaactaatctccttagtgaggattagagcattccagagaggcaccacaaatactacactgttattttcactactccccacccccactcccccagggtttatgagaatatgtattattgttattattgtgcctttgttttaaatgacctatgtggttctgagctctcacaggccacgagctttgggatcattttctttactattagtttagggtctgagttgatgctgggatttcccccaagacaacaaacagagcatcacctcttccattaggaactgctgtcattgccgttgtattagagatggtagagatatatcccgccattggagctaccagcctaatgtgagagcccagccatctcaccatgtcccctgaagagccgcttctccctcctgtcctcttcatttcaggaggagcccctgctgatggtgtagaccctgcttagacatccctttcctactggcccccatgtcctacactctcatgtggcctcatgggttttgactggcttttcttgtcaggtgctactgaaattgttcagttactgcgtgaaggtgaaagtcaaccggcagcaactggtcaaactggaaatgaacaccttgaacgtcatgctggggaccctaaacctggtaaggagcatggactgcaggtgaagaagagtgggccttggaagtctgggtgtgaaagacctctcagttctgggctcagatgaaatggactcacggcttcttcaagcccttcatctctctggctgactggtgcagaggcttgggtcattcagctgcccttctcctctggctggctcacctcctgcccccatgctgctgccatggcactcaagagcttccttgctcctttcctgagttcagatcagagataagaggaaggcagtcccttaaacagtctagactacacaccagtgggaaagaagtgcccctctccttggggcagcaaagctgcctgtcatcaaaagctcacacgcttgtctccctctcagaacatgcatatacacgcacatacatacacacggtcatacacacatggtctctggggagtaaggctgtgagggcatccttgagagcaattgtcctcagcagttagtggctgtggtcttattctgagagtgactgag

SEQ ID NO: 51875 - DNA, 1053 bp, Homo sapiens
ctgaggaattctcactgggcttctatagccggaaacacttctgcaactggcctttctggcaggttgtcttcctccagggtgtcctgtcctgaagctcagcatagacttggaggcaggctgcttgaattagcgtgctaccaaatcccccactggatttcatcagtggttactttgagctccaatttctagtctgcaaaatgagaataatattaatatatgtgctcagtgccagacatacagggaactttccttattctccaatttagtgaagttgctgtaattttgtcatttataaaagacttgattcttatcattctagtcagattgtgggtttagcttaaagaattgtggatgaaccccctccttgtatggttatataaagacgtctgaatctctgtaggtaaagattgatgtactctcttttcctgttttgattcccgaggcttgagtcaaagctctttgatttaaatggccttgtttgtcctgggtagtagtccctattgattggagacagtttctactcctgaggaaggtccaggcttggaattagacctccgcttatagcttggtaaccttgaacaagctgtgtaaccttatgtaaaaggatcatagaaagtacttaattagcataggacctggcacagagtaaaacattcaataaatatttgttagattattacatagtgttctaatgaaattgaaggagatagtgtctttaaaatgtttcatacaatgtctagcttctagtagacacaaaataaaattagcattctttcccctaagtgaattgctgtgcatttggattctagatgttgtggttgagactttgtagaaaaatagaggctctccacattgctggggctttaagcaagaccaagtatggagtcctttgcatttgtctgggcctgtttttaagtacctttctccaactttctctgctcagggagagcccatgaggattgtttatcgtatgcgggggctgctgggcgatgccacagaggagttcattgagtccctggactctactacaggtagatcatggcactgcacatt

SEQ ID NO: 51876 - DNA, 1032 bp, Homo sapiens
atcacatgagaccagcaggaggaggaaggaaagtccctcctcgcaccccttccccgattttttaatatatctctcatatgtcactccttgtctgcttgttttgttaggctttatctcctaatccaccctggggtttcagggtagatgcttgatattttagtctacttgagtttgtttagatttttggaagtacctctgagtttcctgtcctttgtatctttaaatgtttggggggcttgctgagtttggtgtgttttcctcgagtgtccatggaacaaggtagcatggtataaatctccacctctgccatcccttctgatgcacccttctgtctgtcctccaggaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggaggtaatgaccataggacagtgctgcccacgtttacgattaggggcttcctcctaggctaaccaaatccaggtgcttcttcctagtagctgattaacttggggcaggtggccttcagtttctccactctgtaagttggggttaatgattcccacctttctacctcacctagtgctaaggttaataacctgtaaagggctctgcccagtgcctggcaggaagtaagcatattgttaatggctgttggttgtagtggtggtgggtatttattatcgttattgcctctggcagagacttctcggtgagtctgagttacctgagccccctaaatattggcgttttaccccctgtgcaggtttatgtccccgtgtcagttactttctggcagaccgttgagggtctgacatttttacatagtgaaaagccttttctggtgctgagcctgcaggagaaggtccccggtgggtgtgtctaagctggagcctgtgtgtggg

SEQ ID NO: 51877 - DNA, 1085 bp, Homo sapiens
ctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggtaaagagccacctggaccttcctttagggcatcctgaatctgtttagggacaacccttagttccttgggtgctggggttgactctcttctctctggtactgaccttagtgcagatttaagctctgcattttttttctgtattgatacgtttatgattttgagaccctgtttgctattgactgtttccgcttgttgaacacctgctctgtgccatgcacaaagatagattttccctgctttttgagttgctcataatcttttgagacacagactgtccttatgttttcatccagagctctcacagcaacattttcctgtctccacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtagcactgcccagtggcctggagcctaaggcactgtcccttctggggctgccgaggtgcattcgaccaatttcccccagttccacagatccagaggaggggtggcaaacatctccctgcattcaaagggagactcatttcttgacaaagtgttggctcttggaattttaaattctagagctgggctcagtcactttggatttttcatgttgagcttatagagtggtgcaaggtcaaaggctctctcattggtgtcttctatcagtctggaaaattctcagccattgtctctttaatcccctctgctgtattctctttcttttccttgtgaaactccattttcactctgtcatccatatctctccatctctcataatgttcatctcattgtgtatttatgctgcatttttgacaatttgttcaattcag

SEQ ID NO: 51878 - DNA, 1055 bp, Homo sapiens
accattgtggaagctctagccaccattcccagccgcaagcagcaggtcctggacctgcttaccaggtaccatttgggagtgggatgaggagcgtggttagacttgctctagagccttttcatcttccccggggaatccatggatcagggtaatgagaggcacacctctgggtagaagaccccagaaacaacaaagtgttaaaaagctgacttttagtgatggtagtggtggtggtcgttgtggtgagggtgttagcagcagcagcagctaatatttgagatcttatgcagctaatattgatcgagattgagtgcataaatgcttggcatgcattatcttatttaattctctcatagcaatcagtgccaaaatatgaatgcttagattctgtggcattcactccctgcagtgtgctctgaatgcttcctagatgtgggaaattcccatgtgggaattggagctgtcttggatgctgttcctccaccctctaggaagcaggagagacagacagcagaagataggaaagattgggaggagaaaggggagccttggagctgttcgaaatgctagagttcttgactagagtgccctgtccctcttggtggcagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggtatcctaccctattgcccaagagagccccttccctaattcccccttgtaccttgatgtaaactctactatggtgttttgtttgtttgtttttgctgagaagaaatatttgttgaaggtgtttggaaatatttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaag

SEQ ID NO: 51879 - DNA, 1032 bp, Homo sapiens
ggactttggggcttattcagtatgttgggaagcaagagtgagtgatacggtttgtgttttttattaatagtgggaacattgttacaaagagacgtaaactggaatatgagggccttgtggaaaatgaaatgcaggcagatggagaagacagggaaagagttgtgaccaagactgagagtggacgtctaggttttggagactgtgtcacaccagacagcaggggctctgtcgcctgggacatgggccccataaggtggtgctgctcttccctcagttagcttctgttcataggcaaggcggctgtaatgggccctttattattaccgaccacggttttgtgaagctaaagttctagtcttgccccgggaaggaagtagaaaatttggggccaggtagccttagacattgatttcattttccctgggccccttcaggtggaaaggagtgtcacacctgattgtgaattataggactccatttctatttgcttctgcagagacaacccagaagccacccaacagatgaatgacctgattattggcaaggtctccacagccctgaagggccactgggccaaccccgatctggtgagccggcctagcaggcccagctgtcctctctgacttcccctcacatgccttgtgtttctcagcttcccctcccaggtcctgcggtgactgaggagggaaggagcagaacattaccccagaatggttttcccagggaagagcctggagcacaagggtctccgtctgtcctttgtctctgttggagccacctaggaccagaaattgtattaatagttaagagtcgctggaccggagctgaccctcttgactcatgtctcttcccattgccttctaggcaagtagcctgcagtatgaaatgctgctgctgacggattctatctccaaggaggacagctgctgggagctccggttacgctgtggtgagttaggggattttcagagaaaggaaaggaggctcaaaggagcagtcctggccggactgggaggggaggagggaaactga

SEQ ID NO: 51880 - DNA, 1033 bp, Homo sapiens
tcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggcct

SEQ ID NO: 51881 - DNA, 1946 bp, Homo sapiens
aactgtggagagaatgtgtaccagtgtcacaaatgcaggtaagtcattggtcatcccctaggccagggctgtgcacattccttgttatttttctgtagtagtgtcagtgtgagcaattacagtgtctgattccctcagaacatttagagaattatgggtttgtagagtgggttcaagggtagaaagggaggaggaagaagagagagtgagtgagtgtgtgtgtgtgtgtgtgtgtgcatgtgcacacgagtgtgtctgtcctgtggcaggggtggagggtaagggcggagggaggtccagaagtttagctctgggtcttgctttcttgttacctggctgcttaagtcattcatttgttattgtcccttcagtagcccctgcagtagttaccagagtatataaatgtggcacaatccatttcctcagagtgacccccaccccacccagccttgtcaccttactgacccaaacgctttggttactcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggtgaggccagatctggcctagactcagggctgtggccttgatctggactttgggcagacctggtgcagtgcagtgcactttactttctagcctaagccttcttcgactcaacaccagtttcagggcccagcttttgggtgggagcaaagaatggcatgaggtatattgtattgaaagacatggtttgcataggattttagaaaagtgttgattggtaatgaaactagagtatctccaggtacagataactttggatttggatgctttgccctgcatttcttccacagactgcttcatattgaggctgctggccctccctcagtattagattgtccagtgctagttcccagcctgcataatatgggcaggggcggggggaggttctagatattaaagaacagtgaaaaaggggcacctatagggttaacagaagaacatttagctttggagtcagaaggacagaaattctaattccagccatacttttaatacttgtgtaacctagtataagttacttctctcagcattgtattattatatatcacagatgtgtattgtatttttattagaaataatatacccacctcacaggaaagattattgtgaagaacagagataatgtatgaaacacagtgcctgacctataggaaatgttctggtaaatggttagcagtgaggattactcagggaaagtcatcagccaaaaagccttcactcagtccctgtcttttcctgtctaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatctagcagtccaggtcttggtgttgtccctgcccaatctagctgaaaaggcaggcagatggctgcaccaaacggcatctcccccaccgtgatttatggcgctggtcagaatgctgagttcatgcta

SEQ ID NO: 51882 - DNA, 1901 bp, Homo sapiens
gtcctgaggccaataggtccagtgggattcttgtttccagagatggatcattatcacatagatgttcctctcctaatggttggtcaccgatagtaggaatttttatctgccacatttattaccttaaatagaaacttggctgggtgcagtggctcaagcctataatcccagtactttgggaggctaagatgggaggatcccctgagcccaggggttttagaccagcctgggcaagatggtgagaccccatctctacaaaatattttttaaaaaattaaatagaaacttcatcttgtggatgaagagtgggttacactgatgaatttttaaaaaggcagtacgagtcttgaactaataccatgttttgtgaactcttgtatttagtatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagtacgggctttttaggcctcgggaggggcagcaggttgtaaggctgaagctcagttgctgccttcggttcctggaatggagtaaggcagcacatccctagaggcctaatacatcctcttggcccctccattcatgaccaaaggacaaaagtgaaacaacagttctaagcatgttgacaaagattatttctaaattagcccagtggagccataggggtctgtggaagttcctcaacagcctgcctagggaggggaagctgagtgaggggacctccaggcttctcatgcccattttaactattcttacacaaaggtctagacttagataaaaccttctgtattgggaagtaattgtcatttcttggattaagacagctatgctcttgctcacagggcagaaagttatttctcaagaagcttctttagtacacacactcttcgatttccacatggtgccttttctctgtatctgctgatactggatcttcctagcccatgtatcccagtgactgaaccagggcatgtcatatttaggccaagagaggcactcacatgggttatagtgttgactttcacagagacagatcgcctttttttgaactctcaggcattgctactgaagggagaacacaggttgacactacttgaatagtaagacttacagagctgttctgcacacaggatggaagtattgctgttattccaagaggcagaataaggctcatgtaccacagcaacacgtggccatgaaggctgcctagggaggttttctcttcttgccttgaaaagcctagtttaaccttggtgacctgaaagtagatgctgcacattagggtggcccattcccctccagaggaggtgggtttgatttttcattgtgtggagtcagcagagctactggtagactatttgggttcagatcccagctctgctacatagctctgtgaccttagagaagctgcttaacctcagtttctgtaactataaaatggaggtaggaccccacttccagggtttaaggattaaatgagttagtatgtgtcaggtgctgagaacagagcctagtacatagtaagtactcagtaaatattagctctcattgtgttatataatcaccccaaaattattacataccttcctctttatgacttgacttagcacttggttcagaccctgattttcttcctctgcctctctaaaatagcctgggtttatctttccaaggttgctgtcaggatgggaacttggcatgcatcatcattgcacctcttacaggcttcagtgtggcatgcttttggagtcatggtttcccttgttatatact

SEQ ID NO: 51883 - DNA, 1049 bp, Homo sapiens
tatatctagttttgcatttcttggtaagcactcgtaatatgtctgtgatgtagacagtatacactaacaaatctaacttaacataggacgtaggtcaaggtcaggtggggaaagaagatagaactcattacagttccttggaaaagcaagtgctccttgttttgctagtagccctgattatacataccagaaaatgtttctgcaattagctaaccattttatggcttctccataaaaataaaaatgatcttcctccatcaggtcagaaaagggtactacctatcactaaagctcatggaaacttctaaaggagatagaatccatttaaatgattgaaattaggcccagctttgtatgattctgactgagaagtctggtaggtctagggcagtattcagctagaatgcagaagacaaaagtcttttccaataagacttcaccttgggctttaagttgtttctttactgaattctgtttcagttgaaggagtattcacagaaggctgtggagattctgcggactcaaaaccatattcttaccaaccaccccaactcgaacatttataagtgagctttgttttgctttctacctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctcaaaaaaaaaaaaaaaaaaaggtctttagtttcaagggtttaagttaaat

SEQ ID NO: 51884 - DNA, 1508 bp, Homo sapiens
aagagcaagaaagaagaaaaagaaaaggagaaagatggtaagggtcaccctcttgtcattgtgactacaatgatgtatgtaaatctctcttggagcacatggtttgtcctgttgtaaaaggtcttttaatcctgatttagaggggacttaaagcccaaatgttctctagtgtctacttttggtctcattttcaattatactgaagtgacaccttaaacagcatgacttctcataccaagtgacagtaataagaaaagtcaaagtgcactgaacatttttagtagaccaaatttcttattctgtgaaataataacaccttctctatggagctcccatcagagttcagtgaaatgacactgagtacattggtaaatgctcagtaaatgttagctctcttagctgaccctcaccatcagctgcactgctttccatggtccttggagacctgagatcagtggtcagggttgagagccatggtggtggttcacattcccccagttaatgatcagacatctctgtgtaggcctattgcaagcccttgaaaggaagttcctcctcctccagtgtcactgtatttgttcagtgccagcttacatagcactttatcctgtggtttttagtgtcattattgtatgtcttgtctggaaggcagctgtgctcaccactgcatcaccaacgttacacatatgtctcatttggggctgacctatttgtcccccagtaaacaactaaaaattgttttgcagaatatcagcattcagtagaaacttttagaaatggacagaattccctccctcaccatttggtagcccaggccttaggaccctggaggacttcttcctactcttcagcccttagtcctgtcctaatcttgcaggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacaggtagggccagggcttggtttgacagatctgcaagggtgtgaggccagggtgcgtaatgcagttctattttgttttcggttacatatggtcacagagtcagtagttacgccagcctgaatcctcttgtgctttagagatttctttattgttgtctgctttttagccattaaactgacgtcataggcaggagacgatctgttttctactcagaaggctatgtatcggggtttgtaacatgaccaagcttgacccttcaggctaaaaaagctcagcttctgctctgggatatgttgggtgatgggtagaggcagcaaatgactatgctgcatctggtaggattgattgtcaaaagtgaaacaaaaccgttcaaacttaacccataattgtggggaaattgaggtaccagagcctcaatgataaacacaggtgcctcagggttttctgctgcttggtaacatgagc

SEQ ID NO: 51885 - DNA, 1118 bp, Homo sapiens
tcaagaggaaatagcttggtttgtgtttctccccagcctttgtttttttttttttttttaagaccaagtctcactctgttgacccaggttggagtgcagtgacacgatctctgctcactgcaacctccgccctctgggttcaagcaattcttctgcctcagcctccctagtagctgggattacaggcagtgctaccacggccagctaatttttgtattgttggtagagatggggtttcaccatgttggccaggctggtctcaaattcctgacctcaagtgatcagcccacctcggcattccaaagtgctgggattacagctgtgagccaccgtgcccggcctgtccccagcttttaataacagtttattaaaacccagggtgtgagagccacagttgatatagatacagtcccagagtcatttactctttgtggtgtttttcttctcaagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctggtacgagggctgggacctggtagggcagggaggggggatgtgataaggcttagccaagtaggtaatagggctggaggtaataatgcaggacttttaactgtgttgacaatggcatggttagggctgagatgagggtaaatccataacccctgtctgggtgctgtaccatgtgtagttggcttcaggatctgggatgtccccctcagcactctcatcccacctggcagcagttcctccactgtgaggtgagtggcccgagcttcttaccagtgccatttgcttacatcctagtcaggactgatctctttgtgcacctctggtttttacccttgaatactaaagaaatgatgaaggttcgagtagaaaaatgtattgctgcctaaagagaaactgtttggacttagaggagtaaactgagtattttgtatgtgaacaaccta

SEQ ID NO: 51886 - DNA, 2417 bp, Homo sapiens
acaaggtgtgagagagtagagcagtgactggactttataagaatttgggaaacgtgagaaagaaagggctgggtcactgtgcagctgggtgatatagaatttgtatatagcagaattctagaaaataatgtctggaggcagaatagggccacatattagaaaaaagccataaatcttgcagttggaggtttggttttgaaactgagaactactagggcctggaggcttgggaaatactttgaacttccctgtagtaggatttaattcagtgccatcagttgtattttagaatagtttcactttcttttaacagagtgggatctctccttctgtgttgctgactggcataccgattaggcagttcttaacttttttttttaatgctggagattgttcctaagcattaggcttcttgttgaccttggtagcagggtggggttggggagggaactgtattcagctgtgtcctgttggagtacagctcatattttctatcttttccccacccttttaggctgcacatggtccgtctaatgctgttggagagattactgcagaccctgcctcaattacgaaacgttggcggtgtccgggccatcccatacatgcaggtatctcttagctcacctggatctctgtcaggtcatgattggaccgtccttaagcatgcccacatctctcttccagaggacctggaagccttcgtttggtgttaggccacagaataatgaaatctaatttttgagctacaaattatagctcttcattttataaatgagaaagctaagggtcagagaattttttaaatgcacaagttcatccaggtagttattgacagagccagtgcaaaagcccacttctgagattctgagtctctagtctttatgttgatattagagtgtgggccaatagctgttcttccactcactagctgtcttcctcagaggcaaaactgttctttaattcttagtttggtgtaccaccctttctcaagctacttgcttggatataatataggttagtccattaattttacaaactttttacaaaacatttttttgtaatgtcaagtgtggcatatatcagaatttgacttttctgactctgaacactgaagctttggatacctggaatttagaacgctataatggattacagttatgattgatagggatgtcaggaagattaggatttcttctgaaacaccccgtatttcaagtcgttcttctttaggaaattgggttttgtgttttctgtctttgacttctaggtcattctaatgctcactacagatctggatggagaagatgagaaagacaagggggccctagacaacctgctctcccagcttattgctgagttgggtatggataaaaaggtaaaatctgagaggcagactgtgtgagaaacaggattggctgagatcctttctcaggttcccattcgtttcatagaggaacttcacctcgtttcaaggggtaaccatccactgagggctgcattctgttgagtcaacaaaagcgtattcagggcctgctttggcccgagcatagttttggaccctgagcatagttgagggcaaagatgaagttcttaccctcatggcccttttgtgctcagtgaggtgagaacattaaattagttgttcgtatcttaatatggcctcttaagtgtatcgggctctaggtaccccaagtatagtccatggatatactgggggttgttttgtgtctgattcaatctgaggaacattttagggctgatgggcttgacttgaagggatcttgttcagaggatgcctcaagcatcgagtaagtagaggtttctggacttacgctttggcctgcaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcacagaggtggtagtcctctgtaagaataaagccattgttccctgaggggagtaagattctaagctgtcaccttttcaagagcagaacctccaccttttcccgaatcccttccaagctctggtctttggtaacaatccctccaatggaggggtaaaagggtttggaagttccattattgaagagcagggctctcttctgcaaggcacagagtggctaagaggattcccctagtgtatgttgctataaggtatggtaataaagcagagagaaagcaatgtgtgtgtggtgaaaggagattagcataaagcagagaaggtagaaattgaggctgaactgcatccaatcttaatgagcttagggagctgtggggtttgctgggatt

SEQ ID NO: 51887 - DNA, 1484 bp, Homo sapiens
aaatattttgcctgttttggtaccattttgggaatccagaatgtattttacactagtggcacatctccttttagacagccatgttttaagtgctcagtagtcacatgtggctggtggacagtgcacatctagaggattgtacacaactttgtgactttcagaaaatcttccttgcatatcatttatcttgcctaagcttttgggttaggcagcagtttgtggctcttttccctagcaagaacctagagtggagatagtttatgtttctaacggacatatttacaagctttagcaatccatcgagtggaaggtgaggtctctatcctcttctgacaattaggagtctcacctggacatcttccttattagaaggccttctcaccttcacacaaaagtgggcacaggcaggacctgcagtggtgtccttggtttccagtcaatggttttacacttcaattctggttcttctcatagtaattacgtagtgtgaaaatctcactgacctagttgttttagaaaaaaatagtgaaataaattctaatctgccatgacagacaaaaggtaaagatcccaatcatatgatttttcctgtcttatccaaggtctcctgagagttagcgtgagtttgggaggcctactggttttagatctctcacctttatggaaatccctttggaatccaagtttgtttccttcaccagctggaacattttatttttgtggggggcaagctgtcgcagccaactccatcttcccagatgctgtaggtccaagaagtaagagaacaaggccaggcatagcaccccggagttctcccgctaaagcccagggtgctagctggtagcttgtcttgggtttttgttgccacctgacttatggcaccatgtgccaagggaggaaagcaagcaccttcaggtgactggggtttctttgactcaggagacaaggatgatgatgacgatgatgatgcagatgagaaaatgcagtcatcagggatcccgaatggtggtcacatccgtcaggaaagccaggaacagagtgaggtggaccatggagattttgagatggtggtgagtctctggcagcaggagaaggggaggaggagcttcacaactctcctctagctcttattcagtggacttccaaaagttaccacttaccatgggacactgacagagctttctctctgcagtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatccagctgacttagtttgtccccagatatggggagaggttg

SEQ ID NO: 51888 - DNA, 3773 bp, Homo sapiens
tagatttgaattttcccatcatactttgatactgcagggtttttattttttaatgacattaatattttatgtattaagaaacttaactatatgaggctgctttgaagatctgttgtaggtgattggtgttcattggcctgttctcttgagaggaggtaataatcctggtgatctgccagcttttctctcctctttgcttttgtacccagctcttgcttatggctgaccctctgtgctcctgttgttttacaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacaggtgaacttggcctctgtggccgtggtcctgagatctgcttcatatgcctatttaccctctcattcttactgttcttactggcctctgactgactgcatgctcagagacagggattttgcttcctggtctttataccttgtagggccttttgacattgagattgtacaattttaaacacattctttttccagtgcttatactttcgattatccttgagtttatttagtgttctagacatcagatataatctgtctctgaagttattacctcttaggagcttcaggggaaagctaagcttggttgggccctggttgctttaaagcaactatggcatatctttcgctttcatgccattcttttgccagtgctattattaataatgtgtagcaactttctcagtgctcagtgctgtttcctcatctcctcttctgttggctgggtagcaaacctgttttgtcattgtcaaattgagttgattgctgcctttacaattctgtgttatttacatgctcccatatgcatcatcattctgttcctccttttaatactacaatcccagaattgttctagagagatctctagaatgttcagatgttcctctacgttttagaagttgaacagttggaactgagatctttgaatctgcggtaaacatcctaaatgctccccgttctacttaattctaacatacaatgttttctgcgatattcctttcccagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggtatgttaaaagggatatttgaatcttggtaatgaagcctgatgtaagttctgtctttgaacagctatgaccgttagccattagctttcattcttcataatccatttcttccagaactcataattgggaagtagaagtctgcgagataaatgcaatgttcctgagacaggaatttagcagtgtggcagagtgggattttcttctaccatatcttttcatcggggttgaatattttacataaagaggcactgtgtgtgtgtgtgtgtgtgtgtgtgtgtgtgtgtctcagtggtttataattgtttttaaaaatctttgacaacttggcttaaagccagctcaaaaggcacaagtatcttgaggattattctatttctaagctatttggtctctaacttcttacactattgaaaattcagatggaagagtaaagggtctgaatagcaatatagaaaagtaggatgatcctggtgctcattcatgtttggaggacatttgggtggtaaacctaaaaggcaagtcaaggtcatgttttgtcatcacctgaggttgggggatattagggaacatttagtatctgccttcctcttcatatttccttgccttgtcttttgatatccagagagagtggacagctacttatttctgtgactcaagatatctggaaagacttttgaggacaatttgggagtttaggaaactgttaatgaaacaaatcataaataatacaggctactgtgtgtgaatgagtgtgtatgtgagtgtttgtcattttgtttgcatgaccttttacatggagataaaaggttacacttttgtctcagactctcaagtagttagagttttttcctccagattttcaaataatgtttgtctctcctttaggactaactcatattgaagctactgtcaatgctctggtggacatcatccatggctactgtacctgtgagctggattgtattaacacagcatccaagatctacatgcagatgctcttgtgtcctgtacgtagcattacaatcccagagagctcgcagcagccagggaatatctggaaaattgtttttagcttgctaagctaatgaaataaaatatatttagaggaagctgaagggaatgaagtttcaaatatcaataaaagctttaagatcttactccatggaagagaaagatttggaaaggggatgggctcagtctttcttattcagtgctgaatcaccagggacagcctactgcttgctacatagtaagtgctaggtaactcggtgaattgtgacttaaatgagcacatgaatgaaagtagtacatcaagatttctatttccagtgaccctttcacagaagctaagtgttaaaactactgattttagcacagagctaagacgtgcgctgggggcttgatcatctgataaaaagccagaaccatttgtaaggggccaaaatggcctcaggagcaaatgacctgccagtccatccccaggaactgagagacaggaggttagcgaatggctcttaatgtgtgccagaacaggaagcggggattaacttaacctgctgaacttggtccgctgggttgcaggtgagagtagagaggtattccacttgcatgtgagtgagtgaccaagaaaggaaagtgttttatagagagtttcatgaataatatgagagcaaagcgtgacagtttccttttaaacctcaggatcctgctgtgagcttctcttgtaaacaagctctaattcgagtcctaaggcccaggaacaaacggagacatgtgactttaccctcttcccctcgaagcaacactccaatgggtaatatgaggtctgggtttaggctcaagcctgtatttgggaggaggggagagagggaggtacagtagcattgggcatgctgctcatgttgaccaaggtcctggagactttatgtatctgtcttttttctaatcctacctcaccccataaagaatttaggtggcacatcaaaatgtatatagtaagtaggataaaaataaagattaaaggccatgggaaaataaaagtaccatagtaaaatcaaaatacagaaaattcacatcacaaaggtcctgcatggttggtaagcgagggtcttatatttggctgaaagcttcctaagagccatagcaaaaataaaatcacagtgaccaaagacaaaacagaaacataacttttcttgggatagaagctcttcattaaatgtccattttgttgccaaaggggcagaatccttagtggacttacctacaataagttggatagcaaatttcacaggaatttccctcacaatacacagt

SEQ ID NO: 51889 - DNA, 1078 bp, Homo sapiens
ctatgtcctacttttcgggcccatagtgagcgtgtgtcacagaataggatgcgtgttggtacaagaacactgttctgggaatcatgagcttggattccatgtcttcctctggtaagaaggaggattataatttctgaaacttttttttttttctctttgcagtccatggagcataacctagccctggtggcctagaaggaaggaagggcaggcagagtgtagatagttcattctgccttgagttggtggggttagtgataaccctgctgtcttttgccttaggagagaaacaagaatgctgctcaggagctggccactttgctgttgtccctgccagcacctgccagtgtccagcagcagtccaagagccttctggccagcctgcacaccagccgctcggcctaccacagccacaaggtaactgttctctcagggaaaggaaattgcagtgctgacagggaatcaaataagttagcttttcattgtaaagcaacagcacagcaaagtaaggtagagggaggatagcattcagattagacctacattttacagagtttctcctgagaaattctcaagtgccactcaaaaccgagggtaagccagtgactgggcccctggtttgtacttatttttctgtcactctaacaggatcaacaagacttaagaaagagaaggagggatattgagcgtgggtagccttctcgctggaaaagggtgaggtgagggagtccctcaggaaatagactgctagtgttttcgctccctcaggtgtggcacagcacgagaagtgtactgtacttgttggtgagacaagtgttgaatagttcttggagtgcctctgatgggaacatctggggaaagagggtatcacttataaaagaaaggcattgccaaaggagacaaactgggccaatttctgtagatggaaaagatgagagttcagacccctgaggaggaaggctctgagaggagccatcaacccagagctttggttagcttctgtgcctccaacccggagaactgagaaatgtgagtttaacctgctgtctctcaaggaaagacaattttggaaacactg

SEQ ID NO: 51890 - DNA, 1051 bp, Homo sapiens
ttaccctagtcctctctgctccctttctaagtggatgaaaagggggtttggggtagagggattaacagcaaagtcctaccatctgataacccactagagagctcgttctatccaaatttgttttatgcctcagtttcctcttccctagttctttattgccttcctctaccccttaacccctttctttccagttaccttctgaatacttttctttctctgtccagagcttcagctgtcaggatgttgttctttttactatgccacattaaattgaaaggagtaaaccctggggagcatgttacttggtacctttaatagtaatagttgggtttcctattcctttcctaaggggaaaagttttctaaagatgctttgtatttaccccttgaatgttggcaattggcatgcacctaaaaaatagtttgttctctcccccatacttgggactcctaggaaatgcctttgtgcatatatagctttaaactttccaatataagaggatggtttttacctttccctttgtgtgtccttttgcccactgatctctgggcagctgagctttgggtcccattgcatcaagactgttaagcccatctcagtgatccctgccacaggcagcagaaggaagcacatttatcctctttgaggaagaaaagccctgtctttgagttacggattacgaacatggcctcaggttgatctctgagcaggagccaggtttctcctggcctgtaacgtaggaaacgatatgcatggtgcctgtggcaggtcttattgtgctttgattttgtatttggcattcattagctgtccccaaggtcctcatgactatagtttgcttaggctaaagcgcaaggcggagagaacggtgttgtactcaagccaggttttctgtctccccaggctggttgtgagttctttagaagccctggaaagctgctttgccgttggcccaatcatcgagaaggcaagtcactttttcaaagcacatggaagctttctgaagaggcaggaagtcagtggagttgcccgaggccctgaggcctcgaag

SEQ ID NO: 51891 - DNA, 1747 bp, Homo sapiens
ttgactgactcaggactcttcaggaaagtgaaagcttgagtttagcagtgagcaaatccagctaagcaaagaccattacagggatcatcacattaccttaaatttgctctacagtctattttgaaagaatggtttattcatttacattcattaaagaagtagctcctattgtttattttaaataacccagttacaggagagcctattgttattagctgtacacccaataccaatgccagatttcttggtattgctaggacatgtcatagttagggataacaaccattggagagctaaccacatgtaggcatcatgccgatgcaaatgttataatccagagtttgcttagattagagtgtgagtgtgggctctgtctgggaggagtctttaccagtggtgttggggcagaggtgggagagactcttgacgatctggtaccgttctctgcagcaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaaggtaagaatggcactgggctgggatcaatccctgggtagaaggactcaaacaatatggtttgagaacacatctccttttagaaagcaagtatagagtatatactcacagtcacaaccctcggttctagttaaatggttccttagaaaaatggatattcttactcacttggcaaaggacttgtacaggttgggtttccaccaataccagcaggattactgtgtagaggacatcaaagaggtggttaatactggggagaaggaagcctgacattgaagagaatctgctctcttttcctattttcccatttttagaaacaaggaagtcattaccagggagttaaaaggataagttttaatgagcttcacatgttgagacaatgtcagagaagaaggagtcctagttaaaacttaagaacttctgtagtttcttgatgtgtgccttgtctccctacagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcagtgagtcaccaacccctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggcc

SEQ ID NO: 51892 - DNA, 1523 bp, Homo sapiens
taactcacacttttctgtattctggcctctccatcaccactaatgttgttttaacttttattttaagtgaaaatatggatagtccttcaaacaactctaaaatcattttaaaaacagtttcctagaaaactagaaaaggacagtggtacgtaggtattcttaaactattttgtgaactatataaagagaaattgttttcattacttacctgttctgtcctccatggaaatacattccatagcttttagccaggagtaatagagactaatactgatctaggattttctactagacttatctgtaaagaaaaaagtgtgcaacctgttatccctattgaaagagtttttgttacttgctttgacttctctgagaggaccaggagtaggaataaattagtcattgttcctttgcagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggtaaaaatccggatctaggtttgattgccttgagctgtggattctagtcattttctctcccctgttctcagaactactttttcttattcgttgtggagattaaaatttaaaacctactgaaatgcaaaaggaatttttctttgaatttctcccagatctttcagatttctccaatattggaagtaatctttgtgttcatgaaacctgaatgttactagacagtctaaatactgtctgaaggcaggggatattagaggaaaaaagggaacgtcattactctgaaatgaattagcccacttttcagatcatcttttcaccattttgtttcttaaacattgtccaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaaggtacagttacagttctttgatgatatggtcctagaatttttctacttttaaatccagaatcactatgtgctagcttctcccaggagttaaaaaaatcagctgggtgccatgactttcacctgtagtaccagctacttggaaggctgaggtggagaattacttgaggcttagttcaagggtgcagtgagctgtgatcatgccacgccactccactccaatctgggtgatagagcaagaccctgtctctaaaaatgataacaagccatattttgtcacttttgctatgttgctgagtaggagctttctgtctttaggcaatagggaattgattctggttctaccctcactgtaccaagtgcacacctattaccatacttgtttcagaatttatttatgtatgtctgtcccctactcattccttgaaggagagtgaaaggtgttctgttcatctttat

SEQ ID NO: 51893 - DNA, 2791 bp, Homo sapiens
ttaaaatgactttcacttaatggttaaaaaatgctaatgttaggggggaaatgctaatgggagtctcttcatactctaatctggtcttttcttgaatgattttaatcagtttttactctattcttctaatttcaatcctacttcatcttacaagactttgtaaagagctgtctttgtgcctaagaatgaatgaatacatgttacttcagtacaatttactgaccagctacgtggggacggagtggtaaaacctggttaataaataaaaacacactgtttttcttctctgctctcataccatttctctgatcttgagctttatttgaaaaagcttgagaaaacatggtttacataatgaaacatggagaatctgaagttgctgtggggcttctcttacagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagtaagtactaagtaacctcgaagttaacctctcaaggtaatgactaactggcatggtaccaagcttttggctctgttttccagcctcctgtgagcttcaaaacttcctagtccttgttgctgccaggccccaattttctaggccttcagagcaaggcatggggatctaatctcttgtggaaaggactttttcataagctttttccagagtcacttgtcctgctttgtcagtctttaattccaaatggaattttagggataagttcttcatggggggtagtggaagctcccctatagagaaagcataagatgttttttcttaaccacaaacccctaagatctcactcacctgaagtaacaacagattttcagccagctagctatttccagttgtggtagatttccacgggtcatttgcgagtcaactattcaccccgccatagggcgttgaggcacatgtgtttttgtgggtgtttatatgcagggatatatttcgaattaaaaagacttattatttttgaaggatgaagattctctttgcaataaactctgcacttttacgatcacacagaaagaattcatgaaccagcattggtaagggtagttcttcctttaaggtgaagatttgctgggcaccgattgttgggacttctgagcttatttgctggttcttgttctttgtaggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggtgagaggaccctccctgagctataaagggtggcttgttagtgacacgggattactgaagccaaactggaaaattcccatcacctccaggatacctgagtctaggaatatgttccagctcactcatcgatgatctgcacagttgtggcctaaggacttcatttagaatatcagaaccagcagattccttagagatcttgtagttcgtttttcctaagacctccccacaatttcacacgttataataaggcctgatactgtgagtgggtaaagaagttagatattaggtgaatactatgaagatcagaatttaggcttttggataacattgaaacgcttagccagtttcttctttgggtcaaattttcctcggagatctcaggcagtatttcctctgtgcttgaggcaagaacttagggactctgacattttctgtccctaggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggtggggctgactgatgctccctagtaagcagacagagttcagagcctgttgaattggtgtgagagtaaataatgcacatggctccccttgcaactcattttctcctttacccattttcatagtgtgaatgcaaatactatgtattgtcgtcacgagggaaggatttatgactgagcactattaggagtattatggggggtgatggaagcataaattttagttgtgtcatactgtagagtaccctttcttggccagggttccttatctgaaacacagaaaacaaaacgatttgagtgtatatattctcaattttcccatggatggtacaaaacccaaaccattctagaaacgtaagagagaagttagctcatttcatatgagggatgcctttgcgcattaggatatctatgtgggacccctggtttagaaagattgctctggagttagtaccacaaatgcatattgattggaatcaatgccaggattatgagaatgagaagatggctagaatatccaactggaagtgaagtagctggattctgaaggaagttactggcaagatgatttttacaagtattatccattgtttttcttttttttttttttcactggtgtattttttctatttttctcaggccaatttctccttcgctcctctcgtgttagacatgcttaatttccttatggatgccattca

SEQ ID NO: 51894 - DNA, 1037 bp, Homo sapiens
cagttctgtttcactttcaccccacggagaattgtacaaatgaaggtgccacatgttggaatttcctgtctcttcgttgttgagtagtccaggttttcatcaaggattccttttattccctgtctcctcttttctttttaacagataaataatttcagacacttttagctgtgtagaaatgatttgtccaaagtgtctttttccctaaatcactggcagatctggattaggactgagctttagatgcctttcctgttcatcttcctaatgaagaggatagaaaaataaagttgaggggctgctattaattcagtaaacatgtattgaacacctactttgtgccaggctttatgttaagctttgccaaaacaaaattagacattgccctcaaggtcaaacagacaaactttggattttaataaatcaccataaggaggacattgaaacaggtcttaatactggtggttaagttttccgtttgatcctcagtggactggatgaatccatcctggaggaatgtctccagtacttggaaaagcagctggaaagtagccaggctcgtaaagctatggaggagtttttctctgacaggtgagccgtgttttgctttattcagtgaatattttttgaatgcctcttgaaagcaaggagctatatatgttgatttaggtacttattatcagcaatatttaaggcctggttaggtgtctgcactttggggagttaattgctgactccttggggttgttggtgagggggttaatttcatgaacaccttgtgctattgactcataagtggtcattttccccagaggagatgagattgtgaagaaaggatgctttttatgtggggctttaatgtgattctttccatttttctcccatcttgcctcccagtggagaacttgtacagatcatgatggcaacagccaatgagaacctctctgctaaattctgtaaccgagttttgaaattcttcaccaaactcttccagctgagtgagtgacagcttttagtaatcttcttatgggaacttt

SEQ ID NO: 51895 - DNA, 1142 bp, Homo sapiens
ggataaattcccaccattgtagggactaggtcaggccaatggagggactattgtcttcttatacataggtaacaggtaaagtcttatattgtattgccctaaaagtgatccaggttcctggcagttcttctagaaggcttgtctgggatggaatacttgctttggtttcagttaattttctttgttgaatattataaaatgcagctcattaatttgacgttttaataaatggatttttcaaatgaaaatgatttttgtttctgatataataatgaaaaagaagaatatgaaattgtatgatgatacctgtgtataaaatagctatcatgggaaaaagactggaataaaggcccttgcgcaattccccttcccctcttccccggcaagtaattgaattaccctgtccttgctttgcagctttttggaggagtgtattcactaactcgatttcattttctttgctgaagttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacaggtgagcctgatggagaacagtcaggtttcctatgacctactgctgctatcagtgaaatgtactaacactgctgcctttaggtcattaatagcttattgtttttgtgtgtggttttttttttattctgagacatggtctcgctctgtcgcccagggtggagtgcagtggggtcactgcaacctctgcctccggggctcaagcaatcctcctaccttagccttctgtgtagctgggactacaggtgcatgccaccatgcccagctggttttttttttttttttttttttttttttttttttttttttttggtagagatggagtttgccatgttgtgtaggctggtcttgaactcctgagctcaagtgatcctcccatcttggcctcccaaaatgctgggattacaggcgtgagccaccacacatggccagcttattgttatttgtgtttttcaacagaaaattctgt

SEQ ID NO: 51896 - DNA, 1325 bp, Homo sapiens
ggccttcatctcctgtgttgaagcagtccccctgccgcagcctcccaagtagctgggatcccaggcacataataccatacccgtataatttttaaatttttttgtagagatgaggtcttcctatgttgcccaggctggtgttcttttcatttataggggacaggaagattagcaagctagtactttgtgcctggaaaaatctctttgctgggttaggaatgatctggtagaaatttagggtggaaaatcaaagggcttgattggagttaagtacagtagttaccgtttaaaatttacaatcaatcgtttgtattttccttaatttcaagctttaaatattcatttaacattcagatagtctcactttgtactgcttcattgaatgctgttcttaatgtgtgttatgatccctgcccttaagattcgtcttaaagagaaaagagatcaagagaaaagtgatacctatttatagaaggggagcagatgtttaatggtgatttcagtctgacttgcaatgactcaccctcactttgcatcttattttcagttgtcttctttacttgcaagattagaaagtgaacatgatgggaaatgaaaaccttacaattgagagtgttagctattaagcaattaactggttcttggacatagtactgctattgaaatatctatctaagctatcttactaattattttgacagcctgggctgtactgtttctttctgcatttgggcttggcttttaaaatgctctgtgtcgttccttctttcttgtgatgattccttgtcctttctgtcgcctccaggtccgacactggttcagaatttgccatcgtcagtgcagactgtgtgtgagtcctggaacaacatcaataccaatgaatttcccaatattggatcctgggtgagtccctatctgttccagggtagaaatactgagtgctagccattctgtcttttgttcttaagcctaaaggaattaggcttaaactagctaccaagatatcttcatatactgcagtaatattggctatggctgaatcattaatcaatgcatttaatcacctagttggttctcatatggctttttgcttagaagtttgtgttatcaaaagacaaaccattttatttatttgagcctcagtttcttcaccaattgaatattgggctgtgacgattcaatgtattgaatgttaagtgcctagcatattacctggcacacgaattcccaatacgtgttaactctgtttcctttgtaggttgtatgtcaggaacctgctccttttgtaacagttttacagggtcgcttttagcttctctaggctt

SEQ ID NO: 51897 - DNA, 1036 bp, Homo sapiens
cactgtgtcacccaggccggagtgcagtggtgcgatctcatctcactgtaacctccacctcctgggttcaagtgattctcctcagtttcccgagtggcagggatgacaggtgcataccaccatgcctggctaatttttgtatttttgtattttcagtagaaatggggtttctccatgttggccaggctggtcttgaactcccgacctcaggtgatccacctgcctcagcctcccaaagtgctgggattacaggtgtgagccaccgtgcccagctctgtgggctttatgctgctttaaagggacctagatctttgtcagacttaactaaccttgtctcttagtatgactgccttgcagaagatagagggctgttgtttgaggcaaattttttttttggctcaaatttgtttgagccaaacaaatatgtatggctgctacgtgccaggtacttttctaggtgctagggttatggcagtagccaaagcagaccaagtcattgccctctgggaatttacagactctaatctggcctaataggccagtactttccacactgagctgttaacgttcctggtcaagtaagtttgcaaaatgttggataaacagttttttttgttttgttttgttttaaaaaatatagtattcagagcctttactgtatacattgtcaatcttctgaggtggggaaggaggatagatatagtattcactgtttctcaggcttacttgtcaggcagtcatgttttgggagcatttcagaggaggggacattctttgggaaatgattacccattggaattcttagagaccaggaaggggcaggcactatcaactacattaaatagataggaaactgagatatagggttttcagccagtctagggccagtttttcctaactggtgggattagaatcttatggcttcactttccccctgttttttccccagagcctatttgctgcaaaactttaatgaagagggaacaactgagaaaccttccaaggagaaactgcaaggctttgctgctgttttggc

SEQ ID NO: 51898 - DNA, 2908 bp, Homo sapiens
acttatctggctccagatgtcaatattgttaaggttgggaaaccttattataaagtattttctgagttttacattgcatactagtcagatagagttaagaatggaaccattcttttaatcagcatattacttttcagatgctgtcccacaccccagattctactgtgtcctgtccccagaagcctcagaggatgatttgaaccgacttgattctgtggtactaggaattttaaaactgcattttatatgtgggtcagatggtttccaccagaatcagcctactggggggaaagggaatgactgactttttatagtgaggaaatgtggtctgtgttacgatttgagcttattctaataggaaaatgttacttggatatttatttgttgggtgcacttttgctgtggggtttgtcctttctggattggcacctctgacacttgatttttgaagacagtctttgttagcatttttcacatgcaagtattttaatggacaaaaataattgtcttactcccttattctaaagccagcagctgtgtgctcacaatagcttgcaaacagtgtgagtaatgtcccagaatgggaatctgttccaaggagaaattaatgattatgatttgatgggatattttgtcaatcatgaggataagtgatagtgtataggcagtaggaaaaaatactttaaaagtaaggaaatgactctctttctttcttgatgtcaggcatgtgacgtccttttctccaagcttgtcaagtatgatgagctttatgctgcactgacagccctgcttgcagctgggtcccagcttgatacagttaggagaaaggaaaacaagaatgtaacagccttggtaagaccatggaaccctgagaagtctttgggttgtgtttgatcattgatcatttctatcagaaatttccttctgaaatgtaaccagtttattgaatattgatttgcaaaactgactgatacttgagtatttctaggtagtttgtgtagctatgttcaccttaaagataatttaatcagctgttgcatttttttggttaccattgagagaactgtaatttaagagttagtggtccccccccaagtgctatatctcctgtcaatactggttgatgtgtgatattgaaagcctcacgcttgagatttttccatggctctgttaatgtgtctctatattctagaagcaattccaggccacaaaaacggatagctgattgcaggtctgctaagcagaatgtcctgccctcttttggttaattggtaaattattggggagccaaagttgtcttggaatagcctttttggtctgtgaaatgtgcagaatacggaacaaattatttgtatgtgtgttctgccattttctgctaggtgcactctctagaaagatctggagaatggacttgggggccaaatctcaatttaaaatcaggactctatacagttctggtttaaaagttgtatttggagtagttcgtactgtgagggagatcttgaggccataccaagtgctacctctatgctgcttttcctttctccaggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggtaacacagagcttgctgctaagactattcaaagccaaagtgctttgtgcttactggagcttttaaatttgaagataatgaaagctttgcctatagtcatctcctaaacactttttcttgctgtccaaataggatcaccttatcaaacagggaatgaaggctgagcatgctagctcgcttctagaactggcatccaccactaagtgtagctcagtgaaatatgatgttgaaatagtagaggaatacttcgctcgacaggtatgtaatattggaacctaaatgatagaacttggtttctaccatagcccattgccacagctaattatattttgcatatttttaaagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccaggtgtggcgaactgcctgcccagagatgcacatgcactcttcactccgtgcagatcccgcattgactcagaatttgacatttttctctttcttcagcttaggggtttttttccccacgtataatgctttcttctctagtatgaaggggtgcttgatgaggaaattttcaaatagtgcaggaggagtcaggaggaagtttaatgtctataattctttaaatattttgtacgattttactcgtaggatacagagaaaggtaatttttcaaaacactgtcatttctgttattaactgagttaaagctccttaaatgctctttatttattattattaaaaaaatttttttctgagatggcatctcgctctgtcgcccaggctggagtgcaatggtgcgatcttggctcactgcaacctccaccccctgggttcaagtgattctcctgcctcagcctcctgagtagctgggattacaggcatgcaccaccgtgcctggctaatttttgtgtttttagtagagacggggtttcgccatgttggccaggctggtcttgaattcctaacctcaggtgatctacccacctcagcctcccaaagtgctggga

SEQ ID NO: 51899 - DNA, 3425 bp, Homo sapiens
acttctcatgttttgtccatttacaaaattatcctgattctggtatctcaatgcttttctcttttttcaggagcccatatctgacactcattaactataaatgttaatgaggttagatcagtaagttttcacttatgtttttctcatttgttgacctaaatgatctttatccaaactattccaaaatctgaatttctgggtccttctttctttaaaatattctgttcaatattaaacaaacaaacgtttgagaacatgagtaaccttttgactttatcccgtatctgtttgctaatgttctgttccatgtctttcttgtcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtaagatgtctgtaagagaaggcctatagagaaagttatttccttttttatttgtttgacttctttgtagttaatctgtggctttgaggctttgctgtaatgataatgtttagagtggggagggtagaagagggatggacttggagatgtgctgttaaaaaacaagtatgtcaactttggtctggaaataaatctccctgtagcacatgggggatttggttataattatgcgatggaaccacaatcttgaacagaaccaattttatcctgacctgcttttttgaaagacaagcagggaagccagctctgtccttggttattttgctttcaacatgaaaccacttaggggcacttgcagtgttttttggagaaattttaaagaatttttttccttgggggaagctcagattaatcatctaaatccactttagatggacctgtatttgccatttttgtttacatggttagaagtcttcaaagcagtttgttttcctaaaaggctttgctttctgttccccattgtaggatcaaatagctctaatgctggatttgagaaagcataaaccttcttgagtgccaaagacccgctatatttttcctggtggaatcttgcaaaaaggctgagagggtcgaggggtgcaatgagggaaacccttgttaaacacacaaatctctttcctaatattaaaacacaaatctctttccaaatagccaaaggcaatggaaacagttggctacattcattccttttttgcattaaagctcttctgacaaattctctgaatagtatattttcttttttattgctttatagtctatcgagttatttttgactattatcatgcagtgatttttaacctgtagtataaactctcaaaactagaattaaatgatagaatcaaaatatggggaaaagtaattgaactggttcacctgtccaagtttgttaatcagaaaggaacaatagcaacatttttgtgggggagcttgtagtacttttcatggccacaaatgacagggtgggcattaacacgcctgtgttaaggcttgcctcaagcaatcctcccctcgacctcccaaagtgttaggattatagactgagccactgtgcctggctggccaagtctgactttttttagccaaaatttagtttctgtcttgtctttaccatgtagcctttttttcttccttaatttgttatcttactgcctgggtttaggaaatttaactcttctagtgcttgacattataactcctggggaatgctctttttcccaccagatatagtcatcttttctctctggtaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagaccaacacgttcttttttgcttcaccattactgagaactttattcttctcaatggttaccatgatccgcagcccaaatgacctacccactttaggttttaggttttggtaggttgatgggtaggattaggaggaccactgagactttgtacttgatgtttagccagaagtgatacatgtagattacttgatttgatgcattttttgaaagtggaatgtaggctgtgttcaaaggcattctcccacgaattgccctgctctacctgtgtctgatgcagtgccctgagcatcggcccttgatgagtatttgttagtggttgaatgacagtcaagtagtaaattttatggattggtaaattcctttgttgtaaggatccaaaataaggataggaggatccgttcagacttaactgtgttcagcatttcttaaaatgtttcattgagcactataccctttatgttgcaccaaaaattgcattccaaaagtagtcacagaaaaatctttaaatttttattttggtttgtgagtttcccaggctttggtataccaagctattatcgtacctgagtgaaaagctgaatggtgcccaataaaacagaatatttgaatgtagaacacccacattcagattaccaagattcagtgtaccgagctattatcatgcctgagtgaaaagctgaatggtgactgtgtatctttcttaatttcagtatttgtgttttaaaaggtacagcataacctgctaagtcctccctttgggtgggcaagtggatcccaggacagcaacagccgccgggcaaccactcctctctatcatggattcaaagaagtagaagaaaactggtctaagcatttctcatcaggtcagaaagaagactgttaataagaaactgacttactgattctcattggtggggttgaatttgaagcttggggactcttggaggatctttggtcatttgctttagtgtaatccctatgggtggcaaatcacctatggattaaaacatttcagaaatggactcccacatagcctacatttatattttttaaaaaattgaagctgggcactgtggctcatgcctgtaatcccagcactttgggaggcagaggcgggcagatcatttgaggtcaggagttcgagaccagcctggccaacatggtgaaaccccatctctactgaaaaaatacaaacaacatttagccaggcttggtggtgcctacctgtaatcccagctactctggtggctgaggcaggagaatcacttgcaccaggaagcagaggttgcagtgagctaagattgcaccactgcactccagcctgggcagcagaacaa

SEQ ID NO: 51900 - DNA, 1074 bp, Homo sapiens
cccgttctgatgatgtgagtgagtcagatacagttcttgccttcatatatatagcttacagtcaaggatgtggacaaaaaacatttatacaataattcaatttaattttaatagagaagagctaggaattctatatatgtgtaataatcattcatataggcttcaggattgaatatatcagtagtgaattggagccggacaaaggaccttaggagaacaaaagaaatgggtcagtctatttggaaatcctgttttcatacactgttttgtaacatctgttatattaaactggaatgccattttgtgtaagtagaattaggtgggaaagagagactcataatgaaacttaggcccactgtaagtgatttaaaatctgattctttcattcattgtgtttattgcaggatacctatgagcatattttattttctatttgtaatcagagtttataggaacgctgggcttatgaccctgataagagcttttttgtgtgtgttcctttcagttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggtcagtagacaagatatgtgcctgatggattttttttctcatggagtttggctgttggcagggaggtgtggtgcattcaatagctgcttaaataattggcttttctacttgtctttaaggttcatcagatgaagagtttgctgcagctctctatcacttcaaccactcactggtaacctctgaccttcagtcacctaacctgcaggtttgtgtgtgctgtgaccatctaggcaagagctcatgacaccagcttccataggctgcagctccaattgtttgtttgtttgtttttttgagatggagtcttgctctgttacccaggctggagtgcagtgacacggtcttggctcactgcaacctccacctcccaggttcaagcgattctcctgcctcagcctccagagtagct

SEQ ID NO: 51901 - DNA, 1575 bp, Homo sapiens
gtatattggttgatctggtatattgtttccctatctctgtagaacacacttgaaagattagccattaattcagcaaatatgtttgagggcctactgtgtgtcagtgtacttttagggaaatgcagtaaacaggaaaatttccgatagtgattaagtgcgctgaaacaatacattgtgattgatagtgatctgggccgggtgtggtgactcacacctgtgatcccagtactttgggaggtgggtggatcacctgaggttaggagttcaaaaccagcctggccagcatggtgaaaccctgtctctactaaaaatacaaaaattagctgggtgtggtggtgcatgcctgtaatccccgctactctggaggctgaggcaggagaatcgcttgagcctgggaggtggaggtttcagtgagccgggatcacgccatcgtactccagcctggacaacaagagtgaaactccgtcttaaaaaaaaaaaagtgatctgatgtggagctgggcatgctgcttttgattcggaggagggatggcttctgagaaggtgacatttgatccaaatgaaaagagggagtcagctccatgtgaaggtcaaggaaagtacgatggaatgtatcattgaaaagaggatattgaactcttcaagttaaattgtttgggtaggatttagcatttatgatgaaatctgtcagcttgttcagatttttgtgtctgtttgatattgtacagctcgaaatctatgacatgattggacaagcaatcagcagttctcgccgggctggtggtgaggtaagaagcgtatctgtctctgctgcatacttcctatcttgtcctctctgagatgtaaatatctctatgattatgttttttattttgtgcctttcacaacagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggtatgtgtctacttgattataacttatattttgttttatttcgctaacattttatatttacagggagctagtatgacttcatatcaataggaaaatttgccttcctacctggcttgaatttagcaactaagataatgatcatgacctgttatctccacagcatagctttgtgatttttagataagtcactcattctctttgattctatttcctcatctgtcaaaggggaaaaatatctgtgcaatgtgtatttcaggaattttatgaagttcacatcagaaaaacatgtttctgtcttgtaaagcgggcttgtttgacttggagttgagtacttgcgtgtataacctgtaagatgagaatattgtcagggcctcctggtttgcttcctgtaatatttgctgttgttttgatgaactctgaaagaagagatatgaccaatgtactgttcaggtttcgttttctaagcccaggtgtttctggattttattttttca

SEQ ID NO: 51902 - DNA, 2223 bp, Homo sapiens
ataaatgatgaacatggctgtgttccagtaaactttatttacaaaaacaggcagtgtttgaattggagctgtagtttgccaacctctggtacatggggctacagagtcttctcaaggattgcaaacttacatacctgcaggggccaggtaggtaacagaaaatgagtaaagtgtgctagttgagaagattgcaggtcccaactaaaggggctaaccactatttggctctgggttattactgccatgcaggaatggaggtgcaaggttgctatactgtgaattatttgagcgtgagaatttcagatttgcatgtgaatcttttcattcccttcaaattttaaaaaaatattgtgagaacaataagacaaatctataagctacatacggtctaaggacatcagcttgcagtctttgctttagtgtttatatgaacctaaatttggccctgtgccagttagaatttccaaaagagtagaattttctgaaagatctatttgtttttgttttcttttgtttgcatttgttttcttttcagaaacacttgattctcctaatcaagggcctgtgcactggctgtagccgactagatagaactgaaattatcacatttacagcaatgatgaaatccgccaagctgccccaaacagtgaagacactttcagacggtgggtgttcctttgacagatctgatcacatgaccacccccatggcaccttttccatggcacctttgccttctagtggcactttcctcagcccttttttttgcctttgtattttacagtggaagatcagaaagagctggcctcaccagtaagccctgagttgaggcaaaaggaggtacagatgaattttttgaaccagctgacctcagtttttaaccctagaactgtagcatcacaacctatcagtacacagactctggtgagtttctttagtcaaatgtcttcttctctgtgggttttgttaagatgataacactaggggagaaaaagtgatgtattttatgtttgtgatataaaatgatatacatgtctgtgggacaaaagaaattgaggaatacaaaataaaacaagtaaaattcaccccaactccttcttctgtccacggttattactgttttgacgaccattctaggcttctctcaatgcaaattaacaaatgtaaggtgtatgtacagttttctatataaaggcatcactccattttggttatagaacatatatatattttaaagctgtatattttttccctcctcctgaaaatgtaacctgtattttctccaacatgagtaaggaattttcccttcactaactggggagtctggagagtatccgtgcagctactgctcacttttgacagttggtttggtgaagagataatagtatcttgacaggccttatgtttcttttcaggtggaaggagaaaatgatgagcagtcatctacagatcaagcctcagctatcaaaaccaagaatgtgttcatagctcagaacgtggctagtcttcaagagcttggtaagactcccaactgttatcagaaagctgatttctgggctgtcaaaaattccttaagtgtgcttctgtcatatggataagaatcaagcatcagacaaaggcctgtttgtaaggttgtggttttcattcatttaggtggctcggagaagctactgcgtgtatgtttgaacctgccatatttcctacgctatatcaatcggttccaagatgcagttttagctaattccttcttcataatgcctgcaacagtagcagatgccactgctgttcgtaatgggtaaggtgcttcacagtgcacatgctttactttttttgtttttgggacagggtcttgttctgtcacccaggctggagtgcaggggtgcagtctcggttcactgtaacctcgtctcctggttcaagcagttctcccacctcagcctcctgagtagctgggactacaggcacacaccaccatggctggctaatttttgtattttttgtagagtcggggttttgccttgttgcccaggctggtcttgaactcctgggctcaagcaatcctcctgccttggcctcctgaagtgtcggaattataggcgtgagccactgtgccgggcccatgctgataatttctttaactgtcacattatagaagtgaatgattctaagagacacttgttgatctctgtcatgttccagctttcattcattggtgattgatgta

SEQ ID NO: 51903 - DNA, 1047 bp, Homo sapiens
ttcttccctagcctgatgaccttgaatgagatatttaattttaattctctaagcttcaccttcccaatctttttttgagatgaagtcttgctctatcacccaggctggagtgcagtggttcaatatcggctcactgcaacctctgcctcccaggttcaagcaattctcctgcctcagcctcctgaggagctgagactataggcacgtgccaccacgcccagctgatttttgtatttttagtggtgacgggttttcaccatactggccaagctggtcttgaactcctgacctcaggtgatccacctgtctcatctttcccagtcttgaaggggaataggttgatgatactatctaccaggtagtaaggattaaataatgtaatatccataaaggggtatctggcacatagtaagcgctaagcagatgctggctgaattattattatttttacagtgaatcagaaatcctgcaccatgagaagcagtacgagccattctactcatcttttgttgcactttccacacactatattacaacagtttgcagtctcagtaagtattccactcttgtccttcccttctgagggcttgtgaatagggggattgtttatcctctcgttagtgtatctgaaaaagttgttaatgaagtctaggttttagcactcctaagctgctcacccaagagtagagacaactgtcagctaggatgaggctccagaggttcccttacctaggctaaccaagtggaattttaaaactacttggcttggacacctgctttataagtattaagtccacctcctttcccttcttaatccaaagcattttattgatttctcatgtaattactggtgtgttaatttccctggggggaaggcggtggtggatactgacctctggagttagcagccactcaaggctctattccttatttggttttggtgaggatgtggattctcctttgtgttctctggtatatgaagggatttcaacttcagttctccattttcttcatttttctacccccaaaatggctaatccctatttt

SEQ ID NO: 51904 - DNA, 1001 bp, Homo sapiens
ctgagatagtgccactacattgtagcctgggcgacagagcgagactctgtctcaaaaaaataaagtataaggctggaagtaaaggaaaaactaagtatatgaggtagaaacagggggatttagtagggagttttctgctgtacatgtgagccttaaaactgtgtttagtcaccagcaacttttgagtgctgcttgttgtggaaaggtttttattttctcctttttatgtaccctgacaaatggaaaaggacccttagtgggcaggaggatccttgcacacatcatagatgctccataaatatttttttcttggtgaaggagttattctaagggactaatctttgatacatacccatttatccttgatctgcatatagcaaagtgctcgcaatgccagactctcaagtgttattcaaggtgattcatcaccgacattggcaccttccaaatagtgacttgtccttttggctcctgtgttcatttggcaggcagatagtcttgcaggcagtgaatggagtgttcactctgtttacatttcccttcttaggatgatactttttttttttttttgagttggagtcttactcttttgcccaggctggagtgcagtggcacaatctcagctcactgcaattccacctgccgggttcaagcaattctcgtgcctcagcctcgtgagtagctgggactacaggtgggtgccaccacacctggctaatttttgtatttttattagagacggggtttcaccatattggccaggctggtctcgaactcctggcctcagataatccaccagcctctgtctcccaaactgctgggattacaggcttgagccaccagctacaatgcgtcccaccataggttgatacttctgctggggattgactcactaagtaaactgttcaaccacactgttgttctttccatttaataaaatatattttagtctttgctttaccttcatgtttctttctttttttttttctctgagacggagt

SEQ ID NO: 51905 - DNA, 2041 bp, Homo sapiens
tttgcagagaggagaacttaatcccgtattctccagatgtacagatacacgcagagcgattcatcaactataaccagacagtttctcgaatgcgaggtatctacacagctccctcgggtctggagtccacttgtttggtgagtagagcccacagctgccctatttcacccttggtggatcattggttgtttctttcctaattcttattccatctgccttccaggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaag

SEQ ID NO: 51906 - DNA, 1746 bp, Homo sapiens
gccagctttggcctcccaaagtgttggggattacaggcgtgagctgctgcgcctggggggaataaagtcttaacttggtattgtaatagctaccattgcctgtgtactaaaaatttgccaggcaccttatactcattgtccctaaagcagcagccatatctgtctggagacaccattgggttgatctgggtattgtggaaacagcccagtgccctctaaagctggccatggtcccaactgccaggatgaacttgattcactctgctctgattcagtcctgccccccaccctctctcttctctccattcatccagccctccaacggatagctgttgagggcctgctctggaccaggcactctgctaggcaatgcacattttcttaagctgaggattaatttgactttactgtttatttctgctgcctggatccagcaattcaaggtaaaacctgcttcttgctgccttgttgctcgttgcctgctcacatggctagcttttggttaattgtttttcttcctaacttggaccaatgaggtacatccttggggtgtgtgtgtgtgtgtgttgactgccatgcttgtgagttgtcctgttgcttctcacttctcttccttgagcagaggtgggtggaaaataagataagcagaggttctgctccttttttagtgagttattaccatgtaccagccaccacgctaaatcctttatgtacatcgtatgatgtaattttggaacagtccagtgggttacatgccactttacagatgaggaaccagaagcaaaaaggtgaagtacatttctcagtgttaccccgcagtgagtggtgaagctgggatcttaatctgggcctgctagattccagagaccatgctctttaccttgcttccttgcatctgtttacaaatctgtggtctccaatggaggagatttggagggcagtggcttcattgacggaatcagggaaagagtgaatgatggtcctgggaactcgttgcaagtacgtctgttgggtgcaggttaaacagctgacaaagtaggaatgaagcaatgggagatggaagtacctgctcatgatacatattcactgacctgcaccctccacccccacactcatacctcttctggctttgtcatggcacccagaaaccttcttttagcatcttggatgtggggctgtggtggagacattcacagcatggctgtctcctgcatgcctgatccctgacctcttagtctcctattccaagattccagctgggtttagttgttaagagccagttaagcagtttttggaagctcctgcatgagcctcacctgagtgtgagactttgggcatcagatacaggactgccctttgggcttgtggcctagagtgtggactttattgctccagaggagaggcagagatccctcattaggaaaatcatgtacctccttatggacccctagtctgatgtagagtatgttacttttcctttacaccagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaaggtgagtggggtttaagctccagttactgaaccttttcaaattctgagggtgaggaacaa

SEQ ID NO: 51907 - DNA, 1035 bp, Homo sapiens
ttttttttgagatggagttttgctcttgttgcccaggctgaagtgcaatggtgcgatctcagctcactgcaacctccgcctcccgggttccagcaattctcctgcctcagcctcccgagtagctgggattacaggcatgcgccaccatgcccagctaattttgtatttttcatagagacagacggggtttctccatgttgatcaggttggtctcgaactcctgacctcaggtgatctgcctgcctcggcctcccaaagtgttgggattacaggtgtgagccactgcgcccagctaacaaacacgtcttatgtgtcctaaaatgaatgtgatggtgatagccctgtgattttttttccggagcattttgtggaatggtgattttagctccttatggtcccctgtactctttttttctcaggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtctactggctgcctcagggatgaaagacttaccattgccaactctgcctggctgattcctgaataaggaacatgttggccaaaagatgcctctcctagtggattctgatactttttttttttcagtcttaccatctttgaatatttgtatgttcctataactgacctttgcggtttgttctctcagcttgaatcctgagtgtccttaaataagatattgctgcaagcccaggcgggaggatcacttgagctcaggagttcgagaccagcctggggatcacagtgaggccccatgtctaaaattaaaaaaatcaggcatggtggcgtgtgcctagattcccagctacttgggagactgaggtgggaggattgcttgagcccagcaggttgaggctgcagtgagctgtgatcatgccagttcactccagcctgggcaatagagcaacaccttgtctcaaaaaaaaagatgct

SEQ ID NO: 51908 - DNA, 1897 bp, Homo sapiens
aacctgggctgcaggctgggtgaaacagtctcctcctgcacaatgactccactcctagaggctgcctcatggtggctttggccagcaccacgtgcagagcagtaccgatcagctgcctccccttataacagagaggctccatgtgtttccatgtagcaggacccttcctaatgtgggtgaatgtttctaggttaacagctgatgatcagttccactgttggtcataaataagtgagagacctggaaaaggccgtggggtgtagatccatggctcagcctcccctgtggttagggatcctaatttcagtaatggaggtaggagacaaccaaattagaggcctccagttcttccagtttccatagttgtcaggggcccagagcagattcattctcatctgaggccagagtagtgcccgttgtatgctgctgcttgaactcagagcctcgtgaattgtcccacagcttcggaaatgtgtggacacctacaagtaccttttcatcttctctgtggccaacatgaggaacagcaagctgaaggacatccggaacgcctggaagcacagccggtgagcgggcagggggaggaaggcccttctgagtggggacccggccaggctgctctcagtcaaagcacaggagcaatttctgaccctttaggtgcctgggtcatgccgctgacaccttaataaggacaaagtgctacctgccactgaagagcacttccttttcactgttaaagctggtcttgggcagggtgcggtggttcacgcctgtaatcctggcactttgggaggctgaggcagggggatcacctgaagtcaggagtttgagaccagcctggccaacatggcgaaaccccttctctactgaaaatacaaaaattagccgggcatggtggcaggcacctataatcccagctactcaggaggctgaagcagaagaatcacttgaacccatgaggcagaggctgcaatgagctgagattgcaccatcgcactccagcctgggtgacagagtgaaactccacctcaaaaagcagattttgcactgagctcctaggggcaggacttggcagttgctcaggagatgtttgagaggtgggcctttccggagaagtggccctttaaccctggactgtgggccatttaggagcatcacaccagttttagaatgtcagtagggacactgcgacacagacagtgacctgggagcaggatgcaggagccacatggcaagtttctgtcctggggcaggtggctctggtggtggtctcttgccgcaccagctctggttcaggctgttaacatgcctcccgcatacatccagatagagaactggtacatgatgctcgtgatgggctgggagacaaaatgttgccatgtcaggagtctgtgggtgggaacataatgaaagggaccccaacgtggggacagtgtggccaggcagcatggagaagtgggtgccactggctcagcctgggcctgagctcactggggaccggagctactttgcatgttgctgagggatggggagggcagggctcttccttcacagaatgctctttctcttgcttggtaggatgttctttggcaaaaacaaggtgatgatggtggccttgggtcggagcccatctgatgaatacaaagacaacctgcaccaggtaagtctctggccctcacggggtggagctaaggcaaagccgccctctctcccactactcccatgtgacagcctcccccagccattggcaggccggaggctcagggagagcagggcctggcttaaagctctgggttctcccttcacctccggacccaaggaatagcagcttcctgcctcccactccttcctgctatgacaaccaaaaacgtctttaaatgttgccaaatgtacccgg

SEQ ID NO: 51909 - DNA, 1060 bp, Homo sapiens
tgtaaccagtgtccagcatggagttcatacagcagatatttgtggaaagataccattccacttcaattttctgtccttgggcccaacaccttccctccatcccctactaacagtagtgatgttagaatattgctgaagtcctgggccggtgttgctttagaggtttgaaagtggaaggcaacagttccttctcttgacatgtccaccctgtccccggggtccctctccctgcagggcatgtacaacgccaccacccggcaggtggaaacggagctcttcccctgcctcaggcactttggactgaggttctatgcctacaaccctctggctggtacgtggagcattcctgaccctgtctcagcctattcctgacccacagatgcccagcccagaatttatgaagcagggagggtttgacaagaggctgggctgtgttcttcagcccctcctgggtccctgcccctcccctagaccagagccctgagggatgtggcagcttctggggcactctggggccaggggctgattgctgccttcccgcagggggcctgctgactggcaagtacaagtatgaggacaaggacgggaaacagcctgtgggccgcttctttgggaatagctgggctgagacctacaggaatcggtgagccgggggtgggcttggtgaggatggctggggtggggtcaaatctatgtggaatgaagtcctgggctgttcctgaggtaagaccttcctttgctgtttgcatctcctcccctgcattgcttcaggaattcccaagccctctgtgggttttcttgttgtcttgagacctctgggggggaaatgaggatccctggatgttggggtcttgaagtcatagctcgttcctgagcaatcacctgctgggaagcaaaaagcgagcccaggatgggccaggcatggtggctcacacctgtaatcccagcactttgggacaccgaagtgggagggttacttgagctcatgagttcaagaccagcctgggcaacatggtctctacaaaaaaaaaatgcaaaaaagtggtcaggtgtggtggtg

SEQ ID NO: 51910 - DNA, 1096 bp, Homo sapiens
ctttgactttgcatgggttcccatgctctggagtgtacttcctgctcttccttgttggctgggactctgggagtgatcccctagagaaagccttccctggagtctccaagttggcttcatgcatctcatctgggctccttggcatcgtgtgcctttccctcctgtgcttaccatattgtaccatcatcctctagggctccaggagggcagagatccattgtgttcagttcatctctgcatactcagtctctagtgcaaggcctggcacagccagcaggttggtgactaatgatagttattctaataggtgaacattgagaactcacatatatgacattatttaatccccaggacctcccaatgaggacagtttgattattatcaccccattttacagatcatacaattgaggccaagagaatattagtaatttagccagggttacatggttagcaaatggctctaataggtcacttaaccattccattctctctccaagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggaggtgagggggccctccgagctccaaaggtgggctcctgctcctttctttatcctgatcctactcatgagagcagaggcaccagggcagtcccagggtggggcagggaatagccccattccctggggccccaccctggcctccccttcctggtctgggctacactgcgttctgactggagcctcacccatgcagggcaagttcgtggagcttggcctctccaactatgctagctgggaagtggccgagatctgtaccctctgcaagagcaatggctggatcctgcccactgtgtaccaggtgagggccggggctgcagaggccaaggtctccaggactcctgctaatcctgggctctctttgcccccctgactgccccctgtgccgtctgcatagcagccactcccctgct

SEQ ID NO: 51911 - DNA, 1062 bp, Homo sapiens
ccttggcctcccaaattgtggggattaccggcatgagccatcattcgtggctacaacctgctttaaattagatgaacttgatgggcctggcctcagcagatccttagagagtaatttacaataataacaagaaattaggaataccctaagtgttcaagagtcataggaaaaggtaacatcgagggctcagttcaacacactgtgtatgaactcactgaacccacacaacagctgtatgtgggaggcagcactgtgatgaccccatttacagatgagagggctcaggcacagaaaggctgagtctttgcccaaagtctagcatgaatgggtgatgaagcagggatttgaacacacccgtcccttctgcagatccagcacgctgcctgcatgtgtctgtagttggcgtgtgtttgctgtgatctgtgcacctgggagctgattgggtcctggtgggtgaagattatgtctttgcccttctctggctcagggccaggagccccgtgaaaaggctgggatgagcttagtttgggatgaccatgaataggacctggacctcccagtgctgaaagcctcctcccttcctccctgtagaacccttgctggcctcagaacaccagcgccctccctccggtgcagccctgcctggccgggggcccctcctccacagccatggtctggaagaaactgggctcccgcaacttctccagctgccccagtggctccatccagtggatatgggatgtgttgggtgaatgtgcccaggacggctgggacgaggccagcgtgggcctgggcttgatctccattctctgctttgctgcatctaccttcccgtgagtagtgtcttggtggcaggaccagggcagggctgtggggttgaggcagtggctccagctactgctcagcgaggggttgtctggtgggccacgggcctctccagactagaggctggggtgtgttccctcgacagggacctgcactgattgctaccgcaggtcagacctagtgctgggcagtgctgatacagagatcatcacctttgcaacagtttattgagtgccc

SEQ ID NO: 51912 - DNA, 1015 bp, Homo sapiens
tggagacccggcgtgcccaggccttcggcccgcacgtccctttcccagcactgttcttgttgcaatgcccttccctgcatccacaggagaaaggatccagggttctatgcagcggttgtcagggcccaacacaaaacttcaggaccctacataagccccagatccccactggagaccccagggtgtggtagaggagaatctgagtaaggctgcggctttccctggagagatgcacagccgtagagtcctcggcttagaagggattccccaggggactcctccaaagggccgagaaggcttctgaggatcccgcccgtggggaggatgggccgccaggccacttcctctccatcgccgcctcgatccccatggtcgtctcctctgggcggtgtcccctataaggcggcatcccctgtaaggtggcctgagcatgcatcccttcctcttcctcttccacagccagttcatcaaagcctacaagacgggcaacatggaccaggcgctgtccctgtggttcctcctgggctggattggcggagactcctgcaacctcatcggctccttccttgctgaccagctgcccctgcaggtgggccggtacccgggcaaggtggcgctacccctaaccctgcttcaccctgcagggttgcctgaggagatgccaggctctttggcccgcctggtctccagaaccctgacccgtcattccatcttgtgggagggccccatccttctgtctgccgaactgtgactgtgggcaggtcactgctcttctctgggcctcagtttccccatctgcaatatgagcatgtctaacaggaaggtttcggggtcttccacctccagggtgctggagtgctggcgaagctttcagagggtgggcccctcgaggagaaagggagtttttccgtgggaggcccagatgccatcctgctcctgtgggcaggcagagctggggctcccaatcaggaaggcattgtcttcccatgtgggaccagaaagttctgactgccct

SEQ ID NO: 51913 - DNA, 1039 bp, Homo sapiens
agggcagtgagcgcgtcctggcccagaccacaggccggttcctctcgcccaggggctcattcagcagacacagctccagctcctcctctgtgtccggccctgggcttggagctggggaaacgagggcaagtcacacaggctgcctctgccccagccttcaggaggagcaggagacaaggtcagcttgaggctatacagacacggggagggacctggggaggaagttgtctcatcagcgttcctgcttcgtgtaaccccctcctgacctccctgccctcagcgtttcacctttataactctaggagaagggtactgttgttgtacccattcgacagatgaagaatgaaagctcagagaggttaggtcacttgcccaaggtcacacagcccctgaggggcaaggccaggacttagcaccctcccccgacaaccgctgccactcagccatctaacctcagcttccccctgccttgtgtgcagtgtctgcccccatcaactccgtgctgttgttcctcatggggatggcgtgcgccacaccgctgctgagtgctgctgggcccgtggctgcccctagggaagccttccgggggcgggcgctcctgtccgtggagtcgggcagcaaggtgaggcgtgggcgtggcggtcgaagggatggaggctggctcatccccagggctctcccctgcacagcctcatgggtgctaaatggggtgggggatcacctctggctcctacgagacaccaagtgcccccttctgccccacagcccttcacccggcaggaagtcattggcttcgtcatcggctccatctccagcgtgttgtacctgctttcccggctgcctcagatccgcaccaacgtgagcctccagcaggggctgggtggggccgagtagaggagagctggcctggccacccgggccctctgggctaaggagtagcacagcataggagccttggttcagaaagtctggtctactcccgctgttggcttgggcaagttaatccaatctccgagcctccatttctgcttctggaaaa

SEQ ID NO: 51914 - DNA, 1008 bp, Homo sapiens
agggcacagctaaggtagcggctgggaggttatggctggcccttcccacctgcagcgtgggggtgggagggaggggagagggaggcagctcccaggagtcgaaggcccccaggggcaggtccaacccagtctctgctcagcttggccttaacggcggcacccccagatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaaccccatctctactaaaaatacaaaaattagccaggtgtggtggcacacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaaaagataaccgaggaaacggtacctccccatgagacctgcttctgttgctccttccccaaggtgctgagggatcggggctgctttggggaccagcggtggatgtggatggggattcaggacgagctgagcagaggggaccgcatct

SEQ ID NO: 51915 - DNA, 1218 bp, Homo sapiens
gttcaatctgctgataacgcctttcctcccttgcaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagttagcgctggccttctgtgttccttctcgccggcctcgctttccgagcgcgtgtggccgtggccgtgcgctggctccaagctgggacgcgtgtgggccccgctcacggcagcaaggaagtgtcccgtccccagccccgccgccctgaaaacaccaggtatgtgatgaggtgcagagtccctgtccctttccgccctctgccgttggagggcagaagcaccagcaaacactgttctggcgccgcagcacgcacctcccgccgccttcccactgtgcctagtacaaatgtgaggcagccgaggttcagttgcagtaactcagccaaggctgcacagagccacag

SEQ ID NO: 51916 - DNA, 1152 bp, Homo sapiens
tgtgtgctttccactctgggtggaggctgggtgtggggaagacggctgattttttggcttttgcttctgaagaagcccaggccaagggacggatgctgcctctccagcagcagccacttgtgtgcaccggcctgactgtccccagggcagggatctgcctgccgtccacccccccatgcttcagaggagcctctgatgctggtgcagggatcccagaagccacataagcctccccgctgctcagcggcacattgcctgtccagggctagctggcttggaaggggtgacctcactctctgatctctgagtctctggggttggagggcagagtcagggctggactccaccctggctggcccagatgctctgctggagctgcctggacgcccagtgccgactcggccacaaccagcataaccttccgcccctaacgagctgcagctgttcctttaaacaggtttcgctaatggaaaggaaaatagtcttgcttgttggtaatggccaagaaccatgacttgagcttgtgacagatccagatgtagggaaggaggcagcatccctggagagtaggagggaaacttgtttgtaaaaagaaggcatttggaaccctgccaactggggctgcagagcccaggtccaggggctgcgcactgaaggcccaccccagaaggggtgcagcagactttccaaggtggaggtggggtcaggcacttagaaaaccaggtggagctgcttttccgaggccgtgggacttaagtgcaccagtctggtctgtgtgtgccaacttaaggcccacgactcgggtcagcctcacagtgtggccatcaggcatttccatcatggcattgagaaaaaactctttttaagatacaccgtgatggtgcagttccctggccgcccactgggggcgtcctggcgtagaaaccctggcagccaggtctgctcaagatgactcctccctcccacagagtcgagcactgtctccaagcgctgattcgaggttgcttggccgtgaccttcccaagcattgtcccttaaataagccccctgctccttccgccttccaccatttcacttctaacttcctgtgtctaacatgattctagctctggaactttctccttcgtgtgatccagccaagacctggcgggc

SEQ ID NO: 51917 - DNA, 1821 bp, Homo sapiens
aatgccagtgggccctggtgtggcttcagttgcggctgccttggccctcctgtcaccacgttgtttgggaaggcagggaggtgctctcgggtttcacagaattgttcacaaaattagtggggagcccaaggggtggtgatgtggtttagagcagctcccaggcatgggcagagctggccgccaatccctgggtactggcttcctccctgcctgtggactgtggatgggaaggtgccgggagcacagatggcaggtggggtcttggcagcctggagcgcgctcactgatgccccagagcaggcgtgtgccaccctccagtggccacactggggactgcagggctggcaggtggagggagggcgtgggcctcagggttcctgaccttttgccactgcgctgaccgacctcccttccaggacatggaaaataaaatcagaagtacgctgaacgagatctactttggaaaaacaaaggatatcgtcaatgggctgaggtaatgtaccagaaagcacaagctttagaagcagacagagggatttgaaccctggctctgccagttactagctgtgtggtcttgggcctcggtgtcctcattggtaggctgcagtgcccctcttctgggatgatcattatgttgattttggaaagtaaagtcctgatgtgtcatctgcactctccgtagcagctgtcggtccctatctgcaccatttgttttctggggcatgttcaccctaacagccattggtgcccttgcccccggagcctcctcagccctgcagtttgtcagtccccgctcaaaaatctccccaccctccagcctgggcctaggggagccatgacaccacattccgggcagcccggctgcctctggctggcctgctctccgagacagcagagcgcaacgtgcaggcagggccctcagtccgggccttctcaggcccccagcctccctgacgccacatgcaggcagggccctcagcctgggcgttctcagggggccccagcctctctgacgtcctctgccagggctctgctgccagtggccagtgtcctgcaccatccttcccacctcgtgccctcagctctgcagtgtcagcccaaacaaaagccgggcgctctctggaccctccaggtccacggcggacagagcaggaggcaggcctctgacatgaggccagagcccagctgggggcagtaaacggctgtggagggagcactggccttggagtcaggagagtcaggaggccgggatctcccctaagctctgtcatcccgagctgcatggcctctggcactcctcgcagaggcccttgtccagtcgaggaggcacggtcggctgagatgatgaatctagaacacgctctgcagtccagcagcaccgtgtgagtcgggctgtgctatgcctttagcggccagccctctcacccactgccgtggtgtagctctcacagcccagcccagaggagaggcaggctgcagtcccggggctgccccagctcgtggactggggtgggcgacagatttcagtcacctgctttacagttttaaaacagaggaggagtcctctttggacccttgtcttctgatcccctgcccacctgggggaggcttggtcttcgtgacctgtgacagggttagagcccagtggtccctggcgttaggcctgccactggcagccactgcccgatacaccaaacacactttcccgcccagccaacctgcacagtccccaggcagtggctgggaagtgggggagagaagccgaagagcctgcgggtggtggtggcgagcccctgaataccacgaccaccgccagcgtgg

SEQ ID NO: 51918 - DNA, 1037 bp, Homo sapiens
acagccaaacccccaggcagccagctcccctgcagcctgactctcccacatcctgccacctggggagtgggtggaaaatcctgaatctgtatccagagactgcttcctgtatcacttaccactccaggctgttgataattccacccggtttacagtgacctggacaaatatttaatcctcagccctcctaatagtttaaatcagagctgtcagcccatggccagagtctggttccggcttgccgtgagcagtgtctcctgccaagctaaacccaggcctgatgagtgcctgtcctcagcacaccttggccagggcttcggactttgtttgcgttgccttttgctctgggggctttaatgaggaaattaatgctctgccatcattctaacggccgatcaccacatcattcatttgaggtgcattaaagctggggctgggttccaatgtaagtaactacagaagggggagggattgcaatgaggtagacaaatctaagttaatgatgcacagcttctgagcaaacaggggaagtgagggttgcagagcttggctacgggtcccagaggagccttggaaaaacgcctgtgcttgtttggatgggaggcgaagggttctgggagaagtgagcagctcagtgagcatgaacatgcatggtttgcaggctgtccccttggattagattgtaaccaaggtcaagttattctcatttaacaggtgaggaaactgaagttcaaacttaaataatttgcccatataatttaaccagtaagaagcaaagctgggatgtgaacccagatttgcctggtgagaaaaaaatatgctactttctaccatgccacaactgttttggtcttaattcgtcctctgtgcctgccattcggtgactgctaaatagtcagatggaagtgcatggagcagtcagctcagtgtagacaggactctgtctcagcagccggcatgagcagctgcagtggacctgtagcctcaggagcaagcaggccccgcaagcaggatcaaccctgcagagccgcacacgg

SEQ ID NO: 51919 - DNA, 1045 bp, Homo sapiens
gcattccagccagccccacctcctgtgttcccttctacttctgcctcatcaaggctgtgggcgtttccatcttttctttttctttttttctttttgagacggagtttcactcttgttactcaggctggagtgcaatggcatgatctcggctcaccgcaacctctgcctcccgggttcaagcgattctcctgcctcagcctcccaagtcgctgggattacaggcatgcaccaccacgcccgactaattttgtgtgtttttttaatagagacggggcttctccatgtgggtcaggctggtctcgaactcctgacctcaggtgatctgcccgtctcggcctccctaaatgctgggattacaggcgtgagccaccatgcccggcctggtttccatctttatactgactccaacatgaaaaaagtgcccagaccagagccctccttcctggtggaccatcagtttctccacagaagccttcactagggctgcccgtgctctttctggaaatccacgcgatctggaactcagtgacatcctcatttgcacagtctcctgctttcacgtatattcctgtgcataaagacttcgggggaagagtggcttggatagaatacagatcacaacagcttcgggatcccaaaagagacgttgaaatgttgaagccatgtctacgagagtgatctgtcacagatttgagtggaaagtgatattcttgggtccagtctaccaagttctcaagtccaggatgtgagaggtattttcatggcaacacataagaaaaaatattcagctgtacacggtgacttatgcctataatcccagcactttgggaggccgaggtgggaagattacttgagcccaggagttcaagacctgcctgagcatagcgagaccctgtctctacaaaaaaatttaaaattacccaggtgtggtggcatgcacctgtagtcccagctactcaggaggctgaggtgggaggatcacttgagcccagaatgtcgaggctgcaatgagccatggtcatgccattgcactccaacctgggca

SEQ ID NO: 51920 - DNA, 1163 bp, Homo sapiens
tgcttgctgagtaccagggatgcacctcgtacgtggtagatgaggcccctgccctcaccacactccattgtggaaaaacaaacagtggaccagtgaacaagtcattgctgctagtgataacagggagcagctgacttgttatgtagagtggcccatgaggcctcttgaggagacacttgactgaggtctgacattgaggaagccagccaggcaggggggctggttgtgccagggtctctgaggcaggggcaaactcacctgtctaaggccctgagactggtgccccttaatgtgcacacacagctgtcaaccagcaagtgcacaccctcagcctcttttaaattggaagtcaatttgaaagagatttgggcaaaattggccccttttatatgtaagcttcttgggagccatctcaggatactccaggaatacagcctgccctttcagctaagtttgaaggtggaagtggaaagttcccccttgaaagtgtttgctagattttcccccagcttggggagctaacgtgccatgcgtgtcatcccctaagcctgaggaagttgcctggcctcaccccttctgttctatgaggaggctgtactctggcttattactgggctgcatgttgagatatggaggtgggggtgattctgattctttatgagacttaagtgttcatgttgttactcccttaataaagtgaatcagatgtgttgccttacttcgccatttagggccagccttggggaagagcccagtttcatcttggacttctgcttcccttgttctcccttcccatctcatcgttcacatatgtaatgatacatggtgtatggttctgcaggggcttttatggcctgttatcatgagaatttccctactatcattaaaactcttcagaataatcactgaatccttacagtgactataggacaagtgggagttattccatttggcagctgatgaagctgaggctcagataagtactcaagctggttaacacagctagaaaaccacaggagccgggagtcatagctaaggcctcactcttcacgctgcctctggtgaagcctttcccttccctgggaaatgtgtatttgtaaggtggcttttgatttctgtgtgcctttgacttgcctacacactcctctctgaaggtaaactga

SEQ ID NO: 51921 - DNA, 1048 bp, Homo sapiens
catcgtgattcataataacagcaggtgccactggtacagtgcctactgtgtataagaaacagtgccaggtatttctacatagcatctcaaatcctcacaaacatagctagtttagtcctcgtttctcagattaagaaattaagacacagattaaagtatttgtccacagcaaggggtagagccaggaattaaagtcagacctgtttatctccaaaggcccgtatggatttttttgccataccacacgctcacttctgacctggagctcaggggcctctgcctccagctgctctcaggccaagataagtgcagtccttacagagcaggagcagagcagcaaacatcttcctgaatcctgagttgtttgtggcctcggcaccttccttaaaaagcgttttgctagatctgttgagatttcttcctgctccgtctaatcctgcctcccagcaccacagcaccaacatgtcacttaattgttcaggcttacaaggaagggctccagagaaagttagccataatcaacagaatctcatttataattaagctctatactgaaaatacagcaaaactgtaaaataggcaatactaattcaagttggcagacttttttctgtcaagaaccagatcctaaacgttttaggctttgcaggccacataaggtctctgttgctgcttcttggtttgttttctgttgaacctttaaaatgtaaaattcacctcttgagctttgaggtgggtggggcttggcccccagtctgtagttctattatatacgaatattttatatacattatctttactccttaacaagaacctctggggaagatggttttgttcctccttttacaaatgagaccaaggttccaagaggttaaatgactcacacaagaccacaggacatggaggtgaaaagctagaatttgaacccatatttatctgaaattcccacaaattgttgattttcacagttaaaataggcttcagtcttttaaaggttcttacatctagaactttgtcctattgtagaatagttccttccccagtgata

SEQ ID NO: 51922 - DNA, 1033 bp, Homo sapiens
tggctaggggcctggaaagtactggagactccacccagcataggagcctgtgggagttcccggcacggacgagtttttctactccgagttctttagattcctgtgtatttgaaatgtttaccttcttctcgggacttcagcttgtactttgcccaccagagaccaataccaagcacatacacacttaaatttactaggccaccctggtgaccaggtaattaaagctgcacacagtttttggaaggaagactgtattagaaatcacgctccactgtaattcaagaatgggtttctttatagagggacacagttggtgtcagacacatgtggaaaagaaaagaacaggcccataattttgtctcagtgcccagggccagatgttaaaggtactgaccacaatatggctgcagtattgttagccacctgagtttggtgtgctgttttaacctctgtttcgaccttgtcctttctctctgccaggtccccagtctatgtgaggatctcctgtcttctgttgaccagccactgaaaattgccagagacaaggtggtgggaaaggattaccttttgtgtgactacaacagagatggggactcctataggtgagctcatgccccggggatgcagcaggcacagcaggcacacgcgggctgccgtaggtacctgctgcagagcacggggaccttggacttgggcagctggcagcccattcagctttccttccgtttgttccctgccctcctctcctttcttctcttgtcctccccattcttctcatcgttccatctgttattccaatcatgcagcagacgtttgaagagtgccacccacaagcatgagagatagagcagcggaccaaaggccccctgccttcatggatcttccagtctaacgggagagggatgttgttcaaaaacaactgttctattataattgcattcagtcctgcggagggcagtgtacagggtgcgcatatgatggggatcctgagggctgggagggtctctgtggtaagggatctacgaacgcagct

SEQ ID NO: 51923 - DNA, 1029 bp, Homo sapiens
ttttgtgtagaacctgggcctgagcatgtgaaatgtgagctgggggcggtcgggcagtgtgggctggaggggttagaggagatgtcctttgttgagaaatactgaagtataaagttggataggtaggaggtatccttgaaagtgaggagaccttggacttgatgtggtgagaatggtcaccatcagcccactgacggctgaacttgtatgcagtgcctcatgcgcagccatatttaaactctcatcagtcctatgaggtaggactacagaatgtggtctgggaagtgctttaatggctttgcatttttcttggtcagaaatctatgattgatcctacgtggaagaggtgggcaaaagttgaaggtgtgatctgcctttaatttggtcagctgcaggggcttgtttttcctctaaactcagcatgaaagcatgcttggctgagtttaaatttagtttgccaatttagttattactgtattttagaaataagccaaacatagaagtaggaaatgatgagcaaatttttctcattggacccttcctggtgtttaataggctattttgttcttatggcaactgaagtgttttactacagctgtgtcttttctccgggactccctcatcactctctctttcagggatgtgcatgtagctgcttttatgaaaacctggtcaactggctcccttgctgcccgtgcgggttttccctgggctcaacagggaaattgcagcattgatggtgaatgaaggagagtatcaagagctgtctttcgccatagccagataatgagagagatcacctctgaggcttagttgcaggatggtacttggacacaggttgaagtgccaggccgtatctaccactgatatatggtgtactgtgtgacattctatagattactgtcagagcatacttttttttttttttttttttttttttttgagacagggtcttgctctgtcacccaggctagagtgtagtggtgcaatcaaagctcaatgcagcctcctaaactcctgggctcaaat

SEQ ID NO: 51924 - DNA, 1024 bp, Homo sapiens
taaccccgtgtgcatcttgccacttgttctttgcctggcttttctccctcccttggagcttctcaaggaacctggcctggggatgttacctgatgtttacacccaggttacaacaaagggcaaaagtaatccgctactggagtgtgttcaccatggaaccaactggggggcacgacatctgcagccaccagggcctgttgagcaggagcaggggagccggtgagggagctttctgacgtctccagcctgcttccacttctttcagggtcttttggatgcccccacttgagacagagactgctgtcaaaggggagcaaacagcctgcacagtcgccccccgctccaggctgctggcacacagagacctggcggagggcccactgcgtggctctttgggttttagaatgccttgggcaagcatgctttttaaaaggagtttttgatattccttctggcaaaaatgactgacgcacttgtatttctccctccacagagtgatcagcagctggactgtgccttggacctaatgaggcgcctgcctccccagcaaatcgagaaaaacctcagcgacctgatcgacctggtacgtgcctccttcatatggttccatttgagactgcggctaagagttagttgcttttgtgtagctttttccatgcagaattcacaacacaggaaaccttttctctccctggcagaccatgccactggactatgagattcctccaggcagagagaagatggatttcatatggtggtctgtcattcagaaccatctgtgttgttgaagcccaagttaggagttctaaagttaatgacagtctgctccctccccagctgccttgtcttcagtttctagaagcttgcatttagacgtggtgaggaagaggccatacccatcccgcaggcattcagcagtgcacgcaggccagacgctgtcagtctctgctatggtgtgagtttctccagccaacacagtacaagcgtctacctgtaagatgcttccgtggcttcatttctagtt

SEQ ID NO: 51925 - DNA, 1053 bp, Homo sapiens
acaacagcagtcgtcattcccctgtggaaaaatctctaggggctccaaaaccttcacagaaaagtggattttaaagaatgtggcacagatgccttacctataaactggacaggagcaaaaaactgcggggagaagtgagattctgagcctagctcctcgggccagcatagctgccccctgagtagtttgggtgtgatctggctcttgtgacaaggccccagtcacctccccaggccatgccccatggttccccacctcctcctccacgcacctggctcacctctccttagcctgctgcacctgctgcctggaaaggcacacctgcttatccagggctaacctgctcctgtggccccattctgagacatcttctggggctccctgccctacttagtgggcacctgtactctgacattgacattgttgtagatggtgtgtttactctaccaaacttggagtgtaggtactggttacatctcacttgatggtttccaaatcagactttgccctggagtttgcctagtaggccaagttttcctgtatgcagatgatttcataataccgtcggatgtctgaacactgtagcagatatttagatggtggggttttatttgactgatttcttattctgaaaaattgttttagtccgtattaatggtggttttatttattgcagggtgatttaagcaattttatgctttttctttaaatcatgtgaaaacaggaggtgaaatatttcttatctcagtttatataccaaaataagaaaataacacaaaaaaccccctaaacctaccccttggagccttgccagcttaaaatggggtaactcccctccttattatttgacatcctaacaaggactcttccttgattttttttttccacactgattttgactgcaccataagctccatgaggagcagagacttttatgttcaccactcagcatcagaaacagtgcttgttacctaggaaacactcacataatgatcagatgattaattgaatggacagagaattccagaggataaggagaaatggtccttcttt

SEQ ID NO: 51926 - DNA, 1050 bp, Homo sapiens
ttcccacttgcttaaaacacctttgcaaacttcctgttagtgatcgtacagtgcttcatcttacagttgtaccttaatttactcatgttggacatgaaggctgttttcactttttgctatcataaataatgctgaaatggatatctttgtgtcaaagatctcgtgggtcaaaaaaattttaaaaaggccaggcgtggtggcttacacctataaacccagcactttgggaggccgaggcgggcagatcactggagattaggagttcaataccagcctggccaacgtggtgagatcccgtctctactaaaaatacaaaaattagctgggtgtagtggcaggcgcctgtagtcccagctgcttgggaggctgaggcaagagaatcgcttgaacctgggaggtggaggttgcagtgagccaggattgcgccacttcactccagcctgggcaacagagtgagattccatctcaaaaataaaaataaaatacaaaaatttgttttcttcccaatttggagctatcttacaaaattgctttttagatcacctctctgaatttcagctacacgttgtaattgcttactttggctggaggattggttcctttgtgtcagtttcaggcatgaggtggggagtggcagaacagccaggccagggcctgggaagatggcagggtccttagagccagtgtgcagttatgtttataatctagatggggctaggcacgctgttttctgtaaatagtccctttgtgttcgtcattagttttcagtaaaggtttgtttgtttatatgagtgagaaaatgttttcattgttttaagagggttggaccctagagtgttttaataagatacaagcccaagttgtcacagggtggggaggtggcagctgggtgtctgagacctcagggctggggggtgttgcagactgatggaggggcaagccctggggccatgtacacctcaggagagagagggattgaggccagagacacacctgcctctttctatgggagacactcctgctgaagctcttcattgatgaaaatctgaa

SEQ ID NO: 51927 - DNA, 1052 bp, Homo sapiens
caaagccctgggctcaggtgatcctccttcctcagcctcctgagtagccgagactgcaggtcccttcttgtgcagtcatttttatgattgtatcattaatagaatcagtagtaatagcacatatttattcattgctgtgtgccagagacagtattcaagacattaagtcaatgcatcatctcacttaaatgtaatgacttaatcttcattcaccccagtgagctaggtgttattatcctagttttagagacaagaaaactgaggctcagtgagggtaggtaattcgcctgttatgatgtttctggtgatccatagcattcggattcctactcaggcttgccccattccaaactcttcttcagttaagtatttatgcagtggcttctaaaagatagatttcgtttccataaacacttaaaactcttattttaagtaaaagttccatcaggtttttacaaaaatagattttaccctagtgctcaagtcaagggggcaatggccctgcgggtttaggatttaggatgaggtgagcaggaagcatgcgtggaagccagctcatgcccctcatgcatattcacgaagggcctgcttctgtgaaacagaccccgactggagtgcctctggatgcccatgctcagctcaggctgggtgaagctccgcctcagccaggagctccaaggagtggcaggtgggtcgggggagagagaaggaggcagagcctggtcctacaacgttcagttgtccctctgtgtgacctatgctgagggttgccagtttgcaaagcaacagtgacctatgctgaggcttgccagtttggacctgaaagtgggctccaccccctgcttactagctgggtgaccttgtgcaagtcccttcacctctctaagcccatatgaagatccattctcccatccactaacaatacttctggaggctcagcccatgagccacgtgctgtgctggaacccgcccctcccccccccgcccccgcccaggggtgaataagagacagctgctctgcctacttgaagcttgcatctgagtgaagatga

SEQ ID NO: 51928 - DNA, 2784 bp, Homo sapiens
aaaagtttattgtgtttttttgttttgttataaaagcagtatgtttattatggaaaagtttgaaaatatagaaaagagggaagaaacaaaaataattcataatcttagcttgccagcagcactgttaacctttcaatatattgtttcagcgtcttagtctatatgcatagtttggagttcatattgtcagtgcctagcccccttttttaggaggcggggtctcactctgtcacccaggctggagtgcagtggctcaatcatagctcacagcagccttggactcctgagctcaagggatcctcctgcctcagcctctcaaagtgttgggattacaggcgtgagccactgcgcctggctgagggctgcattcttaggccctgcaggggtggaatgggcacagctcttgagagctctgcggccctgcagtgttttcaagctctagttcccagcatctgatgctggtgtggaaacgatgtcggggaagcataatgaggtgttatgtgaacccaaattgtgctttaaaccaaaacagccctggtcatttgggcttttgtgaatggggaggctttcgggggccctctggcctctctgcactgggaagcatgcagcagatggaagagaatttaatggggacacctgaatcactcaggcaagaaaatggattaaatatctgagctgatacctgtcccacatactgggatagagggaggccattctgatagtagtctcagggcgggtgttaaagggccatttgctccctgtgattgggctgatacacagtgtttggacctttggaccttagcacgtttggggtgagaagagcggtgacttaggctagataagtttgtagggagaatgagtgtggcacatccgtgtcctctgctgtgggggcctcactcctcagcgcaagagctgagccgctggaggggactgttcctctctttgcctcccttctcccttctgtttgctttatctttccttttattccttcttgctttagcctgctgcactgcaggaatgagcccagtgtggctgtctaccagcacaatgtttgctggatttgtatgctacttttattattatttatttgaggctttccttaaaattggcttgagggctgggcacagtgcccgtagttgccaggcatggtggatctcagcacttcgggaggccaaggtgggaggatcacttgggaccagcctaggcaacatagtgagacccaatctctacaaaataaataaataaataaataaaagctgggtgtgatggtgcatctggagtcccagctacttgggaggctgaggcgggaggatccctggagcttgtgtgttaggatttttcctatgaataactcctgcattccagcctgggtgacagaacaacaccctctctcaaaaacaaaaacaaaaaactttggcctgagcctaacaccgctatctagcctcttcgtaagcagaaacatctacaaaatcatgtttgatgtgctagttatatttttcctatgaatattaaatataggtaattattaaactgcattcatccatatgctctctaaaacctcccttaaaccccattggcctgcacagcatgccatgggaaatgctgcaggcgtgaaaagagcactgtaccaggagtctggagcgtgacttgggactgcatcctggcctctgatgtgctgggtgatgttgaactattcccgatcccccatgcctctttttcttctttgcatatcagaccatgtgagcaccagggtccctccaggctcacacgttttgagtgactgcaggatgccattcagtggtacctcgaggttactcagcccctctcacatcacctgcgccgtgaggaagctcaggactctgacctagacatgtgatctatgagctcaaaagattgaaaaacgttgcagctcaggaacattttgtcttcacgtgtgctgcttgtttttgtttgggtttcagctctcactgtttattagccaaggaagcagcctggtctagtgcaaagagtaagggctttggagctaggcaggaccttgaatagctccatgcatctggctctgcctccccagtgtgggagtgaaagaccctcctggcggagctgtggagctggtggagtaggccaggagcacagattcacctctgagtctgatcctccacccaccacacctcagcctaagtgcgtgcagtgattagtgtcgcctctgtcccaataaaagggttgtccttggtcatggatggtagctgggctcctggggccagactgcctgggtttaaatctttgttcccttacacttttagctgtgtagccttgggcttcacttaactctctgggactggttccttgtcataggatcgatttgaggctaattaaatgaggtcaagcaggtaagaaggcctgtcatacctagcacatatagggctccgtacatgttgttggtcttatcactgttaatgagttaatgcacgtcaaatgagtcgtagcacctgggacatagtaagtgcccaataaatggtagctcttgtctttatcacatgagcccagaggcccaggacaggaggcactggcttctgggaggagaggagatagatggttttctacattcagctctggttagatccagaggttttcattctccccaccctctaagcttttggtgcctatatccctgaccaacaggaacccagcaatggaccacaccacttctacctgagccattgcacagagtcacctctgcagttggctttgaaagaattagagctcaagtttggaataggcaattca

SEQ ID NO: 51929 - DNA, 1674 bp, Homo sapiens
cctctgcatgcaccgttccgtttccttcccagaatccttctaagcatgggatcctatgaatttaggcctttatgtaaattcagaatgatacagatttagactttatataaattgccaataagtggcagagtcaggtcttgaacccagctgctctgaatttaaaagcctttgccctcagcctctgctgtgtcatggaattttactgctcacaggggtttggggcttgaccaaggtcccacagtaaaccactggagcactgggatcaggtcctatgtctaacactctagaatctagattctacactcttgtgtgagtcttttctgccacataaacttaggcctgtttcaaagctcatctttgaacatcctttttcagtgatgcatggaaagaccacattttccaaataggacattgtgagagagcttcgtggcaattgggtcgaacagtcagaatgccaatggcctgagttcaagaagaaatctaaggaaaggtccagattcaagcccaggtccctttgatctgtagctcatgtttatggggtacatagggacaggaatcatcgtaacaagacactggagaaagtggttgtccaacagtaggtaaaaatggtggcacatctatgcaatggactattttttattttttattttttggcgacagcgtctcatgcttttgctcaggctacagtgcagtggcgtggtgacagcacactgcagcctccacctcccgggctcaagcagtcctcttgcctcagcctcccgagtagctgggactgcagatttgctctaccgcacccagcaatttttgtattttttgtagagacggggtttcaccgtgttgcccagtctggtctcaaactcttgtgctcaagccacaatggaatggaatgcagccattaacatgtgacatgtgaagacggtgttgtagtttggaagatgtgctagtgttgagtgaagcacagtagtccgtctgtcctgggcttgtggttctgtggaataccccccgacctgggtgcttgtgggcattacagaagtgaacaatttgcaagccctttactgtgctctctgttgcttgcagtgggcgggcgtgtgtgtgtgtgtgtgtgtgtgtgtgtgtgtgtgtgtgtgtgtattcttttcctccttttgagtatcttccttccttgagataagtccccaggagggagagtgtagagtattttttctctctgcaccttcttgaaccggtcactttgctctgacaaatgctctctccgtggccgccgcctcactgcctgtccccagagccctctgagctgactcatcctccctgcctagcaggcttcacttcacttcctcaatctccctgttctggccaagttgagaggactcccttcctgcaaaaatgtgttctaaggttagctcatggtttttgctgtattaatctctatgccagaactgttatttattaattttttctttaagtttcctcactttttaacttaaattatttaggaaggaaactttgtccttaccatgaatggaaaacaatatcaattgctgtatatagaaagtacacactgaaataaacatatagtcatctactgccgtaaaagatgttcatctgtagagcacccacaatcctctggccaccaccagcttgtggctcccccttccctgcctgttccctcctgcc

SEQ ID NO: 51930 - DNA, 1053 bp, Homo sapiens
agtgttcactcacagagtggccccttccttctgccagtatttaccggatgcccacagtcattgtctgtaattctctcaacaccaaccctgtgaggtctgtttcctcattttgcagataaggaaaccggagctcagagaggtgtagtaacttgctgaagggcccccagctagttaatggcagttgccatggaggtccaggtccaccgcactcagcgcatgctgatggaattcccctctcctgcctctctggcaccagcccatggggatgtttattttatagatgaggaaactggggccgagaggttcccctgtacgtctagccacagtggctgaagaggtctgggttttgtttaggaggtttttttggttccacttgttgaaatgcaaggagatggaactttgtgaactgcaatctgttttccaaaagatagccactcagctgaaagggcgagatagtcttagcctagcgtcggccactgtgtggcttggcctactggacaggacggttctttgtgcagtagtgtcagtgtccctggctcttcctgcctgtgacgtgagtggcagcagcacatcttaatcattgcgacagccctccatggggactattgggtgacaaagccttgcaggatcctttggctttttcctatgaagccccatcccagccctggtcaccatatacagtgtaagatgcagggattctgagaggaaagacaaaattggcctgtttgattgattgattgagacagggtctcattctgttgcccaggctggagtgcatggttccatcttggctcactgtagcctcagcctcctcggctcaagcagtcctcccccttcagcctctcatgcagctgggataacaggcatgtgccacagtgcctgccagctgggataacaggcatgtgccacagtgcctgcctgcctgcctatctatctatctatctatctatctatctatctatctatctatctatctatctatctacttattttttagagacagagtcttactttgttgcccaggctggtctcgaacttgtgggctcaagggat

SEQ ID NO: 51931 - DNA, 2022 bp, Homo sapiens
gggtgaaatttgtaatgtacttactccagtgcttggcacacagtagctgtggttgttgcatgtcttattctgcataccacagaataagggacacaaatagaagccatcatccctgtcctctaatctgggagggggaggcaagatgcgtccaaaaagccaagtgcagcaggaatgaagtagtactagaaaagacttagccagggacccatgggtgctgtggtctgcccatccctgcaggcctggcttgcatttccccctcctccacgcagccctgcagaccactccagcctgcagtcggcttgggggctgggcatgaagcctgggaagagtgtgctcaggcagagaggacagggtggggtatggtcaaggggactggcacaaaagcagaggtcagggggtgtggtcacacaagcagtagatgcgagcccatggggtgcctcagtctcaggagtgagttgtggagtgcctgagttgctaagctaaggagtttgcattagatctgggacagtgtggagccagtgaaatttttgacagggcaggtagaaattcgaggaggctggcagagcggtggtattttaggaagagccctctggctgtgcatgcaggaggcctgggaggtgaaagagatgggagagaggcctccacaagcatcagcttgtgagcttatgagggtcctggccactgtgcagctgtgggtgtggaaaggaagggatggtggaaggagataaaggcagagtgacacggaatgatttaccacctctggagctgagggggtctgccccagagctgtcccatgtaggtgttctgattggacagtttatcattgacacacagctatttcaggtcagtctaaatcctagatagtggtgtctgcaaagccttgagagcctgttaacaactgaatggggatttcagtctgggtagcccagtgatccatccagccagtgactctgtgactgcaggtggcaccaagttcagcctgatgcacacagcattaggttctggtgcctaagacaccagtctgctgagggagatggtggggtggcgggctctgcatggcagctgtaggaataacagaagctagtttttttttgtttgtttgtttgagacagagtctcgctctgccacctaggctggagtacagtggcacgatctcgactccctgcaacctccgtctcctagactcagggaattctcttgcctcagcctcccaagtagctgggactacaggtgcgtaccaccatgcctagctaattttttgtatttttagtagagacagggtttcaccatgttggccaggctggtcttgaacgcctggcctcatgatctgcctgcctcagcctcccaaagtgctggggattacaggcatgagccactgtacttggccaggagctagttttgactgatgactttttaatattccagccagccctacgaggcagattctcatgtcaccctcattatgcaggtgaggaaaccgaggcccacctggcagtcctggcactgcgctatgctccctttagtgatttttttccatcgggtcattcattccgtggatgtctactgagcagtcaggtagacctaatagaatatgccatctgagtcttaaggttaaatggaggaagcgggtggaagcaagtatgtccaaagttctgaaagactcaggagtgagtgcagaaccagcctggggaagtccacagcgtcagacaggcagggaggctgcttgcctgcgtttttccgtgcttcctcctatggtcaccccacatgtttctgacatctctggatgcttgtgaacaggagcctttgcctacaactttctagtgttaggttttcagttgtgtcgtcacgtgtcttgtaaggcaacaaccctggtggttgccattcacctggcacgtagtgatgattgtgaggactgagtttatgtgtggaaagtgtagacgatgcctggcacgttgtaagtgcagtaggagtgttatctcttattattgtggttattctgttaacatggatggatgataggtg

SEQ ID NO: 51932 - DNA, 1122 bp, Homo sapiens
cagctgaggctcaggaggtggagtgacttattcagggtgttgctcagccagtggaggaaccactgttggtcagtggaagcccatctggcaggctctaaactgttcttcccattgtaccaagctgcttgtatgtcagaaggtttaatgataccgtttgaaaaacataaaatgggatattcaaacatggcaaggggggaggagcagtatttattgcccatgtattgtattttagatcctttgtataggaaatcatgtttatagtgaaatagctgtatggtgatacaggcatatttagcatgggccagaatgagctcttggagggcagagatttgtgtcttgtgttttccgcagctgtatccgtggggcctagaacagcacctggcgttggaagaaaccacttggaatgttctctttggcatgtgtctgtgtccatgaacttacctgcttggatttcatattcattctctcagtcacttgttcttagtatcccttagccttgtaatttctgactgcttattgttacgtttatcccctatttgaatactctgaccattaagccggtgtagatggttggcgtaggacagaagtggtggtgtgaggttgcattgtaggtaaatgaattcagatcaccatgtttttcattttcagtagatttgatggtagagaatacagctagatctctgttatccattgagggaaatagtgacttgagaatctaaaatgcatttgactttggaatgaattccatgatttttgttggcatgagtttctccttcccagttaaaatgcataggcaaatggaatttatttgcattcccttagcaggtaataatcttaccactgtctgagtgctgtacaatttcagagcaccgttccttacacagcttcagtttctgacttgggaattattcttagttatgatgatggtgaggctttagcaggaacggggactagggaggccccctcaggaattgctgctccagctcacagatggttttgcctggcaggagctgatgggaacttggtattgttacaaggtgaaacaacatagttgacattaatgtctcttgatgtggataagacacattgttcaactcacatccctcttgtctgtctatacag

SEQ ID NO: 51933 - DNA, 1075 bp, Homo sapiens
cctccccaccatgatccccttccctggacttttcgccactcctagcgtaacctgcgtcagccccgctcggtccccgccctgagcctctcatcagggtcctgccccctgcctggtgcacgacccagggtccccttccctgtacctggggcgcgccttctttgcagcctttggggagcgaggggagctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcaggtgagcagaacgcctagggagagtgctggctccgctcgtggtgtttgttttggtaaagaaggcagatgctatccagacttttgaggaacctggggtttcacataggcccccacagatagacctgccctcctgccacttgacccttctgcaggacaggcccagcacttaggttggaagggccagagaacttcttcctgacaggatcaagggatttttggagcatgtttgtatgtggactttgggcctcaaagtgttttgaggaccatggttccttgtttagtcaagggatgttgctgctgaacgagggtgagtagttgagatgggttaagctttcttttgatgccttcctgtatgctgattaaaaacatgggcaatgccacttttaaggccttcggatttgtccagtaactttggctgaaaactccttgtttggggaggtgggcctggccccaggccttgatggagaa

SEQ ID NO: 51934 - DNA, 1972 bp, Homo sapiens
gaaaagagtccatttgatttggcggtaggtaatctttcccagagcagtttcggtgttagtggttcaggcgggaattccaatgcaagaaaccagtgaacgaatgagagagtgagtagggaaagtgaaggtgagtacgttaatgaatgaataaatcaagtctgtaccctctcttgcccgggggatttccagggccaatgtcgcactttggtgaggaggaaaggcctggtcacggcttggggtgacgcctaggaaactgtcagcctcgcaaacccataggcgcagccccaaggtcagggtcacctcgagcctccagacaactcgtcaccttgacgaccaactgaaaaaaccggaagggatggaagcagcggatcatctcgcgatatctggagcgtctgcgcctgccttcctgacctgggacttgtttccagctctcgcgagactttcaggggtcggagcgcgggggccggccgagaggaaagctggaggcgcgggtggggaacatgtctgagtcggagctcggcaggaagtgggaccggtgtctggcggatgcggtcgtgaagataggtaaggggcttttcgccccagcaggcccggccggtgcagagctgctggctccaggctgcgctgcccaggaggaaggaagggaagccccacgggaggtcaggcctctcggccttttccggcccctccggccagggcgagccgcccgggccccggcgggaggtcactcgggcggcgggcacagacccgaggagccggagcagcagcccgggtgcggggtggagttgcagcccggaggaggtggtcggggttggcaggtggcaggagagtcgcagagctcttgagtggaagacagtgtcggggcacaccctcgtgccggagccgcggggttctcctcccgggtggtgcattccccggcacgcggcggggaaccggctcaggaggccacgctgctccccggcggaaaccaaagtgccttctggagaaggtcacctggagcatttcatagacaccgccaggccctgatgcgagttgctgtcattcccgacttgccacctgatttatttgaatcagagtagtctggggcctgaacttagaggggtgatgatctggaatgagaattgcgctggaaagtaagaagttgttcacgttaagtttttctgcgtagtcctttaacacgtgctcagtgacggcacaaattatgaagtcactgtatggtggggaggagaaaggaaactcgtttattgagcgtatattgtcttcattgtgcgaaataatctttttacaggccgtgaaatggagagtcaggtgaaggaatttgcccacggtcacagctaacaaatggcaaaattagggattttacccagcttttctggggtcaagtcccatgttccttcttcgatgctaatttttgttacccaaatgtgatatttttgtgtggtaatcttagggtatttaagaggatttaggattgtgtctttgaatgaaaacattgaggaataagattgtaagctccatgagagcagggatgttttctggtttagtcactgccccatccccagcccctaaaagagtgcttaataaaaattgttgagagtgagtcaataaatgaaacagtttataagttaccatttcacctctgaattcagcacttacagtcaagtgatttggggcaagttatttaacttttctgtgcctgattcctatttggaaatcggcagtaataattattactatctcatggagtcgttgggaggattaaatgagttagtttgtttaaaggcttgaatatggatcacttaggaatgggttattttggaagcgactaaacagtcacttttgttttgttactgttaacagcttgcagttcagagagaagacttaacacctagctatgaaatgaccaaagtagttactaggcaatgtcatatagttaagaaagggctttgagctgggcgaagtggctcaggcc

SEQ ID NO: 51935 - DNA, 1140 bp, Homo sapiens
aaaaaagaaaagcagttatattttacctgcttattcgggttttaaaacctctatttattttgtatcaaatagtgtggaagaataggtgatttctagtatggtttgaactgataaattaagcccatggatctaaaaacaatagcaaaaattaaaacccatctttctcttggaagggagctctgagtgatgggcacagtgggcccttacttgttacacatccacttctcttttttccacttttttagcccttgttgctttctttttctttattcctgtcacatttttacacttctttttgacctctattcttattcctgccactgccactacatacattgcctagttcatctataaagtttgacattgataggtcttttttccttagtaaccctgttagcatttaagaagttcctaggtattctatttattctttatcacatcatttttcttaatagcatgtttcaccatttgaaatttgtaattggtttctttacttgattgtttcttctccctggaatgtaaacttcataagaaccagaggctgttgtgttcactgttgatcccctaacgcctggtttagaggaggcgtacaataattattgttaaatgaatgacatgtattgctgagaattttgtagaccgttctctgcccatatttgcttctcagagtgtgtttattaactgaatgaattagtatttaactgaaaaactccaagtaaagtagatttctgcccgttcacatgtttgatcatgtatccttgtgttcttgggacttataccaacttttaatttcatctgggaatgtaaattaactgtcagtagatcttaataataaagtagtattaaaaatgtttgggaatagtcaactgagaaacataaaccagagagcacttttgtatttaaacaagtagagggatgatgttggtttaagtggtagtgccaaagccttattgcaggaaattaaaaaggagtgaagaatattacattttatgaatggcatgttccgttagttttatgtgaatgcgtcattaatgggttttgcttattttatggatttatttttaagttttatcagatttattaaatgctctggctttctttatccactcagttcaagggctgtggtgtttattttccttg

SEQ ID NO: 51936 - DNA, 1140 bp, Homo sapiens; identical to SEQ ID NO: 51935

SEQ ID NO: 51937 - DNA, 1648 bp, Homo sapiens
aaatatgctgaattgctttctttggcaagtgcatttcagtattgaatccaagtaaaaacacaaatatttacttataaaagtcatttggtgtagtaatatttttactatggccactgacccactagtgaaatgttagggcattgctagattggatcctgtttatttaagggccgagagaaagagaaagctaacattaattgaatgcctattaatgtgccatcatatttggtacactattatctcttttttgctttcccagcaactcgggaagtttatattatctctgtttttccagcaagaaaagtagctctcaaagaaatttatagaaattgagaagttgatttttaaactctgaaaatgtaaacaatccaaaatagtcaaaccaatttttaaaaagaacaaagttgagattcttgtattagctgattttaaggcttgcagtaaagctacaagacagtgtggtgttggagaagagctggacatataaatcagtagagtaggataaagtccagaaatagacccatacatacatggtcaattcgtttttgacaaggcaatttaatggagaaaggaaaatcttttcaacaaaccatgctaaaacgactaggtttccatatagagaaaaaaatgagcctcgcttaaaagggtcgtagacctaaatataaaagctaaaactataaaacctataagagctttcccgtgtggagtctggagacgacgtgcagaaatggcacctggaaaggggaaggaaaagaaggaagaacaggtcatcaacctcggacctcaggtggctgaaggggagaatgtatttggtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctggggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaaagtgaaacctgtaagagaaaatcctttgtgaccttggagtcagaaaagattttggggaatacaaaaagcaagtttcaaagaaaactgatatactggatttgataaaaattaaaaacttttgctctttgaatggcaccattaagaaaacaaaaaggcaagccgcagaatgggaggaaatatttgtaatacacatatctgataaagggcttagaatacataaagatctcttaattttaaggttcccccccacccatagactcagggtctcacatgttgctcaggctactacttctggcctcaagcaatcctcctgccccagtgtccgaaaattctgcaatttaagatgtgagccacttttcccagctttttttttttttttttttttttttttttgagatgggatc

SEQ ID NO: 51938 - DNA, 1648 bp, Homo sapiens; identical to SEQ ID NO: 51937

SEQ ID NO: 51939 - DNA, 1120 bp, Homo sapiens
tttaatttttatcaaatccagtatatcagttttctttgaaacttgctttttgtattccccaaaatcttttctgactccaaggtcacaaaggattttctcttacaggtttcactttttttatttattttttacatgaaggcaatttattaacagaaaatattttgaggaatcttgttcacagacggcgaccacggtgacccccttcctgagagtgctgtcagaggggatgggggtgacgtcctcaatcctcccgatcttcatacccgagcaggcaagggctctgagggccgactgggccccaggtccaagggtcttggtcctatttcctcctgtggcccggagttggatgtgtagggcaatgatacccagctccttgcacctctgggccacatcctgggtggtcaacatagcagcatatggcgaggattcatctcggtctgccttcaccttcatcccaccagtcacacggcagatggtttgtttgccagaaagatccgtgacatggacaaaagtgtcattgaaggatgcaaagatatggcagacaccaaatacattctccccttcagccacctgaggtccgaggttgatgacctgttcttccttcttttccttcccctttccaggtgccatttctgcacgtcgtctccagactccacacgggaaagctcttataggttttatagttttagcttttatatttaggtctacgacccttttaagcgaggctcatttttttctctatatggaaacctagtcgttttagcatggtttgttgaaaagattttcctttctccattaaattgccttgtcaaaaacgaattgaccatgtatgtatgggtctatttctggactttatcctactctactgatttatatgtccagctcttctccaacaccacactgtcttgtagctttactgcaagccttaaaatcagctaatacaagaatctcaactttgttctttttaaaaattggtttgactattttggattgtttacattttcagagtttaaaaatcaacttctcaatttctataaatttctttgagagctacttttcttgctggaaaaacagagataatataaacttcccgagttgctgggaaagcaaaaaagagata

SEQ ID NO: 51940 - DNA, 1065 bp, Homo sapiens
gggccacacagtgccgctgtactatcatgtcagctgggtggtgcttcctggccttactgtccttgccagattttagcaggctctcagaaggcctgaaactcaggcacattctttcaacaccttttcagatgctgacttcggatatcatcatttgtatcaacacatcctaaatgcagaaacatgggtgtacttaaaaatatttgactgccttttctgtttatctttgtccgtgaggctttttaatatactctttcctacggatccctgacctatgaattgtcgttaagtgtggtcacttcccccttctcagaagttcctagtcctggtcaaacccttgcctttgcctgtactggttgtcttccataccatctctttcatttctgcctatcatggaatacaggaaaggtggagggagggctgttgagagatcacaggatgcaaggtggtaacattaccagtcagttgagccgagaagggtctgaagtctggaccttagctcccacttgcagttgctttggggctgcagaagccaactggtattttcacctctgatggcggcttcttcagatctgtcctcattgctgccagagtgaactacataaagtacacatctgatatatagcttctctacttaattccgtctgttgcttccttattgcttacagggtagaggccacgatccttagcatggatggcataaaaggttgtcgttctttatctcctaccttacacttgataatttggcagcaaggagcttgctgtagctcctatctcttgccaccttacctcccacttccttctctaaccctcctggacagtttgggtatcctcagtgctcctagtacatcctgtttctgtcattgtaccctgtactttgtgggtctgattatcagttggctccaacactggaacagtgaacatagtgcgggaacttatcattccccagggcgtggcatagtacctggcacacagtgggtacacggtttgtataactaaggaaatgcccacacataatgttggccagaaagaagtttggaagatgtttagttttcctgtggtgggttt

SEQ ID NO: 51941 - DNA, 1048 bp, Homo sapiens
cctcccttataaaaaaaaaaaagcccagatacacacacacctgcacacatacacacccactctctctttcacacacacacactctcacacacacactttcacacacacacattcactctcctctctctcttagacacacacaccactcactcactttaatttttttttattttttttatttttagtagagacggggtttcaccgtgttagccaggatggtctcgatctcctgacctcgtgatccgcccgcctcggcctcccaaagtgctgggattacaggtgtgagctaccgcgcccagccaccactcactctcttaatcaattgttaagtcctgtgaattctgccagcaaaatgctcttcctttccaagcaatcctacacaccttagaagagtcttcctagagcagagcttcagtcatgttattccttctaaaacattcttcagggaagccaactgctgactgagtgaagtgctgcagacccagcttctggtgccttctgcagaatggcccaagattcctttgtagcctcctctcctgctgtcctcctggatgtgccttatgcttcagctggattgggccactcctcagttccctgcacagccctgcttttctgccactgagtggagtgcgttcccgtctccacaaactctggctgttaaatgtctgcctttctgagacaactcaggtgccaccttcttgaaaacttaaaaaaaatcttcctagccaaatgtattcccatcctccttctctggacccacagaacactgtcctttcatggcactgaggttctgcttttggacagttttctgggtaaaatggacttctttctgacttcttacccttcttgatcacaagctccccagggaagagactgtcttatttctctctgacccttgctgaagccagtactcttgccctttagtgctcagtaaatatttggactttcgatttgttcttgaaatgtttttttgtggaggaagaaggtgaaccacagttactatgtgcactgtactagtcttccaagtgttttacacatctcatgggtt

SEQ ID NO: 51942 - DNA, 1047 bp, Homo sapiens
ttatttatttattattattattattattttgttttgtttttgtttttgtagagatgcagtctgactgtgttgcccaggctggtttcaaactcctaggctcaagcgatcctcccatcttggcctcctaacgtgctgggattacaggcatgagctgctgcacgcagcctgtattacacctctgaaatcttttatcagggaggtggcagaacttactaccacttagtgtattccatgtcagacactattagagactttccatttttctaatgtagcaaccctgtaaggttgttttcactctacagatgagcaggttgaggctgggtagggttgactaattggcctggggtcagagagctgacttgtagggactggagcagcggtttgggcccggcctgtcttgctgcagcatcagtgctctaaccactcactcagcaggagagtacatccagcatttatttagaaattggatcctttctttcagacatgtaagaatgaagaagttgtctggcacaaggcttctaggatcttaaagactggtaattcctgtagcttctcatatttgtgaactgccagttgaatatggtacttaagtttttgctcatgcatcttgatgtaagttatacaaaataaaatggagttactttgctattttaactaatcttttagatgtagataaaatgtagcactgacaactataccttaggcttatgaatataggagccttgttgaaaatgttacatgtaagctggagtgaggtcttaataattgccataagttattgatagatgaaatgggtctatagtcttttttcccctatgatctattatagaaatatttcaaagtgaatttctgtttctgttcctcttcagtgagttgttcttccttcattgaaagtccataggcaattggaacttttgtgaagttggtcgtacaggagcatatatgactacagctcattctgttaggggctaacatccaaaatacattgctgcccaaagactgcaatcagattatatagcctacttgttaattcctgctgattatgtt

SEQ ID NO: 51943 - DNA, 1327 bp, Homo sapiens
aattctagagattaagattttctacttgatattgatggatgtggaagcattgctcatctttttgattgagtggtacggttagcaatggagtcggcatcattcttggtctactgctaggaaaagttgagcatcagagagctttttctccttgggggaaaatagaagagacaggcatggagtcagagggacaagaaaaatgctgaaatattttcctttggggcttttgatttctttgccaaaaaattgcctccagatggagaagagcaaaagctctgattgtaagccattatgtttttactggcttatctccccattccgttgcctggtttggaatctgtaagctagtccaaatcctttacctcattttctagtaccaatttactgtcttactcatcttccagctgcaaggagtgaggcaagtcgccttaaaattgaaccctgtaccattttataaaccaagcaacagcagagtcttgccaaggaatatcagtatcaatggcttccatgtccctgaggttcttgaatcacacctaccaggtcaacttcttgtgtctgtgacttgtgcggtaggattggtctgggaatgaatctaacaggcccttttggctttgtgaagacttgttactacccaggttgtctagcattctgagctgtatggggagcacagtcatattttggctgtatttcactggcagtagaaatcttgacattccaatttcccttgaggggtagtaattgtttaggggttgaaactggagaggaatccaacatctggacatggcaggtacagtagcattggagtctggcagacttgagcccagatgactgttccgcaactaactaaacaatatccttgggcaagtcattttcttcatctggggctctggagggccgtctttttcctctgcctagatattctggcttgtgtgatagctcagcctttaggaattgttctggattactgctttttatcttcctcaaaaagtagccatcactccaagtgctgaggtgacaaggggagcgtcctgttggcactatctcatgttttggctgtggtatccctctttgaggtgggtaggagagcccaggatgctggaggctccttgccagcagtgtagagagggtccactctagaacagtctcctggcttgttcccctgccccacaccccgcaacttgtctagagagaacagggagtcaagtttttatttcatgttgggcaggagaaccaaaggcatctgtaaaacctctgacaaataaagacggttagaaattagaaaattaattctctaccaaattatgaaaaaaaatctgtttaatgatgttca

SEQ ID NO: 51944 - DNA, 1057 bp, Homo sapiens
caagtagctgggattacaggcacacgccaccatgcctggctaatttttttgtattttagtagagacagggtttcaccatgttggctaagatggtctcgatctcctgacctcgtgatccgcccgcctacgcctcccagagtgcggggattacagttgtgagccaccgcgcctggcctttactacttattttcctcaaacttatcagcataggcacttaacaagtatttgctaaattaataacttcactaatttacacctcttttttggggccattgtgaaacattgataaaaatgtatggttattatagtcattagtatgatgcacgttgaatatttattgaaccctaagtaaatgtatttaagaggatggggagctttatcttctcttaataattccctattgggattttcccttttttgctcactaggaagaatgtggccattagccttcggttctggcatgggattaggaatggcttattccaactgtcagcatgatttccaggctccatatcttctacatggaaaatatgtcaaagtatgtacagaatatatatttctctttccttcagaagaaaaagatttctcctgagccctgaagaattctttagactgtttgtaatgagtaaaccatgtgtgtcattgtggcaccactctcagatactaattgctctttggccttcagtgatgtcatcactgctttggtgctaaagtctcccctgtgccttcagatgcgtatgtacgttcagatatatactcatgtgctagccgattggaattaaggagcctgcttgaatgtttatcatcaatggtaaggtagattgtgttaactatctgtaagtagcacttttcatttaagagctcagagtgccctgtaaacatctcacatatacttaagctaaacccaaagacttccgggactcagccatgattctgctttttattaatttgtttcatttttttgagacggagtcttgctttgtcgcccaggcaggagtgcagtggtgccatcttggctcactgcaaccgggttcaagtgattctcctgcctcagctt

SEQ ID NO: 51945 - DNA, 1056 bp, Homo sapiens
aacttggcaaggccatgtagttcgtaggctgatgagaaccatgctctccccactcccctgggacgccttcgacaggttttaggaattgttatccaggtcatgatggtttggccctgttccactcgtttcccactcttctccctggaagattggggctggatggcactcttaggaacctaggtagggtgtacatagtcctgttgtgagacagttttaacgtaaacagtgtgataaggttttggcttctggccctttgggtctgacctgatacagcaattagagagggttgtcagaatgccgtctgcacagttttaagctgaatgtccttgctttacaggagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagcttgagacagtccaagcttcagctctggagggcggaggaaagctcatggcatacccacctggcc

SEQ ID NO: 51946 - DNA, 1020 bp, Homo sapiens
ttccagcagacccttacaagcttcttttttcttccttcctttctcttcttccccttccccttcctttcctccccccttttctttctttttttttttttttttttttttttttttgagacaggttctcactctatcgcccaggctggagtgtagtgacacgaacatgactcactgcagcctcgacctccagagatcaagcagtcctcccacctcaacctcccatgtagctgggaatacagacgcgtaccaccacacctggctaattttttgattttttatagagacagggtctcactttttgttgctcaggcaatcctcctgcctcggcctcccaaagtgctaggataacaggcgtgagccactgtgcccagcccttatttatctatgaatgtacacccagcttcgttccagacacaggatgaaggcaggtcctgcccaagactgtgccgccattaagtgtccaggtgtgaggtcaggagtcaagggaactgcgagtttatacgagtcacctgtgcttccagacccccagtttcccactcggtagaacaaaggtgaaatgtcctactatggacttgttcaatgatcaaatgagtgctggcatgcccaaacttggtgtgggccctgagccgatgcctgggttccagtcctgctgacatttcttcactgcataaccctgggaaacttactagcacctgctcttcagatgcctcatctacaaattgaggacaatatccgcatcactgggaggtggtgcggactgggcgaggaccctgcacagggcccagccttatatattaatctgtaaccaatacttttgtctgtttccccttctcccagggggccaggcaggccaggcccaggcaagggctgatcctgggccattgtgtgggtgaagagatggcatgaggcaagcccacaagaccaggggccaaaatccatgaagcccagttctggaggcccacccaaggtgtatgcgaggccagaaactggcacccaaggaaagacatgaaagctggggag

SEQ ID NO: 51947 - DNA, 1054 bp, Homo sapiens
accgggtgccaggctgtgttccaagcacttgcaagtgtgatcacattcctccctcactgcagccacaggagggaggttccaccagtctccctgcttcagatgagaaaactgaggctgagaggtgaagccacaagaatcctaagtgccagagccaggattcaggcccagggagtctggccctggagccctcactcctaaccactatgctgtatttggcagacggcagctggactagggcagggcattccagagggtcggccagcatgggcaaaggcggggctctcaggggtgtctagaaacggtggcatctggtgtctctgcagcccacgtaagaggccccccaggtgggttggtgggaaatgctaataggtcagggtgggagcctggcactgtgccaggctaaggagttggaaacaactggttcaacgctggggaaagattgaggtctttaaactgtggagtgaatgagtaactgagtggatcctgccaaggaggacccgggggcactggtgctgggcaccctacagttcacacacatgcgcacatatgcacactcacacacacacctgcacacattcatacacgcatctgcacacactcacacggcagcaactcggcagaccccaagggcctctaatgcccctgctgttctctagatcagtgtggatgtcccagcatgactcacagggccccactcatgatctgccttcagcaccttcccccgcctctctccacctcacatgccgggctccagcagaccaagctctatttccattgttccctcttggtccgtcctctctgtctccttttctagataattcctactcatttctcaggtctcactgtgtctggaagctttccctccaataataatgatgataatagtagtagtagtaaccacacagcacacacttatggaatacactgcgttttcatgcaccagacacaattctaagctcatcatatgtattatttcatggagtccttccaacagctctgtgaagtaggtacaattatcacatccattttacagaggaggaaagagaaatgcaga

SEQ ID NO: 51948 - DNA, 1429 bp, Homo sapiens
gaagctatttctcaataaaatgtatggttcacaaggagggagatgggaaggaaacaggtactggttgagcacatacatttttctgctcaaggagatgggaaagcacagcatgccatccattctcaatataactttattgactgaatggacgaagaacgaatgaatttaatccttacaagccaacaactttatgaggtagaaattagtgtccgccttttgacaaaagaggaaactgaggcttggggagatgcagcatcgtgatgacatcagccccagttgcgctgagcacttgcagtgtgcccgccgccatgctaaatgctttacagataatctatttctggatcctcacagttcatggggaggtagtgactgttatcccttaattcatctataatatgggtacaataaccatactgcttcttaggataagattaatcctgtgaagtgcaaagcccagtggctgagatataagaagcccttggtaaagattaaccatttttcttctttgattatcaccatgctttgctatcactccacactgagttattgttcagactccaacctcagttcagagttcctacttaataacctctccatcccagccgcagcaaaggggctcagggctgaatgtccaataggaaaattgggcttcctgactcttgagtgctcacaacagcagttctcagggcacacctgaccccaattcactctaaatgttttccttttgctagattttctagcatttccatttcaagtctgaacaagtctagctactgctccaaggccaaggtctcccatcttcaaaatgatcattttggaggaaattggtttccaaatatcccagagggaggtgggatcagatggcaggttggggaagaagggaggggaggagggaggtgatggagtctgtgattatctattttgtgcttcttctgggtccatctgtttaaagatcttttttgtgcttctcttgctattattattttttgtctttttattattcaaattgcaaccctgttaggatggatccattgggtaagtagtacatcccatacactgagattccccggctgggttttagaatgttttcagctttttaaaccatcagtgggctcaaggtgactttggtgccttactctgagtggcagagtagctacccagcattggcccctgtttgagggttggtgtggtggggatgtctcaagggatcctgggcacagctggccctaaagaccagcctcttttccctcagaatggccgaggcatcccgaaagaagaaagaaaaccggaggaaatggaagcgttatctcctgataggcctggcgactgtcggaggcggaacggtgatcggtgagtccagctagagatggtggcacacgtctgggttttgtagacagagaaatgatgccaggctgtgggtgagagtgga

SEQ ID NO: 51949 - DNA, 1160 bp, Homo sapiens
cagtatagaaatacctggatccatgccaattaccataatcacgagggcatcctaggttctttggatatgtcgggaatttataggatcttatatgccttgaaattaaggaacctctcagttattatttggaaatcttattatcagagagaaacgtattacccggagcgatttgttctgataataccggtaaccccaggtcagggaagatataaaccagaaggtctaatacaggccagttctgccacttaccagccatgtgaatctgggcattatttaacttctctgagcttcaacttcctcacctgtaaaatggggataatagtagcgccctcctcacagagttcctgtggggcccagatgagttcatatatatgtgaagtgtttcaagtgagcctgggacagagtaactagtccataaatattatttgctgttgttaacaatactgttctaattgtgttattatagacccttttataaactattatagaccctattgtagtctatatgtagactctttccccaggaaaaggcttcacacatgtaattgtttatgcagcgttagggactctcagattctgtggtctctggaaggatctgagacccagggaagccatagcaactgttcagccaggagacctggctctcagtttgattctgctactaaccctctgtgtggccttgggcacgtgtctttccctccctggacaccagcacacattttctttttttacctatacaattaagggattgaatgatacgtaaatttctcttgactgtaaggttttgtgtttctgggaggtgagttcatcactgggccgaccaaggtgactctttgcagctgaggtctagagtgtgacgtaccacccctctgctcctgggtccctgtctgagccctaaggccacccggcttccctcacttgtttagtgacttcacctctcctctctgtgcctcatttcttcatctctcacatgaggataatggtagtatcgccatcagcattgagaggattaaattacttaacacatatcaaaagctgggacccgtgcttggcacatagtagagtctcagaagatgtgagctcatgagctgctggggttgatactgctcacataggccaggcgcagtggctcacacctgtaatcccagcactttgggagg

SEQ ID NO: 51950 - DNA, 1295 bp, Homo sapiens
tagctaatggtttcaatttagacttcactgcctcagtctcactgggtacatgagaaggttggaatcaacatgcttagttgcctcagtgggcacttgaaaattccttcactggcagcccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgttgctaaaact

SEQ ID NO: 51951 - DNA, 1241 bp, Homo sapiens
ctataacatgccgtttacctatattaaggtatagaaatgatgcaatccaattactgttgactcgaggcttaagaaggcaattagagtggcttgcattttgtaatacagcactttgtctctagggatcaagattgcacagggaatttaaaaaggaaccaggaacccaaattatttcagaagtgtggctcagtttttgtttttgtggtttttagaatctgaaaaggagaaaaacaaaataaaggaagatagaagagatttccttagaatagtggttctcaaaatgtagtcccctaccagtagtactggcattacctgggaacttgtgagaatgcagatttttaggccccaccccacacttactgaattagaaactccagggattgggccctggaaatattttttacaaggctccgtgtaattccgatgcttgctcaagttggagaaccactgccttaggagaaaggttgagatgttagaggactgatcagacacataaaatggaaaatgagatcttgatgaccaggcatctataatcctctagctagaattgaaattggggagaataaattttgggtcataatccccttggatttcagtttgcaaggtaatatacccctgttttctttaatctcatatgctttcatgttggtttttaaaaaatcttatctgaaggatcaatggaaggtttttcacaaaactaggtcacaaatgctacctgtcagacaattgtaagatgacatcgattttaagatgcatccagattgcagagacgttaaaatgaggaaaagatatgcattttagaataaatgattagagcaattctcagactttacttcctgagaatttggtaatgggagaaagtttatattcaaatgcagggcacattgttgaaactggtttttggagcatccttctgattcatttgaactcatcacagaacctctgataggctgtaccagacaatgaggctgaaatgaaactggctgaattagaaattggaaatagaatgtgggattaattttcagctttggtttggtggcagtattatcaggattaggttcagctgtgaatgataaaaataaaacatgatggtggcttaaacaagatggaagtttatttctctctcacagatatctggaagtagacagtcttgagtgtaaaagtgagtccacaatcatcaaggacaggtgtcctctaacttgctgctgtgccattctgagtatagtacctcatggttcaat

SEQ ID NO: 51952 - DNA, 1506 bp, Homo sapiens
catagtctccatggctgtagcttctctgaagggtgtttgatccttaaggaggcaagtttttcttgccctgatacctgccctacatctcccacgagtccccagttgttcaagcctaggggttcacagtgcaggcagtgccacttgtgggtggaacctggtctcaggctggttgacgtcgtcctgtcatctctgctgtatcccattcaaggaactttccttcctccagcgagaaggaaacccagtgagattcaccactcccaactatgacggagctctggctccgtggtgagttgaacttggtacattgttcttcatccagaaagcctatcactgagatgacaagtattgccaaggaagaaagatttaatcaggtgcttgcaaacactgcctccttgcaaacactgcccgctgcctggtgcaggggggagcaccactccccaacagtcctcttctgccctgaaacctcatgcaaggacctccccgagcaggggtgggggaccacccttcctcatcaattcagactgtaaagtgaaacccctgttcttggttgaagcgtccattctttcatgcgcgtccgtgtgaagagaccaccaaacaggctttgtgtgagcaacatggctgtttatttcacctgggtgcaggtgggctgagtctgaaaagagagtcagcaaagggtggtggattatcattagttcttataggctttgggataggcagtgaagttaagagcaatgttttgcgggcaggggtggatctcacaaagtacattctcaagagtggggagaattacaaagaatcttcttaagggtgggggagattacaaagtacattgatcagttagggtggggcaggaacaaatcacaatggtggaatgtcatcagttaaggctattttttcttctttggtgtatcttcagttacttcaggccatctggatgtacacgtgcaagtcacaggggatgcgatggcttggcttgggctcagaggcctggcacattcaggaaccttccctgctctgagaggatccctgctgtcaccacacttggccctctgctgtccttgtctggctgagaagacattccaactcgctgagggttgggcgggactctcacccagctgtggcacccttctgctcgcaggtgccctgctaacagctcctggctcaagtctagtagtgttttgagtctagaggtgatttgctttgggcatggctgggctccacttatcagttccgaggtctcctcatgggtgcctcctctcagcctccctccttccctccctttctacccaattccagtcctccgctgcctgtggcatggccagcacaaggcgtgtcctcatgtctgaggctggtgttgtcttgggagcatagcagtggatgtttgtatacttcagagcagaccatctatgggacaaatccatctctctcatgtcctcttatagcataattacatgttttgtgccaagtatcctctctcaaaaagcctgagtgagaaggaaacagaag

SEQ ID NO: 51953 - DNA, 1113 bp, Homo sapiens
ggattctggatcggaaaaaagccaacaaattggatataaaaaccattattgggacaataggggaaatttgtatattagatagttttactgtatactagatacagtattgtgttcatgttcttgtccccgccaagactgatgagcccccagggactcagatagtcaagattctaagcaggctgtcagagccttaacaaggttctgagcccaggactgaggtaggggttacttcgggctgaggggattagcaaaggcttgtgaagtggctaaagccgtgacctggatatttcaggactcaaatccacccgcattggaattctctgggtgactgcccagcccctttggcaggacagccagccacaggccctgattgtgcaggacttcctgcctctgcaaaggcagtcgggggctgagcagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggcttttaaggaggccaggccacacctcaagggaagatggaggttaccggaaggtcatacctaaaattacgggcaaaaccagggagagttatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgcc

SEQ ID NO: 51954 - DNA, 1848 bp, Homo sapiens
agtttatttctggatcacataacagttcagtaggaatcacacgttggctcctcccatcttgtagttctgccatcccctatggcctcagaattctttgctgggtcatctccatccagccgaaggatggcggcagaaggacagtggagtaaactgtgggaagtttgtctgggcaggtctggaggtggagtgtattaattccacctacctcccctggccaggaccaaatcatgtggccacacctactcgcaagggaggctgggaaatgtagtctagtcgtgagaccaggaggaaaaagagggtccatgacctgctggctagaaatgaggagcaggaaattactcagtcacactaccagatcctccctgccacatcgcgtccaccaaggtggcctctgctaaagtgacatggttgaatttttgctcctattagggatggggtcaggagggcacccctcccactcgggatctaagtctcttgcacggacaggtgctgttgggcgcatgaccactgctatgggcggctggaggagaagggctgcaacattcgcacacagtcctacaaatacagattcgcgtggggcgtggtcacctgcggtaaggctggggcttcccgttcgggccattggaagagcacctgactttaagttcagctgccctagagaacagccagcctgtatcttgttgggggaggaggagttgggtgcagaactgggacgagaggagcaggattattgcagctgtatcagacccccagggtagggctgaatcatccactgggtgcaaaagtgcttgacatgcttcctttttcttgattcccccacaaaatacctgtagagtatgtttaggcttctccattttagacatcaagaaatggaagctagaaagcctgccagtgcacacagcaggattcaagctcagggcctctgagttcaaggctaaatctggggatggttctgctctatgagaatgagagttcctccagagcagcggctgcctccaccatcagactgggagtcccccagaggaaggaaggtgcttcctctatcagactgggaactccctgagggcaggagctgtctcctgcactgaaacctcaccctgagcagcagctgtgccccttccatcagattctctattcccccgatttaggagccatgcctcttccatcaggctgaaagctcctcggagcaggaagtccatggggtctctgctgagactggagcatgctcttcccaccctcattctgctcttggtgtccttttgcagagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcat

SEQ ID NO: 51955 - DNA, 1028 bp, Homo sapiens
ggagcacctccattcaaactcagctatgggccaggtgcagtcccagcacttttggaggctaaggtgggaggatcacttgaggccaggagttcaagacaagcctggataacatagtgagactccatctctacaaaaaagtaaaacaaattagctgggcatgtttgtgtgtgcctgcagtcccagctacttgggaggctgaggtgggaggataacttgagcccaggagtttgaggttgtgatgagatgtgaacacaccactgcactccagcctgggcaacaaagcaaggtgccatttctaaaacaaaaaacaaatccagctatctgtttcactctaaaagtagcatcatcacattcatacttgccttttcttgaatccctgcaaactcttgggtgctatggaaaaaaaattaatcctcagttaagcactggttaaaaaaataaatcagtgatggtaactgttggagaatatgagtatttggctcctctgaatctggattgtgaccaccttgacaaacaacatcagagaaatgggagggagtgaagcttagaattcttgtaccaccttgaggggagtataccctgaaacctaaatgtgaaagtgatcatagatgggctagtatgctagagacactaagaggcgtggaaacccaggaagcagaagctggaagcgggtaagggagaggtctcacagaagagggctaggatagtctggctgttataatacaaggggccaaggagagcatcagatgcactgatcagtcagggaattcaggaagcatgagagtctctggctgccaatattctttctgtctaccctgtccccagtctaatctgtaaaaattcagggttcccccacttttcattgaggtcttcagcaggaatcatgctatctattaaaccaaaaagctcctctagaacatccttcatcctaaataacaaggcatgggagttatcttctcaaatactaggctaactcactgttttgcctcagtttcctcttggtgaggtagtggactacacatcatttt

SEQ ID NO: 51956 - DNA, 1140 bp, Homo sapiens
ctccttcctggggcacgctgcctgcaactctgtgattctcagagacccagggcagggctgggagcaagtggctgctgtgtggttcacgcaccacctccagcagttggctcctagaggtgcccagtcagaacaatacacagggatttcgggagagagtgctgtccttcaaatcattcaggctcatttcccagacaggccaagcacaatgccacagatttccccagtggcattacccacaggacaggtgccccttgcctctgtgggtagcagagaagtgcctcatgtgtccgaagactgcagaagtctgcctcactggtcacctgtctgtcggcagtggtctacacctcttcaaacccctgagctgaggtttatcgtggtcaaggggcaagatcatggctattagagccaccttcgtctagattcaagtcccagctatgcaacttactggctgggtgatgttaggcaagttacattactctccaagcctcagtttccctatctgtaaaagggagatgcttgtcaaagtgcttggtccagagttaagtcaacaagcggcatatcagccccttgccatctggctacattttcacctctggccactcctgcccagttcctctgccatgctttgcacacactgttctctgcctggacgctcaccctgccttgcttgctgggccaaggtctcttccttctacatggcaggcaccgcctccaggaagccttcccagacaccctcagggcattggtctatcctgggttctctgagcctccatactgttagagtggtgaggtctgtaacggtcagtgtgtgtggaccagggttgtgtcatttttgtcccaatgactccagcacaggactcagcaggagtaatatcagttgaatacatagataaaagaagcactagaaaatagaaatgaattaatgagtagagaaaggaaagaagaaagcatggaggaaggaaaaaaacaaaataaaggaaaaagagaagaaagcaagggagggagagaaaacagaagatgaaaagaaatgagagagaaaaggcagagaaggaagtgggtcctcctagggtccctcccgccatgctgatgtctcaagtcccagctatgaaacttacttaccccccgtcctgcctgcttctg

SEQ ID NO: 51957 - DNA, 1162 bp, Homo sapiens
cccacataaatcgaggtcgttgtactgagtggagccgggatgctggagtcctctgcctcaggggcccccagtccaatcccaggcccaggaactgggacaaacccagagataaacaggggagtcattctccaaggcagagcccacctcctcaccatgcctgtagagttcagcaaggccctaacagcacccagcttggcttggtagggaagataaagggtacacataggtgggggaagagcggagcagggcaggatatcaaaccctctgcaccagtgagctccttcctgtgaaattttagcatctgcaaatttatttctgccagcaatttaccttttctgcaagcaagagaaatctgttcttgtttatgagtcactgctttatggggaaaattagaaaacgaggcatctgcagtttggaaataagacagggaggtgaagtttggtggcagggccagtacaaatgagccctggagtaaagtctaatgtggtctcacttccattcagccagaggtgattattttgttggctggaggtacaaggctttattagtatccacacagcatccttttttgataaagcaaacattttctaagtaaataaactttgaagcttaaaattgaaagctccacttgacacaatagaataaactggaaaatatgctgtccgtagaaagctgttagaaaatgttaagccaagaatggtctgggtaggggtttagtattagatccacagctgggggctcgggagaggtggctggaccctgtctttgggagtattgccatcattctgtgctctgtgggggaaaccgccactgggagaccacctgggtgtctttccagggctgtcctccccctcgatgggcacctcagtgaggcatatgaggccacactacctggtgttgtagagtataccggttgtcccctagtagtcacagccttccagctcaagactacatttcccagcctcccttgcagccagtctgaccatgtgactggggtccagccaatgggatatgagcaaaagtggcacatgcgactttgggctgtgctctttaaagtgagtgtgttttaccctcctcttcctcacttcccgctgctggagcagaccccttgggccccaggagggaagccacacgtggaggctggcagcactgccctgccagc

SEQ ID NO: 51958 - DNA, 1032 bp, Homo sapiens
ccgctgcgcgtcgtgggaaccggttttggcgtcccctcctggttccgctcatctccgcacctagccttgcccaccggagctgcgctcgggacttacctggggtcccgagacccaaagactttggctccctctcctatcccagctccagacatttctgtctaaattagtgcgcctggtgcggggaggacgcgggccagtgcgcgccctggctgcagcaggagcggctgggttggcgccctctgtttccttttctcagaatggagctgggacgcaggctggaggatagagggtggtgggtggttcagaggaaagcagggaagggacccctggcagggacggaggatggagctgtttcaccgcgcagtgagccctgctccctcgccctctcctctcccgacctcccactctgggcataacgggaaatgtcagagacctctggctaggccccagcgcgctcacctctcttttcccccctttttttgcagttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttct

SEQ ID NO: 51959 - DNA, 1237 bp, Homo sapiens
ctgggccctcagggtctgaattggggagcaagtgtggtggggaggaagggctccccggtttgcagatggcgggggaggctatgtccgcgggtcgccctggagccctccgatctttgccccgcagcatctgccccccaggggggtcagcatgcttccgcccttccccgcgtgtgcgtcgtctgtccgctccctctccagctcccggaacccccactccccccgaggtcccctcgggaggcaaagccggctgcggggcgggcgcgcaccagctccgggccccgtaaacacccgtgagcgggacggcgggggctgggggcgggggcaggaagctagcggcagcccgggccggccggcgcggccccgtgacgtcgctccgctcgcagggatctctccccgaggcccgcgggtcccctcctccccgcctcctcccgccctcctccccgcgcctcgcctcggcgccgcggccggcatttctcctcgcagctcgctgcctcctctatccctgcctccctctcccccctctgtttttctcccttccttccctctccgaccctcttcctctccctcccgatcctttccctcctcctctcatctttcccctgtctctccgttctagctcgtcccccaccccaccttttcttctttctcctcctctccttcctctccccctctcctctgtctccttccaccgtctcccctgcctccctgtctttcagtccctgtttttcagccccgtctccctctcggtttctctcccccaccctccctccgggtttcctccccggtgccctccctcctctctccctcccctccccctccgcccctcgcagccccgccgctcgcagctcccagtctgcctccccgaaccggcgccgccgcccgcactcgccgcaggaccggcccgcccggctcccggggtgcgccctcctcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgacc

SEQ ID NO: 51960 - DNA, 1059 bp, Homo sapiens
cctgcatgaccctgaccctggccacctccccacagtttcctgcatccctttcagtctcatacttgtgactccaacaacattgaactgttgagtttccttaaacatgccatgctggccaggcagtagctcccgcctgtaatcccagcactttgggaggccaaggcaggaggatcacttgaggctaggaagtagaatttgagatgagcctggacaacatagcaggacactttctctacaaaaaataaaaacaaagctgaccatggtggtacacacctgtagtcccagccactcaggagactgaggtaggaggatggcttgagcccaggagattgaggttgcagtgagctgtaatcatgccacagcactccagcctgggcaacagagtgagaccctaactccaaaaaacaaataaaaacaaatagaaccccatgccatgctgttgtctgtctttgctcacatgaattcctgatctggaatgctggtcctttcttcaccttgctaagatcgattcacctttaacactcagctttaggtgtgtcctccagggaaaatcttccctgtccctccccacctaggctgggttaggtatccctcctctgagattccataataagagtctcaaatctcgattcctgctcttagccatattgtcaatgtcttgggcggggactgtctcataacttttccttctccagcacaaattctgggttgtcagtgcagactaattagaactcacatcagggctcactatttgctaggtaccctgagaagtgcagtacataatgaacccttccggtcctcacttgcgaggtacggaggaatgtgtttgtattattcttaaataaaaggaaacagaggcccagagaggtcaagtgtcttgcccaagtgcacaagagggatgggacttaaacccaggcagtctgactccagagcccaagctcttaactacagaatgtacatggaatgaatgagtcaacccatgaatgaaatagtaggtgtgggcgaaacaatcctggaagactgcctagaggagctggtttttggaccacagatgaaagt

SEQ ID NO: 51961 - DNA, 1061 bp, Homo sapiens
ccaagtcttgagagtttgctctgaaacttaaacgtatattactcataagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaaggtcagtgctggagccggcctggcctcagccgggtcatctctgtcccaggtgctggggagcccatgattcaccttggccgccccaccgtcggaaactgtccaaaaaaggaaacagcctctgaagggtgtcatccagccagtagatggaggagcgaggggcaggattcgggctcgggataacggctgctccgctccttttctcccaagtccctcttatgactcagaatgaatcttgacttcattactttactcgaaaaatatttattgaacacctgcgatgctccaggcagtgagtcgaacagatgaaagtccatcccctcgtggagataccattttagtacgactagacagcaaacatgtaaatcaggcggtgtaacagatggtgagcaatgctttagagtaaggtaggggagagaggacatggaatgctg

SEQ ID NO: 51962 - DNA, 1046 bp, Homo sapiens
aaagggaaagaggcacatcctttctttctttctgttgactggaatgtagtcaagatagctggagctccagcatccatctttgaccatgaggtagtagctaggtattgaggatggcacagcaagaagataaaagacacctgggtccccagtggctgtaaagccaccctggacttctcatattcattatagcaaagtgaacctttgtcttttttgagccactgttgtttggtttttttgttactcccaaccgaagctaatcctaactgctattcctaactcccttgcgttggctgtccctactggcttccctgcttcatttttctccagagcacttattaccagctaatgtattacatttgaataatttgcatgtttaccattggtctcctccaatagaatgtaagctcacaagggcaggaattttgtgtggtttgtccactttcacatttccaccttttccatagttctcgaacacagtagacactcagtacatatgtgttgaattgattaattgaaggataatcaaccctaaaggtaaataatcttacgatcttatagaagaggatgctgaggctcagagagggccgcaaattagaaagggatggctcctggaaattcaccaaggcaatctggctgcagaatgcatgctcctcaatactaactcaactgccaacacatgcaccgaagtcacttaaaagccttctagctgaaaccatacactgtctttaatggggaaagctacacttcttcagggaggaaatgtgagcagaagtccaaggccaagaagattctctgagggctcaggcttagttacgaatgaatattgggagtaaaaacgggaaatctcaaatatcctggattctaagacaccactgattataagacacaccaccaatttaattagggataggaaaagaaacacttcattaaatatatacattggtcacgagaaacattctgatttcagaaacattataatggggagaatctgtatcttcaactgaagcgatggggtagtcaaagatgccttcgagaaacttgttgag

SEQ ID NO: 51963 - DNA, 1026 bp, Homo sapiens
tgctcttacattgcatgcctgtatctgagtactcatttcatccgtcagctagggtctgcgggacagatccggtagggtagggaggaggttgctgcactgctccacgtaagagatgatggtagcgtggaccaggtaggagcagcagacatggtgagaacgagtcagatctcgggtgcagttggagatagagctgatgtgaataggtctggactggttaaagggtatgaaggaaagagaagagttgagattgatgccaaagttcttgacctgagcaaccatggctgacattaccatcattggtttatgtcattttattgattgattaggtgagatagggtcttgctctgtcgcccaggctggagtgcagtggcacgatcatagctcattgtagcctcgaactcctgggttcaagtagtcctcctgcttcggccccccaaaatgctgggagtgtaggcatgagccactgcacctggctggtttatgtcattttcactttgagtttatttacttctaagtggagggcaggaaagactctggaactgagagaagtcccgactacagatataacttggaggccattagtttataaaatggtgttttatgccaacagcctgatgagctcactaagggagcatgaggcacttcagcatctcaaggtcaaggagataagaaatcagcaaaggaacttgagatggagctgccactaaataagaaggaaatcaagagaggaggtaaataaaatgtattcaggaggaagcaatgatcagctgtatcaaatgctgctgagagctcagtaggggaatcgaccgctggatttagcagtgtggcggttgtcagtgaccttcagaagcactgtggaagccaaggccggataggagtggatccaagagaaggaactggaccaacacgcagccttttttcaagttgtgctgtaaagaaaggccaagaaatagggcaatggctggagaggagatgtaagaacaagacagaggcttatttcatttttttttttttgtaagtctgttt

SEQ ID NO: 51964 - DNA, 1031 bp, Homo sapiens
tgggctgctcaccacattctcttacaacctgctcgcactcatccctgagagcacacacacagtctataccatatgctctgaaatacacatgaaccttctcagagatatgaatacatgcttatgagaagcccccagcccagtgctccctccctgccaaatgtcccagacacctgcatctgagtgcccaggcgtacagacatcctgggaggctgagacagacagccgacgtccctccagggagcctggcacatgtgattttcagacaaggcataagttactgcctccttctctgacattaaggaacagcttcctggcagcagtccccagatcccgtcctaatcctggggttggctctggctgctcaaaagaactactttcaggtttctgatggtaaccagggggagctatacaggctcacctgtggcttatctgatcttcaatccattttttcacccccagcaggcctggcattaaacacaacacaggagtagtgacagggctgtaaaagcaggtccactttatttacaatgatcagtgacacatagatctttgggctttttgtggtcttgcggagacacctgggtggggggcccactcccttggttggttaacacaccctccttcctcatcctgctgggagaatccactgctgtcaggacccacctgctctgaggagcctcgacttgggagcaactctgctgcgtctactttctaggtagtcagtgtcctaagcacctgccaaaggttctccttacctcctttgggagccccatcttggtcctggttgtggggcacctaggagggggccacacacatccgtctgcagagagatgggatgggcaaggaatcccctgggggtgccagggcagaggcgtgggcagcggcctggtgcagggctgttacctggcctaacctgttgtttgaacgtcggtaggactctcccagtgttctccagaggcagagcagtgaagtcacaggagtcctccaaggcgtagagaggcggggcttgggcgtgagaattcctccctgtg

SEQ ID NO: 51965 - DNA, 1178 bp, Homo sapiens
acctggccttttatctcaggagtatagcatcgtgatccagcagctctcaaatggcaaatgggtcccctttgatggcgatgacattcagctggagtttgtccgcattgatccttttgtgaggaccttcctgaagaagaaaggtgagtgtagttcctgcacgaggatgctgccagaaacggccccaggcctcacttgctctcgaggcccaaccaggaaaagctctgggaaacccctcccggttattcttgttggttcttccgcaggtggcaaatacagtgttcagttcaagttgcccgacgtgtatggtgtattccagtttaaagtggattacaaccggctaggctacacacacctgtactcttccactcaggtaagcacaggtgacagcttctgttttcagctagcatgtgccctgcctgggctctgcagtggccaggtcctgccacctctgtcctcctgcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaat

SEQ ID NO: 51966 - DNA, 1101 bp, Homo sapiens
cgcgtcatcttcagcggctccctcgacttcttcagcgactccttcttcaactcagcagtgcagaaggcggcgcccggctcccagaggtagctgccaggaggcttaggggccggggatccgggtggtgcagtgtgtgtatatggggaggactcagaaggggaagaaggaggcttttagctaaaagtgtcagaggctgagtgtttcaggtgctgtcagattatttcagggctttattgctatattgctggtattggcacttccaattttttaaggtagtagtgacttatctagagatccctaacctccaccgttccttttagaaatttgtgtatttgttgtgcagatgacaagcaaccagccatatcttttcgtttgtttcctgcgttccctttaaccatgagtccctaggtgcccaaggcctacaggcagaacttcgctagggtactgtcatggtggacatgagtggtcctgcccatcaggcaccactggaaaggtggctctggtgcccaagctgctcctgtttccctcctgcaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggttgaatttgttaggcaagagaaagcgaatatggaagcatgaatacttgaaagtgcctggcacatgtcggggcaggagggtggtttgggtccagactttgatgggccatgaatactgtg

SEQ ID NO: 51967 - DNA, 1437 bp, Homo sapiens
aagtgatggcatcactggagatgcagaagtgctcttcctcagaccatttagacagggtggaattgacaggctctggaaactggctccagtgatcagcatcactagcgtgaaaggtgcaggtgatgagatgaaatatgggcagtacggcatttccaaatgcatatttcctatgtgagttgaaatgtgtacagcttacttgaccagtgcaattagtggatgtttgactgtttcctccaaacctccagaagtttctaattctgagccataattttgagtcttcacgctgcgaggatggggccttgcccgttctgggatgtggtgtgggaagcctctccctcattgtggcccccagagggtgctgctctgtgagtgatcgtggctgctctgcccttcatgtcccctccctgccagtgtcagaggagcagggagaggagacctctgggtcactgtgtctggtgcctgctttcagattttggaggcaacatcaacgtggagaccatcagtgcctttattgacggcggaggcagtgtgctggtagctgccagctccgacattggtgagtccgacctgggaggttctggtgctttccacttctccagggagttggagagcattacaaacagaagctgccaaattagcattcactgggtgggccttagctggggagtcagtgagggaaccgttttctcagttcagaatctgactcctggaggcagaataccacactgctgtccaggggtccatctggggctgagcccagctggatgaagctgcagggcactggggctgacagagagggagtcacaaggaagccaaggacacttggcccaaggcccccctgtaagggctcagctaggtgtctcttcggtctgtgcaggtgaccctcttcgagagctgggcagtgagtgcgggattgagtttgacgaggagaaaacggctgtcattgaccatcacaactatgacatctcagaccttggccaggtaatcaggcctgtcaccttccaggtttcaggggcatatggcaaagctctgcttagccaaaagccaagagggtgtgaggaggttctccctggcttggggaaccttttcctgaccacccacctttccatctactctttgcagcatacgctcatcgtggctgacactgagaacctgctgaaggccccaaccatcgttgggaaatcatctctaaatcccatcctctttcgaggtgttgggtgagtgagtgagcagggagaggacagcagaaacctgggggaagaaggggtcacttaatttttttgggaaatcaaggcaaaattgtaattctttaagggtacgtagatgggattaatttgttatatcaaggccgagtatagtggctcaacctgtaatcccagcgctttgggaaggcctaggcaggaggatcgcttgaggccaggagtttgagagcagcct

SEQ ID NO: 51968 - DNA, 1227 bp, Homo sapiens
ctgggcagcacaggcccgtccatgccatggcccctggagccgtgagcggcaggaaggaggctccaagtgccctgaccctgatcttattcttccaactcctcctccctagaaatggtggaggtggggcctagttcctggtcccgagccttcccaggcccagtgaagaccccgccagcaagaaggtggccaaacaccctgtccaggacgcgacggtcaagcccggggaggaccccgcaagctccagagggaagtgggctccagactagggggcgggaggccggcctgggcggagcaaagggcgctcggcctcgttgattggccgcggctgcagagctgtctctctaggattgagccttttctttagggggacggggccttgattcactcccaccaatagggttcaaggaatccacctcccaccagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaagggtgagagcggggtccgagggggtagcgtgtgggggcctggggttggtacagcatcgagggcattgaccactctccttccctctccctttcctggagcaggccgcccgggtctggcctgccgcttggcgtgcgggtccgcgatgtctgcagcaggggtttcccttcgcgtcccgtcttcctcaactacctgttttttcttgtccagaccggggctttgagctcacattcaagaccgctgatgaccccagcctgtctctcataaagtatggggaattcctctatgacaatctcatcattttctccccttcggtagaaggtaagggttccgcgtcgcccctagcactggaattcgagacccgggacttgatggattgctttcttctggttcttgggcatgtcctgggtcacaggatgggttgccagtcctggatggtgctaccacggagataaggaaaatgctcatttctgacctg

SEQ ID NO: 51969 - DNA, 1083 bp, Homo sapiens
cctaatcagcattgtcactggttcatccttacgacagccctgagaagacaggttttctacccatttcacataggaggacacaatctcagagggtccaaagtcacagtcacagcagtgagtgggaggaccatggatcaaaacccacagttcagagtttcaggcctggttccacttccgctcttgctgctgacctcccgtatggccttccgaagatcactgtccctctctgggcttctttacaaagaaggggttggatcagatgaccttgaaagcctcctcacctctgatgagtctcagagtaaagccagacatgctgtggctctttctccagccgtggacctgactctgcccatttggggagcccgcagtgccccccaggagtcctccctcttgctcagcgtgttcatccaggtccaacatctctgatgtttattgacaccatccctgctgagaccccagcccgcctccatttcccacatgctctgggatgcagcagccttcctgtctgtccccaccctcgcctgctgtcttgcctggaagccccttggctgctgtcttgcctgcaagcagatgagggtcttctctggtgcctgagcccctcctgctgtctgtttcttaaaattatcccttggcttgggctgggaagtgtcctcccctgtttaagcctgagccaggcctgacccccacctccacctgtgccctcctctaggccttgcaccaggcagcagtgacttcagcttttgttttctcatagcagtttcaactgggccacagaacaaaccagcccgcaaaacctctgcagcagacaatggcgagccgaacatggtgaggaccgcgggagagggagtggggtgtcgggggctgggagggctttgcccccagtgctgtgggtcagtgttactgtggagagctggttttccactttcctcccgcctaaggattaaagaaggggccaaggctggatccttttcatgcccctccattggcacctagaccctcaaccccctctggccctcattcaaaggtactcacagtcataaataccaagggaaagtagatggttcggtggcccatcttgccggt

SEQ ID NO: 51970 - DNA, 1051 bp, Homo sapiens
ctagaagtaattgtagtaattactcctgtgctctctagcaagtaatgattcttaatagtatggatgttaggtacctgtgctcagaattctgtactcttctggaatcaaaagttgggagattttggttggtttctttgctttatgatactgcttttaaagagacttactgaataatcacctggtggctgtattgcacaccaggcacttaagcacaggctgagaagtttagatcatttaaagtttcttccaactctaacgttctgttaactataaggacagtttgtttcagtgtgatgtaaagggaaaagacaggaaggtcatcgcactcttccacgaacatccacaactgtcaaagacatacgccttacttacattgagataaaagaatgtttgatttttcccttccaggcattccaaaggagcagaacacatttataatttttacttccatgttcagaaaggggaacaacaaaccccagaggtaatcccagaaatctctagcatggatcaatagcttcagtactctgttggtggcttagtgacctcatttacagtgtttcatacactctgaaactacctacaagctacctttgataaatgagtctcagaaagtgctgggagagagattgttggcttcttaacctacaaaatgaggaaggaaagatactattgttgagaaatgtggagacctttccttagcactatgacagaagcattcattgcacatggattctgactatgcatccacatggacttaattaaaggaaacctggtcctgtataaatcttaggaaacaggtgtatgttttaatcatgtcttttgggtataattaacaggaaaatgacatgaaaacaaaactaaacaatctgctaacaccttttgacatttgttttttcatcattgctgtttttccaaattttgttagcccttgtcaaggtttgctaaccaattcttaattaatacttactttaaagagcctgtgaaattattctctctcaggctgtgaccctcttgccatcttgatacgtcatgagaacgaaactcaccagcc

SEQ ID NO: 51971 - DNA, 1018 bp, Homo sapiens
tcttttgccagtattatgaggctgaagtgtgtattccatgcagactgttcattgctgtgtactcattggctaatacagtgccagatacatattaggagtttaagtaattgtttactaaataaatgactatggattaattttattaaatagtgggtatagaattaggtatggtgcaggacttttatagatttggcataactttatatgtatgttcaaaatacggtaaattgtaacctgatacgtgtaacctagcttgacatttttgggaagggtgggaagaagtgggatatgtccaggtaagagcatctaggttcacattatttttcttgttttatatgggacttgtgttttaatctaatttttccccgtatagcccaggagttctgtttccgaagaaagagccagatgattctagagatgaggatgaagatgaagatgagtcatcagaagaagactctgaggatgaagagccgccacctaagagaaggtgtggacatgtgaaaaccccttgtggggaggacactaaatacctcagagctgaaaaatagtgctataggaggggctaaagctaaaaagcatttcagaaactcaggatccttctcaagttctttatataaatttggattgatcttctcctttgaaaatcaagggctccagacttttagggcaagcctgtgtgtatccatagtttagttattcaaagaaaaataattacatatttccctaggaacaacgtcatgaaattgtgtctagacttcatgaattggttgaatttttatacaattttagtaaaatctctagtaaaaaattgtcacattcctattcttaacgtaagtgaccacttcatatgccgtttctctttagaaagcatctggttgtcccaacaaaacgaatctcttaagtactaaatgacggcctttgctctttggttctcacaggttgcagaagaaaaccccagccaagtccccagggaaggccgcatctgtgaagcagagagggtccaaacctgcacctaaag

SEQ ID NO: 51972 - DNA, 1041 bp, Homo sapiens
ttagtagagacagggtttcaccgtattagccaagatgatctcaatctccttacctcgtgatctgccggcctcggcctcccaaagtgctgggattacaggcgtgagccgccacgcccggcctatttctatatgccagatgttttaagagaagatgaatttggttaacaagcctttcagtttcactgatatttgcagctgttttttggatactgaatcaccataaaatatattttggatatgtctctgtaagaaagatgagaatgaaggacttcaggaaccatgatattgttttgttactgtttactgatttatgaataattagttctgttcatctttataagagattctcctagatgattatcaatacctataggtacacaatagatgtttaagtgaatggaaataattaaatacttagttttaggtctgctgtttatgtgctaccttagagcaagtcacttaactactttgagctcaagtcacttaaccactctgggctttttttttttccctgtgaaataaggtatttgactcaatggtctctaatgtgtcttttcattataactcttgccaggtatggtggctcatgcctggagtcccagcagtctgggaagccaaggtgggagtattgcttgagcccaggagtttgagaccagcctgggcaacatagtgagactttgtctctatattttgcaaaattttaaaatatagatatatgtatgtatgtatgtatataatttaactcttgccaaacttatgggcaataagtaaatgtttaattaaatacctttgaacacataggattcacttagtgtatgtcaattaccgtatgtgacaggatattaaattgatgggcatctgtttgtggttgagggaattatctaatctgaataactagataactttcatttctgaattttttttttcagtgcatttgctgaaaaaaaccctgcagaaatgcgaaaagaatgggtggatggaacagatctctgggaaagggttcagtggcaccttccagctctgttttccctattatcccag

SEQ ID NO: 51973 - DNA, 1050 bp, Homo sapiens
gagaaaacaaaagctcagagggttaactgggttgtccagtattactcagcatcagctagatggtatataaaggagctttcatctgaagtcttttgactctgcattgactgtttttttttttttctctgaagaagtaaacaccactttacattagctcttgcattaccatggcctgtaatttccttagcctactgtaaagttatgaatactagaataacaaaaattaatttactttaggttaaaggaaaaggtgcttctggaagttttgttgtggttcagaaatcaagaaaaacacctcagaaatccagaaacagaaaggtaagacatctataccacagtttgagtgctgtggagctgttactgctactaaaaatagcaacattcattgagtgtttgctgtgtgcctggcactatgcaaggttcagcctttctgctaaggcctagggaagttataaataatttgttcctctagtgagtagaatagccaaggtgcagatccaagcagtccaacctggttaagcctgtgctcttaagtgccttatattaaattatgggcagctatataaattacactgttttttgttttgagatggagtcttgctctgttgcccatgctgtagtgcagtgacatgatctcagctagctgcaacctccgcctcctggattcaagcaattctcctgcctcagcctcctgagtagctgggattacaggcactcgccacagtgcctgactaattttttttgttagtagagacagggttttaccgtgttggccaggctggtcttgaactcttgacctcagtgatctgcccgcctctgcctcccaaagtgctgggatttacagggtgagccattgctcccagctgaattatactgctttttgtgaaatatcttttaaactagaggaggtataagagtcctctgtttttttgtttgtttgtttgtttgttttcttttctaagatagaatcttgctctattgcccgggctggagtgcagtggcacgatcttggctcactgcaacctctgcttcccggattcaagtgcttgt

SEQ ID NO: 51974 - DNA, 1504 bp, Homo sapiens
gaattataaaatggctagtttcttaattatgagtctcatgaatattgcaaagtagaataattaaacaattggggatgaaatgagttttcctttctatgtaatttcctggtctatttttctaataatagataaataaccacctgaccaggaaacttgagtgacataaagaatgtaagaaaactgcattagtggtcattcattttcattttagaattcatttgttaattggagactttggctggtccgtttaataagataagcttttaccttttattgactcagattggaatacatctgcttatgcaattctgctcacctgattttttagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagtaaggagttatgtcttcttgctatttatatttgaagaatgtgtaaaaggactttagattagattgttttaaagtgttataacattggtttatgctaggtatttgctatttggatttaatttttagaattaccatttgaaataggtttattatatagttgtttgacctgttagaatatgctgtagttagcagaacacaatggtttgaataatccaaaagtctttgtcattggctttggaatgtgtttttgagcttgtaatttattgtgggagtatctgatattttaagcattggcaagacttcaataagaaatgaaacataactataaaaatctgacctagaagacatttcactattttattcctacttctgtgccaggagtgggttgtttttgtgtgcttatgttagaaggcattgatttgtatcaagccattggtagtgtgacctaaaagtctatatatgtttgatgaaatattcagttgaagaattggctttgagaatctgaaagtaaaatttgctattgatgtgtatctatataaagtgatggcagttactttttaatttttaatttttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaat

SEQ ID NO: 51975 - DNA, 3148 bp, Homo sapiens
cagcctgaccaacatggtgaaaccccatctctactaaaaatacaaaattagctgggcatggtggcgcatgcctgtaatcccagctactcaggaaggtgaggcaggagaatcgcttgaaccaaggaggcggaggttgcagcgagctgagatcgtgccaccgcactccagcctgggcaacagagcaagactccgtctcaaaaaaagaaaaaaaaaatttaatattaatggatattctggttccctaagtatgagtgtgttacactgcactgaattctttcagctgactgaaagatttccttgcagctgactgacaattgacaagtctggtattgttcttggtgttcccataaaaatattttcccgataagtgtgaatgcatcctctttgtttcaatcttccggatttatcctagttgttgtaggttgggactgttacttgccaagttgaaagctcttcaattcttagacaaggttagaccttaatgtagaagttgcatgactgtcattccctactcattgttaatagttcattagcacagagatctagatacttaagtggtcttttttttttatattgaggaatttttgtataaaatgtcattgagtctcagatgagatttttggggaagagggggtgttagtgatcaggtaaacttgggtgactgcatgggtttttatctttgaatatttaattatattcttctgtactagttttccttacattaaaaatatgacagtcttagaagcatacttttattctcctaggtgatggtctaaatttgcttctgtgggtctggaagctattagaatgtcatgttattcagcagtatttttccccttgtgttttcccttaatagaaggaaaaaaaaagtactttaatagagatagagtttaagattacagttaattttcctgactctttcgagaacagtaacaacaaaagccttctcttggtaaactgatctttgactaactgttccttagtctctttattctatccttctaagttcctgatggtggcaggaggggatggggttaggttccttaggagcttccttgcccttgttgtctttgttcatgtggaaggtgcaacagctgccgtggcttatgcattcgtcttagttgctgctttatgtagtctatattttggtagttttatctttctgagtaaccaaatcatctgtcacttacctataaattttatagttatattttttccctttggatgtgtattaaatttagacgttttagtttagttttgtttctgttaatcttcacaccaggtcttttctgtgctttaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgaggtaggggctgacacattcttgaagctcactcttggatcaatccctgacttcaggccctgctgggtccttcttggtacatgttccttcccttactttggggagtctaggttgtgaatttgaaacaaaatcagattcttttcatcttccctttcccctcaaattcctgagaaaacctccaaccttctaaatttatagcaaatcaactataattatgtgtttccatttgaaattcaagctaaaataacatactttaaaaagtgtatcttaaaaatcatatttcacttcaaaaaaaacttgttaaaagtaatttgcatcagatcctggagtcgacttgaagaattctcctacatctgacacccagttaggccctttgagaaagagagaaaagagaattttttaatgcatgtttgattatggccatctcttttcttagaaggtagaagatagcaccatgccgattcgtcgaactgtgaattctacccgggaaactcctcccaaaagcaagcttgctgaaggggaggaagaaaagccaggtaaagtaaaatggtgacacagcttaaaacatcaaaagttatactgcaatttggagtgtcccataaattcctttgaacttaattgtttttttttttttttcatggctaagtgttttggggaaacatttagagagaatcagtagctattggtatgtcattgccagaccatgagggcaaagtaaggtttcatcttctctataaaggtttttggaaggtgaaaatgttatgttggaattaaaaacaaaaatgtttggggatgacaggaatggccagagagtagcattctggacataaagtgtcatggggatcagtgcagtgtgggagaatggaaaacgtgggcctttagaatagacagtggaaggttcatccagaaatcatctggaggccttcagagaagcaaatggtgatctgttgatctataacaggtattggtagagagaagattggccagtcagtggtgggagcataacaaatggaaagaaacatagacccatcaacatggagtactaatgctcctttatggcatgtataaccacctcttctccttttcccgtctttatttttcttctcatgatctttttggtttttttccttatcttttcccttttttcctttctctcttgccttttatctcaggtttttcagggataagcacactgtgctgcctctgttgtggctgttagaatcaattatttgctgaccagcatgtattaggaatagagggccgggcacagtggctcacacctgtaatcccagcactttgggaggccaaggagggcagatcacctgaggtcaggagttcgagaccagcctggccatcatggtgaaaccccatctctactaaaattataaacattatctgggcatggtggtgcatgcctgtaatccctgctactcaggaggctgaggcacaagaattgcttgagcccaggaggcagaggttgcagtgagctgagatcacgccattgtattccagcctgggcaacagagggaaactgtctccaaaaaaaagaaaaaaaaaaaaaagaggagtagaaaatacatgcatccttggtgcatcagggcagacatcaataaccagtcaatatactcttttctggctgagcctggattttttct

SEQ ID NO: 51976 - DNA, 1012 bp, Homo sapiens
tttaagcatttcccttgacaaaaagcaaatatttgttattgttgtaacattaagtttaagcaagctgatgttcataagaggaccatgtaaaccacaagtaaactcagactgtttatttttggcacatataaaaaccaagatgaaaaacatgaataggccgggcacggtggctcacgcctgtaatcccagccctttgggaggctgaggtgggcggatcacgaggtcaggagatcgagaccatcctggctaacacggtgaaaccccgtctctactgaaaatacaaaaaattagctgggtgtcgtggcggacgcctgtagtcccagctactcaggaggctgaggcaggagaatggcgtgaaccgggaggggaggttgcagtgagccgagatcgcgccaccgcactccagcctgggcgacagagcaagactcggtctcaaaaaaaaaaaaaaaaaaaagggaaaacacaaataagttttatttgttcatcctttagtttaacaaatattaattgagcatctattctgtgcctggtatgttcttaggcatcaggtatgcagcaaatgaaccaggtagataagatccctgccaggaacaagtgtggcagcctcaaaatttgatcattcagagtgcaatagtaaaaagtttagttaataggtacactgggtcagatgcagtggcttacacctgtaatcccaacacgttgagaggccgaggcagatggatcgcttgagcccaggagtttgtgaccagcctgggcaacatggcaaaaccctgttgatacaaaaaagagaaaaattagccgggcatggcggtgcgtgcctgtagtcccagctactagggagactaaggtgggagagtcgcttgagcctgggaggttgaggctgcagtgagctgtgatactacaacctgagcatcagagtgagaccgtgtcttaaaacaaacaaacaaaaaacataggtacagtgatgttaaggcagtgtgaattaacgttgcatatacttagctctgtaatg

SEQ ID NO: 51977 - DNA, 1103 bp, Homo sapiens
aggcaagctactttgtgggtaaggagggcacttgtgcttgggtgggaatgccccactgggagtccagtgaaacttgtttccaacactaactaaaaatgcattcaggacagtaggcctcaagggcagtcctttagataactaagttttccactctgtgtatcaggactcaggacaataattcactttgagactgccactaccactgattttaaaatcttccatcaattgcctgcaatgcttaagaaacccaaagatgtcctctaaagaatgaataaaaccaaaagctatattatgcttttacaaaagtgggggtgggatttttataaaagtgggggtggggtttaaaatcaagccaataccatgtatgcaaatcacattgtctgccaactccaacctcattcaagccattctggtgagtataaagctgactgtgggcctctgcttgggcctctgcttctcctacagatattggagtgctgtgctttctaattttcccaccctttcatgaagtcgcagtctctacagatggttttccatttcagttgtttgtgggccatcaacctacaaaatgtatttatgaagaaagccagactactcccagataaatagtctttttcttttgtatctggataacaagagatttctgctggcttccatctctgaagaaataccacattaagagacttggcaagacttgtgaaacacaagaacaaaattttctatagcaataaaatgtttctctgaagtgtagttgaacacaatacaagatcccactacataagcccacagaggccatttttcagtggtggaatgctgtatgccactggtccccaatgcacaacctagatccctcacatgtgcagttcacaatgggttcgcgctcctgtgagaatctaatgccaccactgatctgacaggaggcggagctcaggtggaaatgcttgctcacacaccactcaccttctgttgtgcagcccagtttctaacaggccatggaccagtacgtgtccttggcccaggggctggggacccctgctgtatgctgcttttgttttgttttgagacagggtgttgctctgtcacccaggttggagtgcagtggc

SEQ ID NO: 51978 - DNA, 1050 bp, Homo sapiens
gtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaagtgacttctcctttggacagctgctgcatgtgtgcccattcctgggggtgctgtctggctatttattgtctaattcaaatcactcctgaggggagagagataaaacgagagagagtgagagagtgtgtgtatgtgcgtgtatgcgcacgtatgtgcatgca

SEQ ID NO: 51979 - DNA, 1029 bp, Homo sapiens
acaaaaacccagtaaataaaatgaagtggagcttttgtagttgaaatgggcggagggatatctgcagtctcatctatgtagaccttaccaaagttcagtccagtggctgtggttttttccttccacccaaagaaaagcctgacagtccaatgactgtgatggtcactacatgccaagaggcaagggtatgatgtagctctgtttcattttttcagcttttagaaaataacgtgtggtgcaaagcattaatataggctatgtagtagtgcaaagacataaagacagttattacctaggtgcttcagcacactcaagatttttcttttagaatcatgcaacaggatttaagaactgtaaacctgaaaaaaaaataagcttcttacaggcttgttctatggaaatcctatgttcagccaaaaaagttttttgttagcagtatagatttgaccactgattgtgttctgtggactgtcccatgatgaactgactgatcaaggcataaaaaaccaaagcaagaatatgggtatattttatttgtaatgagataaaatatatgagataaaaatagcagcaggtacactgctgaaagaccagcatggctacagttgtctcttgggcccattaaacagcttaatttatgctgctagcccacagagcatgagttggcaggatcaggtggttaacctagaaatcctggagtccagctagattatatttcatcagtggtacattaactgaacccaaagtatgcacataatgagagaacctgcaattatttgacatctatttgccatagcacagacaccgtcctcggcatcaaataattgcaagctgtgaggtcagaaagttggaattaaggattcatgaagcccagagttagataatatggctgagctgcaaactgttttgaagtggcagcttcagaatggtgaccctgcctatggtggtagctctttttaagtgaaaagttttagtgagatgtaggcctctgaaaaaagggtggcatactttggctagaacctggaactg

SEQ ID NO: 51980 - DNA, 1060 bp, Homo sapiens
ataccagcatctgaagagttaaagggtacttcatagttttataacagttctcattccctaggtatgccttagctgaacagtttgtaaattttctcctttctctattaaatgttatggtgaggaggtcctcctgctgtattttaagcaatctgaatttcttacaagtccctgtaacatcccacacttgacgttgctgttagattgtgtatgctgtgtagagctcctcaaatgtgtgaaaattctcattgagccactgcaagacaaaccaaagagaaggtattaggttatctttagctgacttcatcttccgtggtaacctgttgtttttgtatgcatttagcatgtatatacttagaggacttgctcggataatgctctaaaaattgcttcatgtatttaacctgtgtttcagtttccttatctgttaaatggggataagttgtacctaccttttcaggatattatgaaaattaaataagaagttaatacacgtaaacacttagaacattacgtgataaatacaaggttttcaaaaagtattaaatgttgtgatgacgaatatagcaatggaaaacagtttaaattgaagattattttcagcctcttttaaatattagtcatgaagtaatagcagttttagttttttagtatttatatagctttctaatttgtttcactatataaattgtatctcttaactgtagtccctaaatggatctcagagacaaattgaagtgtcttctcccaattggtgtaactttagataatacagctttagggacatatggcttttttaaaatctgtgctagatacttttgaaatataacaggataggacataaaatatcttgggtgtaatgaataatgtagcacagctgccctatgtgtttttattgtctggttcatttgtacacttaccagatgcacagtgaatgtgaggcccttgatccctgttctcggccttcagtctgctgagtcagaaagaccttttttagtaattccacgaaagacacaaactgagaaaggtgctatgaaggaaggaatttagttctaagagaata

SEQ ID NO: 51981 - DNA, 1023 bp, Homo sapiens
tgcactcccaactgggtgacagaacaagaccctgtctcaaaaaaatacaaataaaaattctaccacattatattttggctataaattgatattcctagaccatttagaaaactacatgggctggacgcagtggctaatgcctgaaattccagcacgttgagaggccaaggctggaggattgcttgagcccaggagttcaagaccagcctgagcaacataatgagaccctgtctctacaaaaaattaaaagattagccaggcacggtggcacgtgcctgtagtcccagctactcgagaggctgaggtgggatcggttgagcctgagaggttgaagctgcagtgagccgtgattgtgctactgcactccagcctgggcaacggagtgaaaccccatctctaaaaaaataaatagataactacataaataaataactgtaaattggtaaaattacgtttaagtttctcagacaggagtactaatgattttgtctcttgcagccacgtatggaccagtactttaatcagatggagaaaattgtgaaagaaagaaaaacctcatctaggattcggttcatgcttcaagatgttatagacctaaggctggtgagtgggaaaaaaaataataataagcctgctggtccagtctctttaaaggaattgggttggggaaggatgtcctgttgtttacatgtgtaaagatagtgcttttgcttcaggactcagaatttggattggcaaactttccgtgggagagttctgagaagggacaaaaggcctattgccagttacgtgcttcttctccttattctgattatcaaaccatattgcaattttgtttgcgctttgtttttttttttgagatagagtctcactctgtcgcccaggctggagtgcagtggctcaatctcggctcactgcagcctccgcctcccaggttcagatgattcttctgcctcagcctctggaatagctgggattacaggcacatgcccccacacctgggcaatttttgtatttttagta

SEQ ID NO: 51982 - DNA, 1098 bp, Homo sapiens
tttaaaagactcctgcctagtgtttcataccattatttatattataccataatttagacaaatttctatttttttacatcaaagttattttctgtaatgagttatgtggctaaagtatttttacgtatctctaaatataaatacatttctaaaagtgtaattactggttcaaaggttacatacacagttttaaagcttttgatacacgttgtcaaattgcccttagaaatgttaacagataatgctcccaccagctaagtgtgtatatacctatttctagaattctcctcagtagtgaaaagaaggtaatttttgactatttgttaaaatagattagtttaattatttctgtcactagttcacagtccttgttaataatttgagaagttgaacttatatattatttttaaaattaatcattacagaaagcaccatattgtcacagttactctaatgcttttttcttttttgtggcccttctaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacggtaagaagagaggaaggagtaaaacgagaaatcttcaagaggtatattctcccctcactacacattcttcccagaagtgttattggggcaacataaaggggagaatatatttttagtatttattgatataatattctcattattaaagacaatcttgctttattaaaacgtatactcccctctggaggggatatgaagtctggactgaaatgggcatgagatgggcccattcagcgtaagaaagatagagtcaggtttaaattagtaatgtaaaattatcgtcatgggcaacaaatttttcccgtgtgtctcttatggaaagcaagcaaatgcgtgctttcacatttaattaagtttgaaatttaaaaacacgttgattctaattctaatctctgtgaaaatgaaaggatagttgtt

SEQ ID NO: 51983 - DNA, 1054 bp, Homo sapiens
tcacttatacacccatgattctgtggaatttgtaagccagatgaattttttaaagccctttgtaaacttaatcctttaatctagaaatctgaaacaatggaataattcagtaaaaattatctattttcttagttttcactctatcaatatgaaaggctaggcaaacagtcctgatctgagatgaaaacagaatgtttcagaaatgctgcctatctaatgaaaccttaattgaagtatccttttgttgtctagaaaacttaaaaataacagaatcctgagcgtattattttttattgcttgaagtaactttagatatctagtctcactcttatactttatagctgagtaatgtaggggcctgagacctgtgacttgcttaagttcacatagttgatgaatagaagtagacccaggtctagaactgaatcacaagtcagttttcttatgtatgtactcatcacatgttgaattacatgctgggatatttctaaccatgaaatgggaagaacgcaggccactggttagaaagctacgagtttgtacccacaacacttgatgttgcaatctctgggctactacacaattgttcacttgatcagccaactatttgtttggtataggtaaagttctcttttatcctgcttaatttgaatataggtatcacttagacctaatatttctcagaatgactttgcagtggcaagtaatgggcctgatcttgtatttcagctcaaatagctataactgtaccaaagacatggaagaaaccaaaagatcggacccgaaccactgaagagatgttagaggcagaattggaggtaagcaaatctcttaagttcatattcagagcagtggtgccatttcatagacaggtatgtgtttatacctatttattgaaatagttttccaagcaaaacttaatatatcaagctcagagactaattgttttaagtccattttatattagaattttaaaaagatttttagtaacatgtttgatttcattgaatacttatttttctttcaaaatacctcttttaaaataacaaacttg

SEQ ID NO: 51984 - DNA, 1053 bp, Homo sapiens
taaattggttaatagattgatttcatttgttctggcaatgctaatttatatctaccatgtgacaggcccttttctgacctctagcaccacagagatgaatgaggcaaagtctttttccactgagaacttgataattttgtagagagacagataaatatatatatatatatatatatatagggatgggtaaggtgaagagaggagggaggaagtgatggtccctgttagagtgtattttttattattcatagtagctcccacatattaaggttaaagcaaatttctctgtgctttgcagtctggtaatgtagactcactgatggtcagatggaaagtagattttttttttccatctagagttatatattcgaggcagtgagctgtagcattttatttggagatgaaaagtgttgagtaggtgtaagggtaactgtattatagtctctttcctaattaaattacatatttgtgctgtagtgattgacttttttgcatctgtactagatttaccttgaattaaattgcagtcttttttgatgatggtagaagtggttcaaaagtgtcttattaaaatgcaaaagtgcctaaaacacagagcagtaaaaacagaggcctagaagatatgccagtggtctcattggagtcatctttgttctcagtgtcgacaattgcttaatggactgtcctccactgaactttttggagcaaacctacttagtgtcactttgccattttatttttttaatgacatactgtgctgttggggcaacaaactgcacatcctgtcatgctacaaaagcaaaagacaactttaaccaagataaaaatgaagctggaattcaggcaagaaagtgaaggataaggcagacttgagaggtggggtattgagtggggaagcgttttgaagttagatctgtgtttcagttctagccccaacctttactctctgtaaaggggaaacttataatctctctgttcttcagtttcctcatctctgaaatgggaatactgtaatactacctacacaaagagatttaaccagtattgttgttc

SEQ ID NO: 51985 - DNA, 1041 bp, Homo sapiens
tgcagctagcgaccagaagcaaggtttgtgtatgactgttttcctccctcttatctttagtctcttttttattaattacattgccgtcagcattcaagagtaagagtacagcatccaaggattatttagacacccacctttaaacaaagctttgaggcagaaaattaaagtattctgcctctaggaaactaaagtagggatgattggtaaaattatttcatacatttgtttaatctctcactgttagtatctgtatacagtttaaaggttagctgccttaaactgccctttaaaacaaggtgggaagtggagggagaaatcctagcatatattactttacaagaacaatacagtttagcttatatattcagcatgtccctaggtatcttgctattttaaaaaagaaaaaaagataaaacatttcttcttacaagtttgggcttctatagccacatttggagatggagccaagttccaatcccggctccatcatgcactagttatttggtcttgattgagccactgaccttgtgtgtctcagtttcttcactgatagaatggaataaagacctatgtgcttgacaggattactgtgggaacatgcctatcacaggaaaagtgcttagtaaattatagtcattaatgctgtattaaggaatagtacactaaggtctctgctcctattgaacttgaacatgaaggtgccaaatgtttgttgaaataaatactgtgcctttgggaatataatagaaaacttaaaggaaatctaataccagaaagtgggatatcatagtctttctttcctgcctagttgtattttaacttgacctttgctaaaattgagagagaattctaaacatagttcggggaagcaagtaactttgaccctgctttatgtttcagatttctaaaaatgattggatatcaatatggaagccatgtaccttcttactttcttgaattatttattcctccaaactatttgtttattctatagctctatagttagtatatagattttctaaaaattattcttttttt

SEQ ID NO: 51986 - DNA, 1163 bp, Homo sapiens
tcctgatggttttcttaaacacattttcttctagcttacattattgtaagaatatagtatataatatataaaacatacatactgagaaaaaaatatgttttatcggtaaggctttcagtcagcagtaggctgttaccagttaagtttttggggagtcaaaagttatacacagattttcaactgtgtggggtcagttcctctagctcctgaattgttcaagggtcaactgtagttcatttcatggtttagcagtaatagtttcctagaattgggtctatagcttcggttatgatattcatgttatatgttaatatgtgcagtaaatagttacattcctgcatgaagaatttgaaggtgatacctagtataatgtaaacaaatccaatcttttaaaatttcattttgtcatctcagtcataggcactgataaattaatagcattctgtaccttaaagcatacaggtatggtttttgttttagtggtgactacgataaaaatagtggttactaaattaaattatatttttctttatctttaatgaaataacttatcattagtaacctcccttgacttaaatggttcttttcaataatatgtaaagccttgtagactttaaataggtatctaaactggggtggattctctcaaaagtttttaaatgggacatttgaaaagtgtcctattctctgttcgtcatgatgagcagagatccttgctttgttatgctgtttcatagattaaaatgaatttgtatacactatatggtttgatagaggaaataagatctagtgtttggtagatcagtaaggtgactatagtttacgataatccattgtacattttgaaatagctagcagagaagaattcaaatgctcctagcataaagaaaagacaaatatttatctttgaattatgtgaatgtgttaaatttttgtgggtacactgaaactgtgtacatctgttacgcagtaataaaaattattattattatttttttgagacggagtcttgctctgtcaccaggctggagtgcagttgtgcaatcttggctctctgcaacctctgcctccctggttcaagcgattctcctgcctcagcctcccgagtagctgggattacaggcatgcaccaccatgcccagctaatttttgtgtttttagta

SEQ ID NO: 51987 - DNA, 1047 bp, Homo sapiens
cacaaaacaagcagtcagtaagtggtaactgtctttaatatgattgttatggaacaaagtctggttggataaagtaaatgttaccagtatttgcctgtgttatcatatttacaattcttattactgagtaaatggatattgtttagttgaaggcttccagtgatttaatacctgactctgtttttcaaaatgtattccttccaatctggaggatgtaaaggcaaagcaaatctgagttattaaaggtactttgcaggaggatggctatatggggtggatggctattgtttgggtttcatagtgaaataaaacctcagggtattttttttaattcagagataatattgtaaagtattaatactttaagagcttggacttcgccatcagctagatctaggtttgattcttccatgttaaccaagtgttcttggataaatcatttactgctctccaccttagttttctcacctgtaaaacggagacagtaataccatgttgaaactattatgaaaagtaaattagataatgaaaataaaatgattagcggggtgtttggcacatagtaactaggacatagaattagtattactactactaataataaaaatattagtttcttatgtaaaagagtgtttataattgaaaatttagtccagtgccatagaagcatggcttaaattttaatccagggacaaggcaaatactcctaaaagagagagacgttggggatctttactcaagaagcagagtgaaaagaaactatttatttgagaaataactgcaaaggaattagggcaaaaacgttttctgatctcctttatgtaaggcacctgttaatttctttgttcacatgcttgtgtttttcaaaccttggtttattttcataagtcatttcagataagctagcctaaggtaaactgttagtagagggaattaacgttaccattgaccacaattattttggtggattttatacactgtagattgatggaatgatgagtgaattttgaaacaaaaacagtattgctgaataggccaggtacggtt

SEQ ID NO: 51988 - DNA, 1022 bp, Homo sapiens
agatgtaatttagtaaaattcaccctttttagtgtatacgtccataagtcttgacaagcagagacattcaattctcactataagcatgatacagaacagttctgtcaccctcaaaaatctccttgttcctcttctgtagtcatctccttcctctttcaaccatttatttcttttctgttccttttacaaaatggtatcatacagtttgtagtttgaagtattgtttctttcctgtagcatgtgttttcctttatgatttttggttttgagatcatgcttcaagaatcttttatcaaattgatgagaatattcatgtatatatttttaaagaattctgtttttttcaattttaaaaattttaagtgtttgttcagtctcgtgcttattttagtgtaagttgtgaggtaggaaatccaattaaaaatcagatagttcagctgtatttattaagattgatttactaatataatgttcttactaaatattgatttcctcacaggtaacacaagtggcaagacagccgggaacccctaccccatccccttattcagcacatgaaataaacaaggggcatccaaatcttgcggcaacgcccccgggacatgcatcgtcccctggactctctcaagtaagataaaccttttttaaaaaaataagaaatgtccctgtaaaggcatcatttttgtttttctaaagagactcctaagcagtaacataaaacattacttgtatagtaatttcaagtttgtctttggcatcttttcagacttaaccgttcataaagatggctactaacaaatttcacacatttcattttgaagtcattaaaaattaactgttggtgatatttagttttcattttcattgtttaagaagttagagttttattctaaagtttactggaaaacccccccacaaagcactgatttgcttttcgatgcttaatctgctaccgtctcgcacccctttcgggtgaagcattaatggttattttctacttatgtgaaaacttggtgtcttcc

SEQ ID NO: 51989 - DNA, 1054 bp, Homo sapiens
aaacttaagtaatttgcttatatagtttctgtatagtagagccagaattcaaacttaggtctctgacaccaaaacccattctcatttttttctttttttcttccccccgccgccccaccactgttttttttttaagatagagtttcagtctgtctcccaggctggagtgcagtagcatgatcatagcttgctgcaacttctgggcttaatccttctctcccagcctccctagagctaggactacaagtgcacaccaccatgctaaatttttttttttttttttttggtagaaacaaccccatgctcttttattgatgctgtttagcctacttggatgccttgaatctgtttaccttctgtttatgttccttctttcaagtttgtgtttggaaagtgataattcgtgactcagcctcagaatggaggcatatatcacacatcttacatgatttggatctgtgtcagaggaacttaatattgtggttttgataatataattgaatttatgcttatagttgaatactaaaatctgagatttattaataccttggaattaaaatagaattcacttaccttggatcagttaaataactagttgattagcaactgactgaagatcaacaggaaaatagtaaggcattagttttaaaaaattaagttgtaagttggtaaatgactaattccattgcagtcactgaatgtatatcagtaatctccagactcgcatacaaccttgtcttggtggaaagctctgactatggattttgaacataagaaagagaatgtgagtgtctgttaaaagccatcactcctcagatgatgttaaaagtcttcactccacatcttctgaggagttgtcaagtgttcctgcttctgaccacaaggacagcaattggcctgtaatatatgtattccttgaaaaagtaaggagttaatttgttatgcttgtgtagactgttactaattttgtgtagttttactaaatgattggatttagtagaatagacaaaccttaccactctttttttttattcaagacagtcattcctaactg

SEQ ID NO: 51990 - DNA, 1541 bp, Homo sapiens
gggactacaggtgcgtgtcaccaaagccagctaattttttgtatttttagtagagacagggttttgccgtgttggacaggctggtattgaactcctggtctcaagtgatctgctcatctcggcctcccacagtgcttggattacaggcttgagccaccgcatctggcctctgaactttagatattgaaggcatcgcatctttctttttttgatgaactgtttttcccacagtgttatgtcttgtattatttaagcctaccactgtctcagagtcattgtggactagggcagattaagaaaattggagatccttttgtgactagacagatgtcttacaacttttaaatattttgataatttaccattaagaaagaacggcaatgataatggaagacacaagaggaaaagcctggccatcaagctgtatagcagttttccagaggcttttactttttattgggattggattatattaaccttacattcatgttccaaccgtgtaattttgccctaatacattattttaacttttctctagcttctgtagacatcatgattcctgtcttgcttgaatccgaatctgtatagcttgaaacagcattattactagtataagtgcaattacacatcatccatatgtgtaatacaaactggcagactaagaccccagccgatatgttaaatgcattggaaaggagtttttcacacatttaaattgtgttattttcttacatgaaagtgctcgatattattggtttgggctataataattgaatcacagttgaacttgaattcacccaaactgaaaaacatctcgtttgacctgttctgtatcagtgtgctaactgctgaaggtattaaaacactaggtgtgtgaaagcatattaaataaggatatgtttatttaaaaagcatccggtttaaatttgcaactaattttccaatttatgacatgcaaaaaaagtaattctccttttctgtcaccttgtaatttataaaaatcaacagaaaaataagttacatggtttgaattagtcatttagttttttggttttccagtatatgggaggatagaaattatttgacttcttgcttctgtttacatgattttgctctgagtaattacagtttattcttttcgtataaaggagttttcatatcttgaaaattgtccatctgagggtaagcatggtatgaatgtaatgcagtagaaatactacattgagagctcatctaaactctttcaaattcaaatgtgtcattgttttaagcagaattctctctaatcctaatgtttattgtttacatatgcatgaattcattccagagggggaattagaggatggtggctataggctttgttgggactggagctcatgtgacctgggttcagtcttggctgtgactctcaccaggtgtgcgaacctgggaaaaccacctaacctctttgttgcttagcttcctaatctgtaaaatgggcttaataataagcccattacctcataaggtaacctaccttacaggctgttttgaatcttcaa

SEQ ID NO: 51991 - DNA, 1142 bp, Homo sapiens
actgtactccagcctgggctacagagccagaccctgtctcaaaaaaacaaaacaaaacaaacaaaaaacaaaattgggaaatactgcttaatctcttgtttagcaggattctttttgctatttaggaaaagaccacattaaagaagaggttattttgttacccttaggtgtaataaaaacagtttatttgttttggataaagactttccacaaaaaaactcttcagttgcttaacattgggaagtgggaatgagtggagttgctgattttgtaagattgtatctgctttaagttttaaattattatgcatgtctccagcttagctcttactcaatattcaaaggaagtgggtcttaattagtccatgtataattttaatggcatcaagtacctaattaataattgttgaatctttgaggctaatgtagtcagctgatactccctgtgttacattgttgatctttttcagaaatattagagtttgaaagtagtccaacttcctggaataaatgctgtttcaaaagcagactacagagcacttgaccttagcttattaccttttatattgtgtgactgagtgagtgtatttaaatgtggtacattttaggtaaggcaatgaaagctgagtgtggctctggaatgtcattgatttcattcttgatcttcattagaaaaatcatagttaaaggatccaaacataagtatgcattagcttatttttcctttacacatagtagacagtaaatttaaaaagaagtgtctttgaaaggtgccaccatgagccagtgatttttctaagctggaaaggagtttggggatttttctggttcagctttctgccccctctcctacctttgttctagaggctgaggggaggttagggcaacttgcctaaccataaagttcatgccaactcaaatttatttgaggtctttaacaacactgaccagtgacctactaatagatcctgtttctcctgtaatggtcctggtttggatagtaaattatatggatacccccacctggtaaccattacatagcttagacaattaggaatctttttatttatttatttttttttggagatggagtctcgctctgtcccccaggctggagtgcaatggcaccatcttggctcactg

SEQ ID NO: 51992 - DNA, 1833 bp, Homo sapiens
ttgtgttattcttgcaagtggagaggagggatttacagaaaccagttaatgttttctttgtctgatggtaagtgacatgttctgtggtggcttattgatattagaagatactaacatggggcagaggcagaggcaaagcagcagtttgctcatataagctacttctggtttttggcttgttaatgttagattcagccacagagacagaagcacctctctaacttcagtggtgaagactgtatagttagttgtgagatagtgggagaccataaaataaggttgccatggtcatttgctggcttgttctgggtgatgatacagttagttcattatgagatatgagggaaagtaagttctggaataaactcccgtggtgctgtggtgagacacaatctatttttacctaaggaataatactttgagctaatataataggaaagtaactagttcctgattattagccacgcatatgactttaagcaatggataaactgcagctgagacttacacggatgagatattgcaggatcccaagcgacttctgaattctcaaatggcttccagttctttggcttgctgccaaccaaaggaatttttcaatctcctgtagctcagctgaaatttgagaaagttaaactattttaagtgcatttgaaatttgttggtttttacgactttttttttttttaatttatttttttagacagggacttgctctgtcacccaggctggagtgtgatcttggctcactgcaacctctgcttcctgggttcaagtgattctcatgcctcagcctcccaagtagctgggattacaggtgtgtaccaccacacctagctaatttttgtatttttagtagagatggattttgccatgttggccaggctgctcttgaactcctgacttcaaatgatccatccaccttgacctccccaagtgctgggattacgggtgttagctactatgctctaccatgatctttattaactaataattgttttgtacttttttttgagacagagtctctgtcgcccaggctggagtgcagtggcgcagtctcggctcactgcatcctccacctcctgggttcaagtgattctcctgccttagcttcctgagtagctgggattacaggtgcgcgccatcacacccatctaatttttgtatgtggggtacaggtggggttttaccatgttggccaggctgttctcgaactcctgacctcaagtgatccacccatctcagcctcccaaagtgctgggattacaggcatgagccaccacacctggcctgttgtgtacttttttgagcccactgtgtgctgcctgactttataagacattgaattttgttaatagaatgtaaactccatgaaggcagagatttttgtttattttgttcactgtggaattgctagcacctagaatactgcttgacagacagtaggcagtctgtaaatttatttgtttgtttgtttgtttgtttgtttatttatttatttttgagatggagtttcactcttgtcgccctggctggagtgctagtggcacaatctcagttcacttcaacctccgcctcctggattcaagtgattctcctgcctcagcctctagagtagctgggactacaggcgtgcaccaccacgcctggctaatttttgtatttttagtagaggcggggtttcaccatgttggtcaagatgttctcaatctcctgatcttgtgatccgcctgccttggcctcccaaagtgctgggattacaggcttgagccaccgtgcctggcctgtaaatatttattaaataaaaagtgtgttggactttgggaatcaatt

SEQ ID NO: 51993 - DNA, 2225 bp, Homo sapiens
ttagtaatgggagagttgtgatgtggtttgtggtagagatctgaggaggaaatgtgacgccggacgcttccctgtctttgacctttttaaaggaagaggaagttcaccgacattacccatcacccacaaaagtctcacttcttggaagatttgtgttaggctgaatatttttaatgggctttaatttactcctcataggcctgatgtctagagagttaccagggcttctggaggaaagtctagtattgaatgtttctaatttcatgttatttgctcgattgtagaattttggagagctttgattgaaaagacttggtgatggggtattttagtcaaaaactagccggtgaaggtaaaacgttgaattcatgtattccacggagatttagaaaggtattgcgtacctgagaataacatttcatcatgcatcacctcctccctacacccactgtatttgtgtaaatcaataaataatgattggatgttagatgtgttgtgtttttatgtttgtgtcatcgtgcgtttgacttttagagattgtaggatgtttgagcaagtaagaagctaactgctgtgaggtccccagattatttcacagtctgtagtttgattcttgtctgtatagattactttgagaagggaaagcaatctcccttctagagtcatttcaggtcattgtttgttttctgccaagtgtcattttctctgttctttaaacctagttcgtgattttcaatccaggcaccgcggtgcagtgtaaagataaattccattccagtgtgacgtgtgtactgatttcataatgtttttatcctgcatgattctgttcaattaggaattgttcaccgatgagaaagtgtggtgataacttagcgttgcttatggaaaacctggttggttttgttcagtgtctctggggtgggggaagattggctggtttgcctacttaaaggcagagttcagtgttgaatcttttaaacctgtctttgcttactactttgtgagtttaaattcctttctaatttcattttttaccttgattgcctatactcggttaggacttttaagtttctgaattgtgctaccacgtaaattactcattacctgcatctttgagctgttttggcaattgaacagaaataaaaggaaacctgtagtaggtgtccttgatgtacagagtagtaaggaccacagtgctgaatgtgacactgtttggtgaattgggtggctttttgggatacagctgtgtttcaagtatgctttttctcagtgcatttcatagaaggacttataaaagctctgagttggttgcaacattcaagtagttacaaaagctgaaacttaattttcttttgaataaaaagcacttgttaaagagataaatttaagtgtaagttccagtgtagataattttaaaccaattttagtcatatggaacacttacttttgtgtggctttaagtttttactttgcctcatgccattgaagctaaaattaatcttcctcttgatgtgtttcacagctcttattgttttctctttgcttttacacactgaaaggttacaattgctaaaatagaaaattttattatataaacagtaaaggaagtataggttgtagatttcatcagacataccagtggtgaagtgttatcaactggtaatggggtattgattaaaaaaggattgaaatagagcagttctacttttctaccctgagggagtatgggaatttgtatttgacgcaagtggtcattgttcaataagtggataacatttaagcatcttggcaggagtgcatagctggagttagcactgttcatggcttgaatagatctccagaccctcaaagtatgtgggtatagttgtgtttgcattgaattaataagttcagacagttttatttatttatttttgagacagagtcttgctttgtcgcccaggctggagtgcagtggtgtaatctcggctcactgcaacctacgccggctggattccagccattctcatgcctcagcctcctgagtagctgggattacaggcgtgtgccaccaggtccaggtaattttttgtaaggcgtgatcagactgggtttcaccatgttgaccaggctggtctcgaactcctggcttcaggtgatccgcctgcctcagcctcccaaagtgctgggattacaggcattgagccaccgcacctggccctgatctggtgaaacctggtctctac

SEQ ID NO: 51994 - DNA, 2964 bp, Homo sapiens
ccaaagtgctgggattacaggtgtgagccaccgcacctggcctcccctgctgttataatgggggcagtctggcagcccgagggccccacagtgaccctggcctctccctgttgccccttcaaaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagtttt

SEQ ID NO: 51995 - DNA, 1014 bp, Homo sapiens
tcctcggaacatgagtactctagatcttaaagcccgctccatcaaaaaggaatgctgtggtccaataaggcaataaggctgggagaggctgtgtcttctcccctctctggaagaatcacggtgcctattattaccatattaaaggctctgaaaagtaccacagcagagacttttccaactttcccgaagctcatcctaagcttattggagcatggagccctgtgtgtggaaggccagtcctgtcttgcagggtgttcacgttaggagcgtggtttggaagcacagctgtggctccccttctcacccagcctgacgcttggaaaattgagtttaatctctggccatcattgttctgcacggggtgcctgttgcatttacctgagaccagtgcgcagaccttactgctgtgatgtgtatctcctcaggccaccgagatcatcctggagattaagaaggcatttgaggaaagcctgagcaccctgaagtggatggatgaggaaacccgaaaatcagccaaggaaaaggtgaggctggccaggcacttggagggggtgctgcggcgtccagcacagatagaggagggtgggggaaggagaggccggtttttttgtttgttttttgaggcagagtttcgttcttgttacccaggctggagtgctatggtgcgatcttggctcaccgcaacctccgcctcccgggttcaagcgattctcccacctcagcctcccgagcagctgggattacaggcgtgcgccaccacgctcggttaattttgtatttttagtagagatggggtttctccatgtgggtcaggttggtctcaaactcccgacctcaggtgatcgacccgccttggcctgccaaagcgctggcattataggcataagccaccgcgcccggtgaggccagttctgtccggcagcacagcctggatgctgtctcgccttcagcgggtgagcggtctaggcctagcaggattcggggtaggcctcaagcacatgattgcttggatgt

SEQ ID NO: 51996 - DNA, 1089 bp, Homo sapiens
gatgagtgtctgtaaattaaatctaggatctgtttctgctttctcaattgatcacgcatgtcccaacggaaagaaatgtttgctgcctctgcaggtggtgaacaagtgctgaataaggcctttcattcattcggttgttcattcaaaaacacgtattgaggccgggcgcagtggctcacgcctataatcctagccctttgggaggccgaggcgggtggatcacctgaggtcaagagttcaagaccagcctggccaacatggtgaaacctcgtgtctactaaaaatacaaaaattagccaggcgtggtgttggatgcctgtaatcctagctactcaggaggctgaggcaggagaattgcttgaatccaggaggcagaggttgcagcgagtcgagattatgccactgcactgggtgacagagcaaaaactctgtctcaaaaaaaaaaaaaaaaaaaaaaagcacgtattaaacagctgctagttgccaaacacagtactagacaatggaaatataaaaacgcataggatattggcctgccctgaagttcacattctagtaggagaaatgaacaaggagatggtcgtgacatagcacagtagcagagcaggcacccaggccgctgaggggcccagagagggaagggggtcgatgaaggtttccgtaggaagagggggccttagatgagggggcctggaaaccatgaggtcatcaaaatgcatgaagcacttcctgggccaggaatatttcatgaagtttctgcaaaccattaaatagttaaataatcaagccattgctccttaagcacctcgtaggtccctagcccaatgtccagcaaagtaggcacttagtgaagaactcaaatttctgagactgctttatttatttatttgagacagagtctcactcttgtcgcccaggctggaatgcagtggcgcgatcttggctcactgcaatctccgcctcccgggttcaaaagattctcctgcctcagcctcccaagtagctgggattacaggtgccccccatcatacctggctaatttttgtatttttagtagagacagagtttcaccatgttggccaggctggt

SEQ ID NO: 51997 - DNA, 1125 bp, Homo sapiens
ggaggggtcactgtgagggcctttcctgcctgctaggggcttcagtttgggggcccccactcccgacctccggggaagggaggggtccccatctcccccgggcctctcgggtcttggggtctccccgggaggccggaggttgggaaccgggcgccggcgaaccgatcaggccccgcccgcgaaggtggtgcaacgcctggcccggcccatcccatcccggccacccgggcagcgggaccaggcgtctggggcacagcatgcggggcgtgtggccgcccccggtgtccgccctgctgtcggcgctgggggtgaggcgggcgcggcctggagggcgggggcgggaggcgggcgggacccctccccgcgcgggccgctccgtgggccggtctcggtctcgggtgtccaggccggggcggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtaggcgccctccgctccctcccgaggtccaggcgccccgggcccgggcatgcgcgctgccgctgccgcgccccccgcccctacctaccccgcctcttcccctcccttcccctccctcgtcccggcatccgggaggggccgcgcctccccgcagctggagctccgcgctgagaagccttccggagcccaccagtctcccctcacctgcccccgccatccctagagcctcccggccacctgcttctggggccacagcccaggtggcagagttgaaagcacccccgagacccgaactggtccagttccctttccacagaaggcacagtttgtgcatgtcccgggacttgcccaggccctttaccggcagagtctacggctgtttctgttttagcgtggaaagccctgcatccctggaacccactcccccagtccggggcaaactgggaaagttggtcaccttatccgggaggcagtaccaccctcttcctcttgccctcccaatacctgagtttcctggggccag

SEQ ID NO: 51998 - DNA, 1045 bp, Homo sapiens
actgaggcacagagaggctgagtcacttgctcagggtcacagagttgggaagttcagactggggatctgaaatgaggtttagatccagagattttacccactacattatagcatctgtgaaatataagtgtttagctaccagataatatgagtgtgttttagatgacatgtaaagattgaacagatcccagccaattaccagcaccaaaagtagtaactgatggggacttcggccacaaagggcagcgtctctaaggagctgaggcttagagacaatgtgaaagtagctgtggagggtgtggctcagtcccaggcctcagaatttcacatgtggggcttcccttttccacctcatcaccccaagatgacttaacaatcccccgcctttggccaaccaaacgcaagagccatatgagtgactaatgtcgtctgggcaaagggggtcatgcccaggtgctaccaggccaggaggcttttgtcgccagaaacctgtgcgtgtttatatttctcgtttctgctcaccacaggcctttgatttacaagggtggagtttccagagctgggcactgttgcaccttcatctggctgtcatcacttcctctgtgcagctggggcaccggggactgaggacggggcagtccacagggagctgtggttccaccccttcactcttggtttctgccaggccctcctcttgaacactagacccagattcaacccagatttctcctccacggctgcacagtgccaggaagggaactgagaagaccaaagtggaggttctttaccttccccaacacactcggggccaggcgtggcacccacaactgcaaatgagacaattagggagaataagtgctggctgccctgtcagcccagagcctcagtctgcccagggcacccagactctgtgaggttcccacctgaagaagcagttccatcttccacaaggagcacaggaccaagagtccaggacccaggttcgaggcccagctctaccactttctcgccgcggggctcgggttctctggaggcagcgtaatgg

SEQ ID NO: 51999 - DNA, 1059 bp, Homo sapiens
ataggagactaaccacatgcccccacgtcactctggtgcctctcagccactccagatggggctcccagagcacagtgcgtacttcaccctgggcagcctgtgcccctgctggtgactgggctactgaggcctccttacattgctacactcttttggtaaacaaggatgttgttaccttttgttaaagaataaatacattgttttccctgcagagttggggaggccaggggaagaacaggatttgaggcatgagagggctacaaggtgggcttggcagaatgttctgggcgttagcccagaaaaccagcttggccaagtccacactttcatgtctacggtgagagaggaaccatgagcaaatgtttacaattttttgtgcttctgctcaatttttttctctccaattgactgggtaagcctcctgccatagtcaaagggcttcattcatttgttcattcactcactcaccaaacaagtctgtctggcacaacacgaggcatgggggccgtggtcagtgtgagtgagactgataggtctctctctcccacagtctgatggacaggcaggcagacagatacagagcaggaaattacaagcgcaattactgttgtcagggagacacgcggggggctgtgggattggaccgggaacctgacctgaggatcagaaaaggctccctgagcacatggcattaaaatcataacctaaagagcgagtgggactgggaagagtgttggggggcggggggtggagggagcagaatgtgcaagagtacagaccgctgtgccttcagggatggttcatctggaggcacggaggactgtgcttaggaggtggcccggagggtgcactcagggatggtcatatgaaggacctggggctcaatccttagggcagtggggagccactcaggagtttattttttaaatttaattaatttacttatttattgagacatagtcttgctctgtcacccaggctgagtgcagtggtgcaatctcagctcactgcagcctcagcctccctggttcaagtgattctcctcagtctcccgagtag

SEQ ID NO: 52000 - DNA, 2773 bp, Homo sapiens
agaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggtcagagcccaggctcgctgagagaggaagggctgggctggggcagcccggaggcagagagaccgagagtgcggggcgggcgagggacgccagggccgcgtcaccccagcccgttcctagctccgctcccggcagggggcgccctggcctcgtggcacgaccggcccgcggggcgcggggctcgggccgggggcggggccggggccgggctggggaggggttggggccgggggcgggggagggggcgggctgcccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagacctgggctgccaaccccaaggcctcgtggcctggcgccctcccaggcgtcccacctgacccggtggggtctaaagcagtttggtttgggaggaggagagggcaggaggcgcttggaatggggggcgtggcgggaggagacagaggacacccgcgtgggtgtcaaagtgtgggcacccactgtgggcaccgcagctgtggggcaaagctctggagcccgcgaagccgaaggagcctgccgccccctttaggctttgcgaggtgggcctcccagggctgcttccctgcccagtcttggtaagaaagggttaaacgcaggtctcagcagaaaggcaggaggccgaggaaagcctcccccactccccattgtgccttatgactctttttcaacacataatggggtcgaaggcggggcctttacaaaggcctctgggtggagggtgaaattccttgagatcaaaagagggggcgattcttgggccaggaagggctttgggccctgggaaaaagtcagaccgctcaggtgggcccagctgcccagggaggcaggggttgggtcccagcctcagtgtagatactgcaactgttttttgaaggcctaccgtgcgtagagggacctgctctgacatctcatgtacatcatttcattttacaaatggggaaactgaggcttagacaatttaagtaagtggtgggaccagggtttgaatccagactccaaactctgcagccctagcgtcctgctcccactgtgttgcctaagagatagggggctgagccttggttttgtcttccggctcctcctgggctcagcccgctcttcctccactctccagtcttgctctttccaactgtttagtcctccccacctgtgggtgtccccacgctgtcctgccccagccatcccactccctggccccatgcatcttgttcctgtgtcacctttttctttctttaactgaatacctgtgaattccctcagaagaggcccctggacacagcttctcaacatcccaactggtgaagactaggctgagtgatgatcccggtccatgtgcccatttgtaaaaaggggtgtattcccctttcgggactattgtgaggaataaaactgaactgaggccagaacaagatgctatcttcattcagcaaatacttaagcatccgccgtgtgccaagctctgttctaggtgccgggaatgccacagtaaatcagccaaaagccctcttctggattggatgtttgcataacaaaattctttcaggctttgaaactgtcagaattcacagtgtagacttgaaatcaagctattcataaggaaggagattaagacgcaatcacctgtaaaatggattggccaacctttggccctcactttagcaaaggcagccttgctgtgggacctgggatcagttctgttccctctctgtgcctcggcctcctcccataagctgtggagatcaatagtgcctaccagtggtgaggtctagatatgatgaatgcttgcgaagggtttaagctggtacctgtgcttaagaaaatcctggctatcctcagctctcttctcagcagaaaatgcaatgcggagactggaagttgggttatgtgcctaccctgcctctgaacctgttacccacttctgcccaggcccttcccatcctgttgggctacacatgtggggtggcatggtgccctctttgctcacactcagatgccaccttctgtcgccatcctaaacacagcctgggctgggagcgcagagctccatgatgagatcagccctggagccatcatctctgcagcgcttcctg

SEQ ID NO: 52001 - DNA, 1010 bp, Homo sapiens
taccatcgttctttctgaattccagtaaccaggagtcaggtttcacaaaaagtcgtagtgttctttcctggctggtgtggactcgccctctctattattattattattattattattactattttgtattcatctgaggccacagagtactggccagagaggagacatagatccccagaatttcagttggaaggcctttagaagctggctcggtcaactgggctcttggtgcaccagggagactgaggcccagagaggagaagaggcttgcccagggtcacacaattgcttagggcagagtggactgggaattcagtctcctggccttaagctacatgatctttccaaaggcaaccactctcctgaatttggtgtgtttcatttctacagtatattcttagcatatctgttttttgaaaatcattgtttaagggaggatgcagatgatgtgggttggtggaaaaagatattaagctcaggagagctgagctgaagtccttgaatacctctgtgaccttgggcaagtcacttcccctgtctgagtctcagattcttcatctgtaaaccaatatatctgaggagtaggagtggagagatgagacttccctaagacttggaatgggtctaatgtattcaactggtcctcagatatttatagcctgctgtgtgctgggttatgggagatccatcacaaactgccttcctaaggctgcagggggtgggggattgttgacttttgcggtgattaaacaacttttatttagttgctggtgtttttaaaccaggcaatttcattttatataaagataaggatttctggcttctcttgaaagatcagaagatgtggccatatggggctatgtccctgcctggccacagtggctggagctgattagcagctgctccatccactttaccacagtctccaccacgccccactgcctcacacttgcccacctgcctccctgacattacctacctaccttctgagcttgcggtttctgggctag

SEQ ID NO: 52002 - DNA, 1050 bp, Homo sapiens
ataagtagaaaatggttataacacctaacctgtcaaacatggtagcttagcctgacttaccctaaatgtgttcagaacagttacattagcctatagttgggcaaatcatctaacacgaggcctatttcataataaagtgttgactatctcatgtcaatttcttggctatactgtattgaatgtgaaaaacagaatggctggttgggtactcgaggtgtggtttccactgaacactgtagcttttgcatcatcgtaaagaaaaaaatcttaagtgtaagttggggacagtctgtaatgaacatttaagggcttactctgtgtcagaaactgagctaatcactttgaatgaccttattgtattgagctcataattctttccattttgcaaacaaggaaacggaagctcagagagattgagtaatgttctcaaagtttggaaagtgcaggtgagactcaaatccagggttgcccaatcagattggcatctggattcaaatttgcatgtttggagaagagctctcagggcaccttgtggtacacatttgtttttcagtgagtgtttgcaaatgacatgggggtgggaggccccagggggaggagacagaacatagacacacctggtggggcaccagcgtctgttctcccagacagtgtttcttagcctgttcaccccctcataggaaatgacaagcctagaaggaagcatcctgagaaacccagaggggcctgggtttgaatcccagccctgccatttcaagctgtgtgaccttcgccaagtccctttccctctcttagcttctggctaccctccctaccacgcatggtttatttgaatgaggcaaggccttaggatttttcgatttgtggatggcgaatagccagcatgtctccttcctctctcctgccctgcacccacatcagacatcactagtcaaccactgcttgctttccttcccagattccttctaagtacagtgctccagacagccattagcaactaatatagagttggcacacaagataaaaggacatcccagaaccagattagat

SEQ ID NO: 52003 - DNA, 1028 bp, Homo sapiens
ctggtttgtgtgagaactttgttctgaaatttcccttttcaacaaccaaatccctgggctggcctgcctgccccacttccccctcttggaggaaacggatgctttcctcttgggcggccacatgatttgaataatcaagtgtttcccagctggcctctggccaaacggagctcagctgggcaaggcccccagttggggcactgaggcaagcctgccaacctcctcatcccgccacacgctccagccaccgagggtaaaatacaggaaaaatgcatggcccatagacttggctgggccaggccccagactattcctgtgatggaggcagcgcttgtcttgggctttgtcccatctacctggagaaagctgagtggaggaagaaaaaggctgcccctgctcaggaaattcctgatggagcggcctctcctggcgtgctcacctgggtgctggcgtcttggcacttgtcagggtggagagaggaggaagccagtcaagaaggggaaagacgggtgcgggaggacattcactgattcaacaaacatctcattagcccaactgcctgtgaggcccagggttaggtgctggaatcacagatggatctgccctggattttgccttcaaagagtgtgtgtaggctgggctccgcggctcacgcctgtagtcccagcactttgggaggccaaggccagtggatcacctgaggtcaggagttcgagaccagcctgaccaacatggtgaaacctcgtctctactaaaaatacaaaaattagccgggcatggtggcgcgtgcctgtaatcccagctactccggaggctgaggcaggagaattgcttgaacctgggaggcagaggtggcagtgagccaagatggcaccattgcactccagcctgggcaacaagagcaaaactctgtctcaaacaaacgaacaaaaagagtgtgtacagaaatggtcttgtaagcagactcccccacagagccctaggtggtagaggatgagggaaagcatgagaggccacctagctaagcc

SEQ ID NO: 52004 - DNA, 1005 bp, Homo sapiens
cgaacgtggtgctgtgcgccggtggtcccagctacttggtctcttgctgaggcaagaggatcgtttgagctcgggaggttgaggctgcagtgagctatgatcgtgtcactgcacttcagcctgaatgacagagcaagaccctgtctcaaaaaaaaaagaaaggagagtgaagctggatgggccaaatactggggcttctgaagaagtcaagaccttcaggcagacaggaagctcatgacacttagctttctcgttttctttagctttttaaaccactctgactgctcctgagtggaacaaactctcaaagaaatgatagcctcagcccactccactccaatgactaggagaaaaagcagtagcactgggcccaggcagatctggagacatggcttggccctgcccctgtttagcagagggacctagggcaagtcacttcaccttgctgagtctctactttctcctctgaaatgggtgtagtggtattctccctccgaggccttttgtgtaaaacctactagaaaggtgaattataaccagtcattaccaaactgaagggcctggaaggcagagcttgtacctgcaagtcctgtcacagggctggcacacaatagatgcatggaacctggtggtcaaagggttgtaaacttcaatggacaacaacctgtcagaaagtgaggatctgagtcctgcagggctattagacaagtccagccccaaaactttctgtaattctagaagtttatagattccaagtagaaagtgacttgtaggaagttggactcttacattaccacatacttgaaacttgtcagctttagcttgtttgcaagatttttcctctggcagaaacagctggcagaatatgaatgacctgatttggttgctcacaatctaaagcgctgagaaaaactggctgagctgcagttctgaggtcagactctgtgttccaagtaacagaaaagccaagacgcacaatggggaaattaattggctcatgtagcc

SEQ ID NO: 52005 - DNA, 1034 bp, Homo sapiens
tggccaatgccctgtcttgaggatgagttgaaggaggggattatgggtgggggtggccagggtgcgcccacctggccgggggcagagccaggtcttgaatgccaggtcttgaatctgggatcctcccctccctgccactgcaagccccaagtgagttgcactgcagggctggctacaagataccgtgcaaagatcagaagagacttggaccctagatgtgacattctcttgctgtgtgacctctggcaagtcacctcacctctcctgtaaagttatgattataggaagccctcccactgggaaccgtggtgcagatacaatgaaataacatttgggaacagagtgtagtgagtgtgaatcaaatagcagctgcacgcaatcccttcatctgcaaaagtataatgtgtctgtgtaatgtacatattgcagagagggcaaatggtggtttgtttccagtcttgcctcctgtttgaggagtttatgcttagtcctgggagacagaaacatccccaagtaaggctgaattctggctcgctcacttactggctgtgtgaccttgggcatgctccttaatctctctgtgcttctgttttgtcatctgtaaaatggggataataatagtgcttaccttgaaggttgttgtggggatcaagtgagttaatataggtaaagtgtttagaacaatgcctggcacataataaggtctatgaaaaggtttgttattattaatcttatgaatacgatgacaaaatatgtaaaataggatttttctaaaatagtctcagtttgaaatattttcatcagttgccgcaaatcactaatgtacggaagtccaagacattggcatccaagctgcgccttgaacactgccttgcctttccagtaattgccccccaaatcctcagctggttagtggggagacctatccctgcccctgatgtgctgtgtgacactggggaggttgtgtaccctctctgtgtcttccttttctttttccttttttttttttttttgagatggagtctcactctgtc

SEQ ID NO: 52006 - DNA, 1504 bp, Homo sapiens
aggctgtgtgcctgcaaagcagccatgctccgcccccgacccctgcctgggcactgcaggccccaggcatggtgtctctgggccctgctatctccctcccctgcgatctccctactgcgcctccctgctgcttctctcctgccactagtcctctggcttcagtcctctgcccacagagttggtttggggcatcatgaccgtcctggagcctcagggacccccagagaagctttggcttctctgaacccagaccctcagggtttctgattccagctctgctgtgtggccttgagtaagtgacagtcagagcctcaccctcctcacctgtaaaatggagctggcaatggggcatgtagtgagatgaggcatgcagagggcctgctctccaccaggccgtgcttggggagcagagccctttgtggtgggtccaggctgcccctctgtcctgaatgcaagccgcctgctcgtgcctttctccctgaaccccaaactccacacattcctgcctccttgcctttaaacactcaggtcctgttgggagtgtcctctctctctctctgctcatctcaaccccatcatccttccagcctggtgctcgacccacccccacggacacttctggcccataccctgtcctagactttctctctctccccttcaagatggaaaggaagtgtcaggctacctggcaggttactcctttcttcccaagtgagtgtgtgagggagagagagatctggttctctttggagatgggagccctttgactgtaagaataggacctctgccgcttaagaacaggccctttgaagggaaagtactcagcaggcaggtgagcttctgggttctagagtctcagagctggaaggactgtctgcagccatccaggtgaacaggtctctgggaaatcccaaagcatatggtggcttgatcgagtgggcggggaagggtccatccgttctctgctccagcccctcatctgccccacttgcccatctctgccccgcagtccatccacctcatttgctccccctccccataaccctagctcctgactgacattcactcagcacctaccacatcccagcctccgttttacacccttgtgtgtatgaaggcatccttacaacaacgcagtggcttctattaggtgtggaggggtgaggtcacctgctctgagctgcccagctggtgaggggcagaggcaggatcagaatccaggcagcctggctccagcatccatcttcactgctgctgagctgtctcttcagccacccaccctctgaccccatcatccttccacctagcgacattccctggccacccggcctgtgccggcctctgccagccacggggctgctgccatcagcagagcaggattccagctccctaggagctcaccacggtgagagggtgacaacctatgattctctaaggctctgattaatttcaccaagggcttcatggcactgggtgctgggagcttggggaggagccgaaactg

SEQ ID NO: 52007 - DNA, 1040 bp, Homo sapiens
gcagggcgtggtggctgctcccaggggccctctttgccccaagatggccctcctgtcccccatcctggatgtggtcctcacggtggccctcagcctcctcctcctggggctgatcctgggcctcctttgtttcttcacttgccgcctggccaggccgctcaggtaggggaactcagctggcctgactccccctgcatcccgccaaattccctgccctaagctcgttcagcttccatttgttctcgtgagatggagcaagcggggcactcatttctcttactcttcatggtggggaaaccaaggcccggagaggttgagccctggcgtcagcctgggcttaaatggcgcatagtcgaagactagccaaaccctctgttgggtttcctaagctacaaaacgggggctcttcatccatattgtgagatcagggatgtaaacagcatggggctgagtggaacatgagggcctaagaaatggtagtgacacgtttgtcccattcttctatcatttgccccagatcttctgagacccagcccaaggctggctttttgccccactccaggatgctcccgggccctctgcctgggttgctgaatcagtcctcagagctaaggcctgcctggctcctcagccccctgcactgaactgccaagtagctgctcctctggcgccacagcctagccggggcttctgcactggccatgcgtaatcaggctacggaggagccgggagcctggcagagaagggagggagggggtggcgatggggctgacacacacccggaggccccattttaagctggcagacattggcagagggtggtgggcagccggggcccccacagccccaaactgggcccctccgcttccagggctgccacagagcagccaggagcctctgcgagggggaggggtcctaggggtggggccagcagggaggctctgggttctgaaggctttcccaggtccccaccctctccttgtcctgagcggaggctatgggagaaggcacctgcctccaggccaagcctatctcaatgc

SEQ ID NO: 52008 - DNA, 1121 bp, Homo sapiens
ttgctctccttacagtttgagaaacactgcaccaaaagattggactctgggaggtagggggcttcagatgaattgaaagtggaaattcacttaggaaatgggacggaactgctttgcagcatggaactcattgacactgacacagctgtttgtgtggttaagcttcctgagacagggaccagctgggtttggcatcccaatgttgagccccatgcctggtctgtaataggtgctcaccgaatacttgttgaatgaatcaaggaatgaataagtgagtgaaaaaggatctctagagctgtgccccacatgcctctttttctctttttttaatttctaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccaggtatgcttggggacacaggtggaggcataaaaaggtggtgcagatggggtatgatgagggcagtgtctatgttttaaggtcccagaaccatccaaagtatttaagagctgaaaacagtgttcagagcaggaaacctcagccctgctacttgcatgtgttagttggataggtcactcttttcccatatatatatatatacacacatacacatatatgaaatatatatatacaaggaaaatatatatatacaaggaaatatatattttccacatatatatttttccatatatatatttcatatatatatttttccatatatatatttcatatatattatatatattctttcttaatttttttttttttgagacagggtttcgctctgttgcccaagctagagtgcagtggcgccatcttggctcactgcaagctctgcctcctgggttcacgccattctcctgcctcagcctcccaagtagctgggactacaggtgcccgccaccgcgccaggctaattttttgtatttttagtagagatggggtttcaccgtgttagccaggatggtctcgatctcctgacctcatgatccgcctgcctcggcctcccaaagtgctggga

SEQ ID NO: 52009 - DNA, 1054 bp, Homo sapiens
cccagaagctttagtcaggggccaaggccaaaacacaggtgacaaggccaacatacaggtgacagagccacagtccacttgagatccctcaggggtcctgtgggcgccttgatgaaggggaggactccagcccaggtgctcacatctcaagggccttcggggtgaggggagagggttccagaggcagtgttctggctgctcggctacttggaagccactgccagacacctgctgctgtggatggggagactgagacccgggcaatcctcagaactgaagcgggggcctgtctttagcggggagggggaagggagggaggaggcctctgggacaccccgatctgtggataaagccaaacccgcccctcctgcaccccagggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgagtgctcgggggcagccgggcagggacggggtgaggcggggcctctggtgggcaggaggcctcaggcccaggctggcccggagaaagcagcctggcctggctccccacacacctgggaggctcccagcccattaggggatttgcggttgggcaggcaggcactgtgggatttctctgcggtggggctgcggggtgaaccctcatgtgaccgccaccacaccccaagaaccaggcatccagggatgattccataaattgaaacctggtgctgtgccctcctctgccccccactacacgggaggtggtgatggccaagtgtcgtctgcctgccctgcgtattcacatggtcacagatgggtacatatctgtacactcaaccaccagcatgcccggcaaagagctggtgtgtacagtggttggctagtgccagctctcgtgtttaaacttccgagttccagaccttgccctgcgtgttgctagctgtgtgaccttgggtc

SEQ ID NO: 52010 - DNA, 1144 bp, Homo sapiens
agtgccacagccggaaaagccctgggtttgaatcctgatgctgccacttcctggctctgtggccttcgggggaaaaaaccaatttctgtgcccatttttttagttggaaaacaggtggccagggtttattgcagccttggtatgaagttgagtcagaatgtatcttaaatgcttagtgcctgacacacagggaacgctctgtaaatggtctgattcttattcgagtgggagttctgtggattccgggaagccaagtaaggtaagttatcagctcctccaatatccctagaagcgccaaaccaccgtcccaatagactcgtgatttcatctccccacgctggacaagtaaggcccagagatgactgaggcctggctcaccaggctgggaaagtgtccacaccatctccagggactccaggagtccaggttccaagccgaggtcactggggcttctgggcatcttggaaccctgcagaagtgatggctcctgtctcttttaggtgatcatggggggtggccggaaatacatgtaccccaagaataaaactgatgtggagtatgagagtgacgagaaagccaggggcacgaggctggacggcctggacctcgttgacacctggaagagcttcaaaccgagatacaaggtagcctgtgctggggccatgtggctgcagaggtggcctgtgatggggagaggctgtgtgacccctgctctgaagttctgttgtcctctgtagaaagggcatcggaaatctttcctccatgggctcaaatggcctaagagatatacaagcagtagatagtcagtgactaatcatttccttcccttggaggggataccagagagaggcggatggtgaggaggaggctgggccagggaataacctgcgtggacattgagtcaccctgagcacctattgtatgtaggcacctggcggggcatgcgtgaggcacagaggctgagtcagatggccaaggaaacatggaatgctgtgtgcctgcatgggggacgcctggctctgcaggcgccctggggggacagatgacagggaggagccaagaagctctgggcaagtaggaggatggagggaggaggcagcgctggatggatcaggggaggacatggttggccccagtgtgcaag

SEQ ID NO: 52011 - DNA, 1071 bp, Homo sapiens
acagccacgcctttatctcccctcccagatggggtccccaaagcagagctggggctttgcttcctccctggccctccacggcctccagaaaacagcccacacctgtcagcactcaaggcccctggagacctgtgcctggctcttctttgccccatgatccctcctccctggaatagccttcctgaccctaggctgttcaattcccacttgtcctccagggacccattagaacatcacctccaccaggaagccctccctggtcctgtgtctgggctcacggcctccctgggctctatcagaattctcatccccttgcattatacattataatgggctattgattcatcatttcttgaggtcagggatggtgggtcctcagggagagatttttaagtgagggaaggaaacaagtaaaggcctcagactctgatagctgctggggtcagtccttccgactctccctagcccccggcatgtgctgacacagcccttcctcctagcactcccacttcatctggaaccgcacggaactcctgacccttgacccccacaatgtggactacctattgggtaagtggagggggtggaggggaggatgcatggctcggagcctggtggccggagctgcgtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgtggcacaagtgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtgagggcccaggggcagcttcaggtctggtgggatgcagccctgag

SEQ ID NO: 52012 - DNA, 3296 bp, Homo sapiens
agagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtaggtgggccttctttggggtggacactcctggggtctcctgtctacccacctgggagcaggagtgggtgggagagccagcaagcccagagcatggtggggactcaatgacaactgggtggggaggaagagttactggggatggggagaaaatgcagggtgaggcaggggagtgagttgagtggtggtcgggtagacaggcaggtgggtggatggatggccacgttgaccatggctgggcgagaacgtggatagatgaatgagagaggatggctggctggatgatggatggatgatggatggatggatggatggatggatggatggatgatggatggatggatgggtggatggatggatgggtggatggatggatggatgggtggatggatgaatgggagggacatgggtacaatgaaaactggggaatggttagttggaaataataaggtttagaaggtggcttcttggaggcattgcagggcccttcaaagaagatcccaggggttaccaagccaccaaggagcctaatctgggggctggggactgtactcctggggccccagcatgacccctgaacaccccctccctgtgcaggtctggcccccatgctgagtgacacagacaagaagcccttcactgccatcctgtatggcaatgggcctggctacaaggtggtgggcggtgaacgagagaatgtctccatggtggactatggtgagacctccaggacccagggctgggaggggacagggcacccctcggggatgggcttgggaatagggtgtcagcttgtggtcaaggtcaggggtctcagaatgactggggcttgagtcccagtttgattgttgagtcccaggttgtttgattcaaacaacctcagtttgaatcgccttctacaatctagcagctctgagactttgggcatgtgacttcatctttctctgcttcagtttcctctctaaaagggttctacctttgacggttgtctgaatgaccaaatgggtctgatgagcttagcatagtgcctggcacaagtaggtgctcaatattttatactcatttttcttggccctataatattccagtatacgagactttgcagttagttcatcccatcccatatcattcattcgttcttgatactcccagtggttctagggggtctaaagatgcagcaatggtaagagtctccccgtcaactctccctgctaatccaagcagcccaaatgaggttaattttctctgttgggggttgagaatgcagactcctgtgtcagaacaggctcaggttcaaatcccgtggccttaggcaaaatgactttcccacattgagcctccttttcctcttctgtgaaatgggagcattcaagccagcctggaagggagatggaaaagctgcgtgcgcagcgccaggcccctggcaggctctcagcaggtgtttcccctggcccacagctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggacagagctgagtctttgtggtcagtgagaaaaagactgaaagaagcttatttctctgggaagaactggcctcagggcccggggtacaggtgggttggacagggtggaaaggccttctgctgtcctgggggcttcacactccctacctgtgccactttggacacataggtttgtgtctcagttttcttgtctgtgaaatgggagacaacccccttctg

SEQ ID NO: 52013 - DNA, 1970 bp, Homo sapiens
ctagccagtgccaagggcataggctaacctccctccctctttccaccccctccccaggagagcgtgtcatcctcaggaacaccccacaagcgggactccttcatctatagcacgtggctggaggacagtgtcagcaccactagtgggggcagctccccaggtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccagtgaggtggctccctcctgcccccctccccaggcccctctcgatcaccccacccagacgccggcaagttgggggaccctgcgtgtcccgagatcaagatccagctggaagcatctgagcagcacatgccccagctggtacgtgcagcctcctggggctggtgctgagggagccccacccgggaggggatgagctggcggggaggctgggagctgaggctcgaccaagaggtccccctaggccccgctaggccaggaggggtggggcttgcccggcctggacacagccagtgactttgtgcacctgtgtctcccgccccgttgcttctcccgtcttgccacctgcctcaccaccactgtctgtctgcagggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggtgggcccctcccagggtggggttctctgaggcagggacttggcagagttggggcacactggtgccagccacccaccatgccatgtttcatggtgtctccatccccctttgccctgcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggacc

SEQ ID NO: 52014 - DNA, 1188 bp, Homo sapiens
agtggtgaaccgtccttcccctcccctgcctgggcccgggacagcacaggagccttgactgtgccacagcagggtgtcagggggacctgggcattctctggggccctcctttgacatatacccagcgagcactttgtgcacgcccagccccgcgcccggctctggagcacagaggtgccctgcgcataggtccccgcctcacggccgcaggtccatcagaacgcggcctcataggctgttgccggatcatggtgataggaggaacccgaagcagggttggggggatgaagagggactgggggcagaggtgttttagatgggtcctcggggagacacctccatggggtgacatttgaattgggaactgaaccagccctgctaggactggcatggcagaggagctcggccagtgcagaggcctggggcacactccagggacagaaagaagggtggctgggagtggtgacgtatgcctggagtccacctacctgggaggctgaagcaggaggatgattttagcccaggagttggaggctgcagtgagctatgatcatgcctgtgaatagccactgcactctagcctggacatcatagcaagactccattgcttaaaaaaaaaaaaaagagtatctgaggggctgggcctggacagacattgtgacattgtgctgggtggtggcgggaaggaggttggagaggtgggcagacactggcttatagcttagcaggctgtacaagagctttgactttttttttttttttgagacagagtcttgctctgtctcccaggctggagtgcagtggcacaatctcggctcactgcaagctccacctcccgggttcacgccattctcctgcctcagccccccaagtagctgggactacaggtgcccgccaccatgcccatctaatttttgtatttttagtagatacggggtttcaccgtgttagccaggatggtcttgatctcccgatctcgtgatccgcccgcctcagcctcccaaagtgctgggattacaggcgtgagccactgcgcccagcctaagagctttgacttttatcctaagtgtgacagggaaccttgggaggattttaattacgagggcgatgctttaagaagctgacttcggttgctgtacaaagaggctggagtggggtgggatggaagcagagaggccagtgaggaaa

SEQ ID NO: 52015 - DNA, 1011 bp, Homo sapiens
tgacctaccgcttcttgatctgcatgtggcacgttaggtgacgtgctggccctggtgcccgacacgcagcagggacttgaccacacagctgtcactagtggggatggagaggcagaggggcgggcactcccttctgcctgccttgctttgccaccgaatggggctcagggatggggatgcaggggaatggggcactgtcccccactcacccacctcttctcctgcacctcctgtatgttctcgatgccaatggcgctgctgcggcgggagccgaacgggcccgacttcttcctcgtggggctcttcccagggacaatcagtgactgtggggagaggccccaactcagtgccaccttacctgggagccccagtgccccccccacatcccctctggggatcctgctgccccaggccctgaagcagagttgatgagcaagaaagaacgagagaagatatccattcccagagacagcctcccagtttacgaaagggaaacagtccccaggagggcaaggggctctcccgagctcacacggcaggactgcacgtcaatactggcccaggattaggacagcatcctgagggggctagggtgggaggaggccgagtcctcagaatggctaccgctccccgccccccagggctctgtgggatctgcagcctaagggcagtggtcagagggcagtgtagcaacccaagtcccaccccgtgccagctagggcccctccccggaacctccaaattggctgggggaggttctggcccagcagctggaagactcccccagcttcccacacactgtgctgggatgccccaggccccagaagcccgcccccagcttctctggaggcaggaaggggtaggaccccaggtcacttcgtggcggggaggaggagtcagggcagaggagagggatggcgctccatgcagaccggcgatattgggggacgtgcggctgggtgtagggcctttgggtaccggatcctggcagggactgggccagggtcccag

SEQ ID NO: 52016 - DNA, 1073 bp, Homo sapiens
ccatccatccacccacccatccacccatccatccatccatccatccatccatccatccatccatccatctctatccatccctctatctccatccatccatccacccacccaccgatccatccatccatccatccatcctttattgactgtctactgcatgccaagccctgcgctcagtgctgtgaggctatgtcacgtggcaggagggaattccccgacctctgctgtccagcagtcaccaagcacactgtcatgcgaggagcaggcccaacctcccccaacccagttttatcaaccactcccttcctctccaccagagtgacccagcctcctgtgggtggccgagaggggccccagggacaggaccaggccagcagcacccaccatggcagtaaccggacccatttctgttttgtttttgcacaactctccctctctctgtgtttcctcctttcattctactctctctccttgtttttttgttccctcctcccttccctttccccgtcctgtggcctctctgccctttggctctctgtttctccttccttcttgcacctgtcttttttgctccctctcctccttcccttctccgctcttctcaccctcgctttttcctttcggccttcccctggcttccttctctgtctctgaccctccctgggcctgtgtctgtgtccttgcgtccctgtctctctggatttccctctgtgcccatctggtgtgccctcgctggctcacgcgtgtccctgtctccgggtaactgtctgtccatctctcccccgtctcccttgtcctctgtctctccttgtgcttctcgccttcctttccccggccctatctctcccattgcctcctgcaccgttctcttcctttttctgtctgtcttcctcctttccctgcctctcctcctctctgtgtctccctcccaccatctctcttgctctctgactctctctctgtctctctctctctgcccccgccctctgctgcttgccagtcattgcttattcctgggaaaagtgcgagtagattcggacgccggggcagtgccataggcataggaaccgtgg

SEQ ID NO: 52017 - DNA, 1076 bp, Homo sapiens
cctgactccaactctctctgttgccctgctgcccacatgcccatcctaggctctggatttggtctagccactactttccatgggaggggggtgaagtgcccaggccaggacactgcggtgctgacagcttgcagcctgcagccccttcccaagctccttggccctcccctcctcctggccctttatgcattgaggtgtgacttcctgcaggtcagccctgggacagcctctgtgtctcattccttattgagtatctatctgtttgctggggactgggctgctgtgtgggcacctactgtcaagccttgggtttctgggagcacctactgtgtgtcgggctgtgggcacccactgtgtgtcaggccctgggctgctgtgtggacatgcactctgtgagcatctactgtgggcctggccctgagtacctgtgagcacccactgtgtgtcaggtcctgggctgctgtgtgggcatcaactctgtgagcgcctactgtgtgcgcagccctgggctgctgtgtgagaacctactgtgtgtcagaaaatggactgctatgtgagcacatcgtgtgtgataagccctagatgtcagtgaacacctactgtgtgtcaggaagtgagctgttgtgtgggtactttctctgtgagcacctcctactgtgtgtccgcagcagccagggcctctgtggtgtggctgcctattgtgtgtcgggaatctggcttctgtgtgagcatctccagagggagcacctcctgtgtgatcactgactgttgtccaggttctgggattctgctgctcacactcaggagtgctgggcacatggatgaatacggcctatggctgtgggcctcactgctgtccactgcctagtggccaccccaggacactgcacccactgctgtgctccccacccatccatccagccacccatccatccacccacccatccatccatccacccacccatccacccatctagctatccacccacccacccatccacccacctacccatctacccatccacccacccacccactcatccatccacccacccatccacccacccatccaccca

SEQ ID NO: 52018 - DNA, 1115 bp, Homo sapiens
gcatgcaggtccgaatatggtccagactcgatgagcacccagagatccagcgttactacccaccttcactgaactgagccaagcacttcatccctttcagtcctggctgccaccaaagtacagggttccctcctatttggcagactaggaaagtgaggcacagagcggccaagtgacctcctcaggctgcccagctggtcagtggcagagtggggctttgagtgcaggtctgtctgatgtggggtctgctatcagccgtgacacctgctatcggcgaaggacctgcatctgggagtgggttggctttctggccttgtttccaaaagccccatgctcagcctcacccactcccctggcccccacctcccactgcaggagcatttcaattactactcactggacgctgccctcggccaccttgtcttctcactcaagtacgatgtcatcggggaccaagagcacctgcggctgctgctcaggtgagggtggtgggggagtcctgagatggcaggaagggctgaggtcttacaatctcagagcccatctcatttgacccactctcttcatcaaggcccatagaggggcagggatttgcttgaggttgcacagcaagttagtacccgagtcagcctgacacccatcatcacctctggtcctcgctgtggtccacccccttctggccttactttgtggggggtggggttcccattttcctgtcctgctgcccaggccttcatcgtgtgactttctcttctcaggaccaagtgccggacataccatgatgtcatccccatctcctgcctcaccgagttccctaatgttgtccagatggcaaaggtgaggtctccgctccgctgagcttcccgggctggctccgcagatgggcacctgtggggcttcagcttgccttggcgcgtccccttcagctgtaggccctagccctggcctgccgccctatcctgaggctgtctctcacttgttcccatcgtgtcttgggctgccacgtgttctcctaggcccccgtcccctgcctgtgtgcttttggttttctctatagcaccttcagatctcaggggacctccgttccctgagcaacagtgaaccccgagtcctgc

SEQ ID NO: 52019 - DNA, 1060 bp, Homo sapiens
gcgccggcggcccccggcagctggaccgcggcccgctggggcgcggacgtatccgagctggggcgggggcgggggcggggcggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtataggtatgtgggagtaggggcaggcaggtcagggggaggttctgctggacctcccactttgcctctgcagctgttgggcccctcagtgacgctctggataaagggactctagaagcccttagcaggtcctgcccaccctgggcaccaggctgccctccttcctgcatcctggctctcaggaacctcctcctccctgggccactggctgcctgggcttggaggcctggaggaggtcagagtggcagcaggttcatcttggggtcaaggggtgcagaggtgggatggggatttatgcctgttgcggagatttggcaaattggagggacgatgggttagacagagtgggctcagagcccctgcccagccagacaagcggctccatgaccttcaccaggccctacctcccagtggtcatagggacccatgggacccaccttggggtgtggagcgctggggcttgtgtgtgggcat

SEQ ID NO: 52020 - DNA, 1082 bp, Homo sapiens
gatgaggttctgagattcccagtgatgcctgcctcctccctgtcacgggaacaccacgcccttcagtggcgtggtctggaagagacagactggtgggcagagctgtttccaagagacttctctgcccaccatgcacatgggggctatgctgccccagaaaatcagattgagaagggcccttggaggggcctcattattcagagaagaaaactggggagctgcccacagtcacattgtgagccattggtggcactaggcttagaacacagatttcctggctcagctcacagctgtccttgcacgtgtccagtaatagtactaaagacagtctccatttattgtgtgcctactatgtgccaggggtgagcagtttacactgaatcctaagaacaatcctatgcggtaagtacttttattatcattgccatcctcttttacagatgaagaagctgaggctttgagaggttatgaaaatggaccaaagtcacaagccaggaagtggcagagcaggaatttaagcacaggtccatgtgattccaaacccatactgatgccaggccttatgtatattatgataggactaaagttgactttctgtttctttatgttcatagtcaacgtaggccatcattcattcattgaacatttatggagtgctcactaaaacaaggagactatagagctgatcagggttgagggtcagagattaggtcatgaggcagggagtctcagacactgctaagctctctgcctccaccaagaatggctgcgtctccctcctttttttttttttttggagacagagtcttgctctgttgcccagactggagtgcagtggtgcgatctcagctcagtgcaacctcggcctcctggattcaagcgattcttgtgcctcagcctgctgagtagccaggactacaggcatgcaccactacgcccagctaatttttgtatttttactagagatggggttttgccatattggccaggctgttctcgaactcctgacctcaggcgatccacctgcctcagtctctcaaagtgctgggattattacaagcatgagccaccgcgccccagcc

SEQ ID NO: 52021 - DNA, 1074 bp, Homo sapiens
tggcagcctcccacccagacgggggccgctggcccttccctgatgcgtgtgccctggcgccgactgccactcttcatcctgccttgctgtggttagagtggaactgtcctctgctccaagccgcccctgaagcccaccctccttgccggcctttcctagaccttacctgtggctctgtggacagcacaccttgaggacttgctgctttggggttttcttcccctacttgctctggtgggcagttcctatctcagtttttctcccatttgatctgactgggaaggagtgggcgggcagagatggggagttatttccaagaggcatcattcccattttaggactgttcccccctccctcacctgcagtctcatgcattatttggagtttaccgtggtgccacccatgttttcgttctccagcctttttggatgccagatttttaaagccagctttcatttctcagtgatagggagcacagagatggtggctgggtcgcaatgtattaagtgtctgagacaaggcttgtgcccagaggcagccatgcgtgagtggtcagtcctgagtggtttggattgaaataggacagggaaagcaaagctccggggcctttgtccaatcttccccctcagtagctaggctgcatgccaagctctgtgcccagccccctacggcacgtgctgcctcctcgccaggggccctgacagtctcagaatggtgccccccaggacacatgggagattataagcctcttgcattgagggaggttttctgtaaaggggaaaatgctgtaattgaaaagctccttgattataaagaagaaatagagacgcctggcatagaagagacttcgttctttggtctgctcagccagggtcggggacattcagtacccccaggctaataggctcttgagctcttaaggaccttggagtctgcaggtccagactccagaaggttatgggaccatgaagaggtcacacagctgtaccccttggcttgctgcatttctgcatctccagtgcctccatctgccccctccctccagctcaggtgggacacctttgtctccactca

SEQ ID NO: 52022 - DNA, 1045 bp, Homo sapiens
agttgtagaagttgggccacctgtgttacagataatttcaccatttaccttgtaaccaagaaaagtgacttaatcttgctttaccttaatttcttcatctctcaaaatagcagtatttgctatttttgtttactacactcagaggattaaacagtaataaatattgttgaggtaaaaggctttgtatttttctttgcatttagaagaactgttgcctttctgaggaaatgctgttggaatctcttttgcaagtcttcaaaaagaggccttgtaaccacctagcaaagctacctggagcatcttctctgagaactttagaaactaccttttacttcaagcccttccaactaaaatgataactagacaggtgttcgaccatcctgtcacataaatcttttctcctggcccataagaataatgaagccaatggccaaactgcaagccttctcaattcggtgttttttttgcagggtcatgtcgaaaggtatttgaaacacgcttagaatgcatgttgaagatttatgtctccgtgatgggcagtttctgccccaaaggggcagcttcagttgttttgattgtcattgctaagaacatcaggaacagatgtctcgagctgccgaggcatggctctgcgggcactgggaagcaaagccatgcggaggcctgtggctggtgctcagaggtcacttcctggtctgagaattgcgtttttcattatttacctggtgatacttagtgaataatatcgttcaagggtagagtacacgaaacaggtatttcttacgtctcccctcccccaacaaatgacagaaccagttatcaaataaatacaagatactaaccatgtgagatttctgcatgtggtaaggtttaatatctctttgagcctcactagattttaggaaggaggaggttgcagaattgtggcttgccaggagttgtatgacctcttcaaagtgacattagtttaactttgttttattttattttaatttttgagactgagtcttgttctctcacccaggctggagtacagtggcacaat

SEQ ID NO: 52023 - DNA, 1085 bp, Homo sapiens
cttcctcctgctctgacaacttgccttgttctgccagcactgctgaaagtaactgcagcccagcggctccagtgacactgtgaagctttattaccaaggcaggagctcaggccctagacccgctgaatcggaatctgcatccacaggccactcctgtactctttgaaaccctgggcttggggcctctcccacccatagtaggcagagttgcaaagaaacgtatgcttgtattgaatggttttgcattgccacccttctcacttggtacagggaaaaacaggtaaagggtatgacctaaagcccgattctcgtttcgtctgtaattatgaatagatggagtccatttgccttctggactgtgaaaagttcagagactctttgtgttggggttctaatgccatgcatgtgtacttttttatattagatcagtctccggtataaggtattatgaagcttgggtcttttccccttgatatttctgaccattctttaatctgaaacgaatgtgttcagcatactacactggtacagattgtcaccacgaactgaaatataggctgcatttgggtgtcttcatttcctggggagtaagtatctttctgtgtatttatgaactctattgtttagaattactgttaccttcctgccaaatttaaaagatatgagtgtccctttatttctgtgggagcataatccatagtgaattttttggttattttaaatgtgcttttggttggtctatgtggtcatagatctgttcatcagactctggttaatattggaatctaatgctcaggttgaataacctgttttaaaaacccaagggatgatttatctctgtctaaacaaaccgctgaagcgaaatgagcaagaaagcctgtctttcctgttaccgaatcatggggcagaatcatatcctttctcttgggtactttagtcctcagctcattcagtgttaataggggactgcgaacagagtgcatgcagattaaaagccagcgttttcattttaagaagattttcccagcctgagaaacatagtgagacttcatctctataaaaaagcaaaaattagccaggtatgc

SEQ ID NO: 52024 - DNA, 2080 bp, Homo sapiens
aggagttcgagaccagtctggccaacatggtgaaaccccatctctactaaaaatacaaaaattagccgggcatggtggcgtgcgcctgtaatctcagctacttgggaggctgaggcaggagaatgcttgaacctgggagataaggttgcagtgagccaggattgcaccactgcactccagcctgggcgacaagagtgaaactctcagaaaagaagaatggtcattaaatgaaagaatcaataaaatctggttagtttgtgtgaagatacacttaggaagcacatggctttcaacaaaaatgtgatttagcggagagcctggagtctgctggtattttgtcttatcctcccacaccaaggtgcgactgtgttcatttattaaatttgatgctccctgttgatgatgtgttcttggtaaatggaatccatgaacttttaatctgtagttcacaactatccctccacgtgtgtttcttttcccaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaaaaaaaaaaaaagttttctctgttgagtccgtctgtgtaagtttgtggctgagatgctagcttaggcatctctcttgttaacacttttcttggccttgggtttgtgcaaggctttttccccctttcatgaaaatgtgaactcagatcatggatggggaaggcagattttgatttgagacccgataaccttggcagcatcccttttgaatagctccttttgtcagagtaattacggccatttggtaaaattctaacttcgtgtttgtgtttcccctctgtgtttctaatgtcttcagtctgtgtcccctgaggaggcagggggtctctaatgagcctatctatgggggaaggtgagagctgcacacagccccctgagaaaccatcctaggagtggaaccaagggaccaactgttctggccttgaggttggcacaggggaaggacttgaagttgagctg

SEQ ID NO: 52025 - DNA, 1100 bp, Homo sapiens
gaaaataacctataaataatggcaaaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctagaagtaggagggaaagccagtcaaattcacaggatgaagtcaggaagataatagagcagtgcccgcaagatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcaacagtggacccagtaaatagcagatcagcctaggataagatgccctagaagatggtgaagggaagtctcagaactactgttcttcagcaggcagcgaagacacctgatccatattggagtggtgggatgcgagcttcaggaagggatgccacaaggaaaagtggaagggatgatgactgtcttcaagaggttacaggtctttaagaatttacacgtgaattggagataaatacagagaaaatgaaacacatcagtaattcagtagttaccaagcccagaaagaccaagtcataccatgtagtaaatataaccaaggtgcaccaaggcattcaactgtgactagtattaatggcgtaaaaagtaatgccagcgctggagactggcttaacaacaacaaacaccacttcatcaggaggatgggtcggggcaggtgctatgtaagtggtaaaacagctgtttgtatccttcactgaagaatttattagatttttatctaaaattatgaagtaggccaggcacgatggcccactcctgtaatcccatcactttgggaggctgtggcgggcggatcacttgaggtcaagagttcgagacgagcctggccaacgtggtgaaaccctgtctctactacaaatacaaaaattagccaagtgtggtggtgggtgcctgtaatcccagctacttgggaagct

SEQ ID NO: 52026 - DNA, 2045 bp, Homo sapiens
ggtttcaccgtgttggccaagctggtctcaaactcctgacctcaggtgatctgcccgcctcacctcccaaagtgctgggattacaggtgtgagccactgcgccaggcctcagtgacttttctttgacagtgtcttagaagcccctactttcactgggcgcagtggctcacccctgtaatcctaacactttgggaggttgaggtgggtggatcatgaggtcaggagttcaagaccagcgtggccagcatggtgaaaccccatctctactaaatatacaagaaaattggccaagcgtggtggtgggcacctgtgatcccagctactcgggaggctgagacaggagaatggcgtgaactcgggaggtggaagttgcagtgagccgagattgcgccactgcactccagcctgggcaacagagggagactccgtctcaaaaagaaagaaagaaaagtcattgaaccagcctcatttgcccaattctaccctccctaagggcctaacttagtcgcttcccattgcctcttttgtttcttcttggccaaaagaatccctactgtgccgaataccaccacatcatgtggtagaatcattgttcaggttttttattttgaactgtgaaatgtatgcttttcaaaccttggagcccccgttctggtgtgataaagttaggccctggaatgatgaggcagacccatatctaccccatccatgcacacacacccctcatcccaccacctaacccctccctctgtttaacattctgcatttcctggaagtataggttctgtgaaatggttttgaaaacacattgagttgctagatcctaatgatcctgtctaaagtcctaaaacagcctgtattgttgaacggtttgtacttcacatgggcagctagagtctgtactggtcattggcttcattatccttgcagctaaccttatcataagctcagacatcataagcttcctcctaaaaaggaaatgggtatcttgttcttgctggtgaagtgggacaaaagtataattttaacctaattggtattctgagaggaccagtataactttttatttgtacccctcactgccactacgagtatcttagctcacattggtttaatcagtctttagtaaccccagggtgtctaaacatttccatgtctaaaggtgtctttaagaatgggaaaatagtcccccctgcctttcctcttcacacacacagtataccacttctgcagtgttgactctagacccatagccagcagggcatctgctgttaaacctggacgctgctggctgtggctgaaactgagttatctactggacagtgtgtttgtgtcttatagcaatatcagtagttgaatcatgggccatacttcaaatttcagactccctctcccttgtggttttgaattgtcttcatttgttttctaggctgatgaaccaattgcagattatgctgcaatggatgatgtcatgcaaggtaaagatgaatttgttttaggaatctgctgattaggttttagacggaggtgggattttagatattgaagctttagtgtacagtgcttttactttgaaccttgaaaaaagcttccacatattgttacagtagaatacattatcttaaaagatcatagaaaggagggaaagatatctacaaaaacttggaaagctaacctgaggaaactgaaataaatgtgagctctgcctgtggaggaggtcaacaagaagcaaaactaagtcagattgcagtgccccagacaggcacacacaaattagaggcctaggtacctctgaaggtgggaatgaattgtgagcctaaaaagaagataacatgatacttgtttggaaaactgtataagaagcagttagacaactctctacctttcacatccttgtcacttccccatctccacctggacctcagatgggcacccagaattatgtgtttccacacttggaaaaattaaactagaaaggtgggaacgaagcctataccaaataggagaccatctcttagccctttgctcaaattcgggcagcccat

SEQ ID NO: 52027 - DNA, 1032 bp, Homo sapiens
cacacatctgtagtctcagccactcagaagccttaggtgggaggatcccttgagcctgggagttcaaggctgcaatgagccatgatcgcgccactgcactccagcctgggtgacagagtgagaccctgtctcaacaacaacaaaaaaaaaagaaaaagaaaaaagaaagaatttggacttgacttgttgatgaaaggatatggggcctgggaaagatgaggtgacagtgatgaccttgcccaagcctcagaatagccatcagcccagccccactttttattcattttatttccccacacctccatccttgggaagctggtaaggtaaggaacaaacgcatctatatgtgtaattgtttcctaatactctaccagacctcttaaggatgttcccggatatatagggacgatagcctcagtaggagtataacaagtaggctgactgtaaacaatagtggttttgtactctgaagccttttttttttttttaagaatccatgcataatttatttaaatagggtataagtcttagtattttgcattatacggactttctctcttttatattggcacagatcatgcatgcattttcagttgctccttttgaccagaatttgtcaattgatggaaagattttaagtgatgactgtgccaccctaggcacccttggcgtcattcctgaatctgtcattttattgaaggtaagtaaacagctccttagctgaagaactcaaggttttacatgttacataactatgtgtaaactgtgtgaaatggtggttaaaggatgccttgggtctttagcagagggtagtgataaatgactgctgtgggtttttgcagctcagcccaactctggctgagccccaggagacttagaggaggtcaggacatcatctatcttgttcttgtgtgttatagtaggtgatgttacgccacagcatcagcaactgctggtaccctgagaaggtgaaagtgaaggctttccttggcctttcctggatcacctagatcagtttctatgcctttgtgg

SEQ ID NO: 52028 - DNA, 1123 bp, Homo sapiens
tcacccaggctggagtgcagtggtgccatcttggctcactgcaacctccgcctaccgggttcaagcagttctctgcctcagcctcctgagtagctgggattacaggtgcgtgccaccacacccagctaatttttgtatttttagtagagacagggtttcaccatcttggccaggctggtcttgaactccttacctcgttttccacccgcctcagcctcccaaagtgctgagattacaggcgtgagccaccgcgcccggccttgatagagttttaaaattatctttaccttgatgttttccaaattgttatatagatttattttagatatgtcctctccatccccctcaaagcatgcattgctttacaaatcagttccacggctgtagtgcaggcattatgaaatggtttcatgatactgttatttcttggtatcaatactgaagtactataaataagcattccagtggtaaatctcaaaccctaggcagaaggaactgataaattcaagatgtccataaaaaattctggcccctaatctgtttcagtcactgatagatatccaaaaagttgaccaaatttcctcctttgctacttttatgtggcatagtttactggttacacatttttcttgttgctgatatttatcattgtaattgaggcaaaagtacaggccttcctttgagggtgttatgtattccagattgtcctgacaacagtatttcccttggttgaacccatggctctgaaaataagtgtgttggcataatatctttactctgttattgtaccttttacatctaagaaaccttgtttctatcactggctttctgcctgtcattgggaaacctcgaacattcaaaacctttaaattacagaaagagcccctgtgcctaaagacatttttaaaagcctgtgctgcttttattatggactacaatttttgaagaataaaccagaagtcagcagaaataacccttccatctgagagcatgtacctgcccgaatgagctgctagaagatggcagctgttcacacagcccccagaggtgctcttcctgaatgtctgtctcatctcccactcttgcttcagggaccactgcgggccaaacagagtcaaagaaa

SEQ ID NO: 52029 - DNA, 1035 bp, Homo sapiens
cctcctgcctcagcctccaagtagctgggactacaggctcatgccaccacgcctggctaatttttggttgagatgggtcttaatatgttgcctaggctggtcttgaactcctgggattataggtgggagcctcctcaccaaaccttaaatgtctcttgtaacaaacatttaaactgcttacatgcacttagaggtgtgtattactcattattttcttttatcaattttatgtgagcctgctaagaaagtctcgttagtttctactcattgtttacattgaatttcaaatagttaagggaccaataaggaaacagcttttgtttacctgaaaaacttcatgagcaagggtcacattgtggttaatttcagtgctttcttcatttccaatcttcattatagagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcaggtgagggaaacatttgttcaagtttgctctggacttaaaagggcctttatgaattcctgctttccacctgtatttacatatatgtatgtatctgtgtttttttccagaagacttaaagttttcaaaatagccaaaaatctttttgtgaagatgaaagtgaattttgggttctggaaacttgggctggttctgcaatagctttccaataatgagaaacgctgggaaccacttaatttgtcacatgttgaggttgtgccaggataactgttctctcactttattgtgctgtatgcttttctttgaccacttaataggtattggaggctgttaccaggaactgctgtgaaatttaatgggagataaaaggcagcttattattagcgattagtgattgcttattcactaggctgtcacagtatttttggtggcagataaatctatttgatagatagagggggtttttttttttttttttttttt

SEQ ID NO: 52030 - DNA, 1050 bp, Homo sapiens
tatccatcccgattcaggactccattctcttttgtctgtttggctggcagtaccgtatgttttagttattatcacttggtagtatggcttaataatcagttgggaatcaaatttttttattttgagaccaagtattgctctgtcgtccaggctggagtgcagtggtgccatctcggctcactgcaagctccgcctccgaggttcaagccattctcctgcctcaggctccccagtaacggggactacaggcgcccgccaccacgcccagctaattttttgtattttttagtagagacggggtttcaccgtgatatccaggatgggggaatcaaatcttttattgcctgctgtcactaattatctgttctctggttaactttgtaaattagtttgttaaacttgacacaatgttcttactgtctttagtttgttattttaagctttgcttttcaccctaagagttatttagaaactatctacattttcaagtgatttagattttagaaagctaacttttttttggtggtctagttttattcattgtggtcatgaccacagcaattttttcaaagtgtatgtggaatcactctccttagttgtggatgacaacagatttcacgtttataaatatgatagagaatgttggggaacattgctttttatactgtaattattttttatactttataattttcttctgtcttccttttccttctttggatattgtaatactctaaaatgttttacattttgctttctcacaaaaaatttttggctcacaaaaaatctcaagtgtaaccttcctctttggaaaagaatagatagtccctgaaaaatgttcagcattttcaaaatgtcaccctcctcatcacatatctcagtacaaagatagcttctgtaattgctgctttaaatccctgtaataaaaaatgatgcatttctgcttgtccttagtggagataaacaaatcccttttcctcttttctctaagctagatcaacccaactcctttgacttcatctaaaaatttaggttaataatatactcggt

SEQ ID NO: 52031 - DNA, 1686 bp, Homo sapiens
taccctagtggctattgctggtctagaatgaaatttattccaagaagggatcatgatatggaatgaacgaccatacactatcaggttttatacatcataccaaggatttgggtttattcccagtgtagatataagcccctggagagtttcaagcaaggtcatgatatgatctgatttatagtttaaaaaaaatcaccctggctatagtgtttggaattgctgtgagggcataacagaaataagagaggtcagttagagcctcttccattgacctgcaaggataggtgaaattgattggatatgtttgggaagtggaggtgttaatacttgcttggattggatttccaagcatttttattatattagggatggctcttgggtagatcctgacccatatctctagatatcttattaatttatttaattccatgctttctgggattaaagacaaaatggaatacattttatttgatgcttgtttccaaacacattttttagaagggtaacttataattatgccctggaggccaagggttctgctttacaagctaaataaactaaggccttcatttcctaatttgccgagaaaatgaagttaatgagtataaatgtctctgtttctccctgtaaaattttcttaaatcttttgttctctggtataaaatattatccaatttagatgtagtttcattattcagtttaataagagtatttcatagtgtttgcaagagagcgcttcttccatctttcgttttctcaattcttaaagagcatgtaactcctgccacttgaatagtttgagaacttgaaaaggcttggcaatcagtgtgctcgggaaggtgtcaagcaccttcgaacttctgcaaaataacatcattgtacaagactgataataataactgctctgcagagacctcttaaatgtatggtgagcacattaaatactacaagaataagtcatagggtaaaaaactaacatgttaaaagagcatagaaaaccgtgaaggcttgattcttgatccactctccagtctataatcccaccatgataaaggtgttcctcgtcttgataaaggttgccggtcccagcccccacatcctccatagcctgccttcctagggtctgacctacttctctttgttgtcctggcacattcaggtgatgaaggattcggctccggaactgaatgtgagtagttctgaaacagaggaggacaaggaagaagctaaaccagatggagaaaaagatccagattttaatcaagtatgtgttgaagctgcttttcattgttatactttctgctgttcttatagagcagccactcgaagcccctggccatgtctctgtaccctgtatgggatattggttctttttttttcttttttttttttttttgagatggagtctcgcactgttgcctgtgctggagtgcaatggcactatctcagctcaccacaatgtccgcctcctgggtttaaatgattctcctgccccagcctcctaagtagctgggattataggcgcccaccaccacacccggctaattttttatatttttagtagagacggggtttcactgtgttggccaggctggtctcgaactcctgacctcgtgatccgcccaccgcagcctcccaaagtgctgagattacaggcaggagccaccgcacccggccttttttttt

SEQ ID NO: 52032 - DNA, 1045 bp, Homo sapiens
cttctctttctcccacccttcctctcacactaaccactgtactgaatttagagtttatctgtctcagaaagtattctgtaaaaaaaaaaaatgcacgcacataatgtcttgcatatttaaaactttttatataaatggcaccatactgtatttatacttctgcaactaacttattttactcaattatgtttttgagatctaaccatgttgattcatgtaatttcagtccatttagtttcgctgctgtggtaacattcctttgtatgaaaaactattctttgttgatgatacgtatcttttctctctaattcctttggattaaatgttagtgttaatggttttggtttagcagactaatggattatgttaattctcttaatttccatgtgtcttaaggcatgttgtgttttttttttgcacagtatagctctcatatggcccagtgagtggcaaatgatacaaaagctctttgttgtggatcatgtaattaaaatcacgagaattgaagtgggagatgtaaacccttcagaaacacagtatatttctgagcccagtaagttttcatattgctttcggtttctatagttaagagctgacattttaagaagaaagggtgtgtcagtgttgtctgcttaaagttaaagatcatgcggcggtcccaactccctaggtggaaactctcattataatcatcccattatttgtacgtttatttatggacagtaaatggatttccttatcatttgcatgtaatagaatatagtggttaatagaaaatattattaagagtttgggccagcacactagctcatacctataatcctaatactttgagagactagggtggaaggattgcttaaggccaggagtttcagaccagcctgagcaacataacaagaccttctctctacaaaataataaaaatgtagcacatatctgtagtcttgagctactcgctgagaggctgagtcaggagcatggcttgagcccagaagcttgaggctacagtgagctatgttcataccactgtaccccagcctgggtg

SEQ ID NO: 52033 - DNA, 2280 bp, Homo sapiens
ttacaaaatattattttaatgcagtgtgatttcaagattagtcaaatgggaggcaataaagtctgcaggaaatgataacctttgagtgtgggagtagatgtaattttgttaagcagcgcttgccatggcacagaggtcccaggactcctggaatcccatttttgactacttccttccttgcaaggagaaagaaaatgcacggttttagctttgtacgtttgtttttatctcatgatttttttttcaatcacagacctagattaaggacgtaaaattgaggttaatggctacctcctttagaattaaaatgaaatcggaaattcagaagtttttgaaaacaagaaaagagagctagaaataccaaactttagcaaagcaagaaaagcgtacctgtggatttttcttaagtttaagaaataggaaatagataatgactttttttcagctgttttttttttttccaaatatatttttttaaactcaggtgagttatgcatatctgaaaatgaaagaaggcttgtttctaaagaggcttggagcaaactgcagcagtactttccaaaggctcctgagtttccaagttacaaagagtgctgttcacagtgcaaggtactgaacgctactgacatctggggaaatggcatgccacctccctgggttgacttcccaggggaattaacactgtacttctgacgggggtgtagggaggaggcaggtcatgtgctgtcagcaggagacagttgattgcttcattctctttcagattttagaaagagaaggggaagaaaatgaagccttacataagatgattgcaaacgagcaaaagacttctctcccaaatttgttccaggataaaaacagaccgtgtctcagtaactggccagaggtataatgattcccacaaaagaaagaatgcatcttttctttttaaagcccttgccaaattcccagtgagctatttcagaacaacccagaacttctcatattctcatttgtttagttatctaaccaggggatttactccagcctgctattttttggtagaggactgtgttttcattttatttataaaacttgaataaggacaaccaaagtatattataaggaatttgtgttaagcaggcggtgaattgacggatactgttttgtgatttttgtgttctaggatacggatgtcctctacatcgtgtctcagttctttgtagaagagtggcggaaatttgttaggtagaaacaaaatatgttttatttcctttattgttactgatttggttgactctggtattttttaagatatcgtggattctgtttgttgtacccttccttcatggttactttcaccagcatacactgaaagctttcttttctattaattaaatgaataagcctaagaaacacattgaattactaatattttcttaaatatatctctgattttgaaataattattttaaaatcttctctttcgtcatgcagtaattaggtatatttctcctccttgtctcatttgagtagaaagcctacaagatgcagccctgtgtcatcagttgggaacagtgctcttttgtgtccccacgggggcctcatgtttacatttgcttccatgaccaaagaagattctaaactgtgagttccttctcttcatgtgatttttttttcttcttttctctttttgatgattaataaaatatgtttaggaaatttctcatctgacatagtctgttttaagaatttagtcctttgctgaattgtggggtttttttttccccttttaaaagagaagaagactgcttctccaggaaagacaagaggctgcccgaggctatttgtctttttgctctttccttgtccctcttgaagacaacacagccaccctttctcttcccccgctgctggtgaccagtgctgagacctcttttccagaatcacagaatcaacatggtcttggttataggttttgttctgccatggccaggcttcagacaattaaaggaggaggctagcagggtggcagagcaaagccactgcactggtcatctggaattctagggtcttagaacccaaattttattccatgcttcaagtacttccagaggtgttcatctgtgaatttctcccgattttaccaaaaatcgtgatatacgagaaggtagaatgcttccaacattgtcagaaaatcaggaaaaggaaattggaacacataaataaaaatgcccttggggttaagctagagttttattattcatatttcagtactttaacatcatttaagggagttca

SEQ ID NO: 52034 - DNA, 1003 bp, Homo sapiens
tttgctgtcacactacaaactgtaagttatggccacagtgtgagttaagatggaaaaggcattaaacttgtgggtggaagacatgaacagaaatgtgccaatggatgtttattgagttcggtggtaggttttaggcatccattgagggtcttagaacatatgccctgactgatcagcggggagtactctgtttgatgataaaggttaagtccttatttaatttgcctttaatgctttgtgttcacccccaaaaagtgtaggtaggtgaaaatgacatgccatgacatgacatgtagatgattaacttggtttatgacacagtattctcgatactttgactagaattaatagaagaattccattttttgaatttaaaaaagcacattttcttgcataacctaaatctttaaaagttaactgtcattgagatgttcctctttccttttaagggaaagaaatataacactttttagcagaactgtgtaggaatcacatgggtctaattttcagagttttaaagttttctttgttccaaattgtgcagagtagtatatctgctactttcaactttaagtacacaataaccacagcagatatcatttgtatttcttttgattagatgaatcaaaggaagaaagaaaagaagaggaggaattaaattttaatgaagatattctgtgtccacatggtaagctagaagcataaatgaattctgttttattgtccttttttttacttttagcttctactgcctggctttcatgccagtatctctcacatcttacctgggaaaaattttttttaatagaatttccccatatttagaggaaatcattggaaaagaaacttcttgtcacttgttccattgaagtgcttttgaatttgaagtattgaatttcagttgtttcccatgactgtcattgtccaagttaaacactttgagaatagtgctcgtatgtttcttcttcttcatcttgttagggctatctatggttttttattt

SEQ ID NO: 52035 - DNA, 6403 bp, Homo sapiens
tcagatgtttttgatgctgtgattgttctagactttataactttccaaagaaaatgtgtcatgttcaaaatccaggtttttttttttctttttaaagaactttgaaccaaaatgtatatttccctgtggtaaatattttaatattttgctttcctcatcaaatgctgaggtttcatatagtccggtatctccagcttgataataggagagttctccctcatttggagttgattatgtccatggcctttggaaagcaatgcttgtagtttactgaatcacaaatactagggaatatatttgaggggcctacttagagtctttttctagtgcagaaacatctgtagtgtaaaaactttgccacaaacagaatctgccttaactatgagacttgtgctccacttgtattctcaggcaagctcttggcagagtcagtgcaactctttatgatgatagagactgaaaatggaaagaaagacagacttctgtgaccatagtcactcttccttcatggagcccacagcgcactaaagtgaaatctggagaacttgctgttagtagtaagcatggtattagattagaattataggcctgttctctgctttctgtcttcctcctcttactataaaaccgtacatagtttttctaatcattgtatcttacattaaatttatattgaacaattcaaaaaccaaaacaacaagctttccttggaagttttctgtgagattggaaaatgttgtcttgcctttgagccacattgttgctggacagtcagggccacagtcaccctaggctttgaattcctgcagacatcccctggcaaggagggctttgtgcattttgagctttcctagattcctttcattgtgagggccaggattcttagggtgttttctttcagttagcaataacagatactgctgtctgtccactcctccccagctgctggggaaactaggatgcctagtgacttattcttgaatgttgctctttatcacaatcctgttttttctcctttgatagccttcatattgcttaccattttaatctaattgactgtccttgggaaaagatgagagtatgctaagactttgatcttgctttcagaaagggatcatttatctttgcattccccagatacccagtgtactctatccctggcagattaagcttgataaatggcaaataaagtcgggaggcattttgaatgtaattagccataccatgatatactgtaaagtgctgcagctgtgttacatatactgcatcttaaagtctcctcttttttttttttgagatggaatttcactcttgttgcccaggctagagcgcactggtgcaatgtcagctcaccacaacctccgcgtcccgggttcaagtgattctcctgcctcagcctcccgaatagctggtattacagtcgtgtgccgccatgcccagctaattttttgtatttttagtacagacggggtttctccctgttggtcaggctggtctcaaactctggacctcaggtgatctgcccgcctcggcctcccaaagtgctaggattacaggcgtgagccaccatgcccagccaaggtctcctcttttatatattaagtttacgtaaatgtataattaacttttccatatctcttttcttccaaaaagctcaaaatgcttcacatagcttatcttttatactcaacaacattcccatgaggtaggtagaaggcaggtattattaccttcattttacaaataaaagactggaaacatagaaagtttaagtgacttgttcaggttcattttcttggtagcagaacttggattagaccgtgacctcgactcacagtcctgtgctcttcctctggagccacattcgacttgaccagttagaaggctcttagttgatgatgtacagtgccaaattttgttttcataaaaattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattttaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatgtatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactggtaattcaagatgtcctctctgtttaaaaaagagcagctcattaaatcttcatcttatggtctttatgagtgtggcttatgatgatttgacccaaactatgctagaccaaatattccttacactttgcacaaaggatttgctaaataaagtagaagttaagcaactgatgctattcatagagggttggttggggttttttggtttgtttttttggtttgtttcttttaacccctctcaaagcagacaaaataggacccttttaagaaaactgtctggtagtagtttgttactctgtgtaatactgtttaaggtacttgagcccttgtctggttaattgcaagtttgtgcctccatgttatggtgacttctttttttttttttttgagatggagtctcactctgttacccaggctggcgtgcagtggctcaatctcgactcactgcaaccttcgcctcctgggttcaagtgattctcgagcctcccgagtagctgagattacaggtgcgcaccaccatgcccagctaatttttgtatttttagtagagacggggtttcactgtgttgcccaggctggtctcaaactcctgggctcaagtgatccactcaacctcgccctcccaaagtgctgggattacaggcaagagccaccacacccgcccagctatggtgacttctaacagtgtgtgagctgtagatggttacttagtttatgaatggaagctacttgattctcccttaaatatagagctatatatgaccacatagtacccaaccatagtattttgttttggctgcctttctgttgtgcctccttgaaacatttttctttttacatgagtagctgccaacacaatcctccctccaattttcagatgaggctgtaggaaattacatgacacctccctccccaatacactttttctgtaattaagtgctgttttctaatggtatacaacttattgcataaaacttgatatttaactacatgctgcaggccttctgttaaacacgactggagttttgcttcctaaatttctgggaatttttgtttttgtttttttgagacagtgtctcactctgttgcccaggctggagtgcagtggtgcaatcacagctcactgcagcttcaacctcctcaggctcccgtctcagtcttccaagtagctgggaccacagacatgcaccaccatgcctggttaagttttgtattttctgtagagatggtgtttcatcatgttgcccaggctggtcttgaactcctaggctcaagtgattgacctgcctcggcctcccaaagtgctgggattacaagaatgggccaccatatctggcccctgttttttttttttttttctctgagacagagtcttattctgttgccccagctggagtacagtggtggaatcgtagtgcactacagcctagaacttctaggcttaagcagtcctcccacctcagcttcccaagtagctaggactacaggcacacatcaccatggcttgctaatttttacactttttgtagagacagggtctcactatgttgcccaggctggtctcaaactcctgtcctcaagctaccctccctgcttggcttcccaaagctcttggtggtatgagccactatacctgccactgttcttaattcacaatgaataaaccatgcaataggaagagcgttcacattttagatgattcctaaaacttctttgtgttttaaaccaggcccttcattttgcttttccttttagtgtgctttgaagatcactttcacatgaagatcattatttataattatcagctatatttaacccccccaccttagaacctcagtgatttgattatcatcttgtaaagattgcatgtaaaccttgtcagatactgtatttagatacttttaatgtaatacaacattttgtctctcattgttctttattcagataacagtattgccgtcttggtttctaattgtcttagtaaaataatttagggtatataccaatttgccatattgccaacatttgtgactttggtttagaatgtgtctgtgtttgtgaagtgctgaaaacattttcctaacaggaagtctgtttgaatgaaatatatttcctttcattctttcttgcctgtagtgaaagccctgtgtaaggaatgtgtagtagaacgttgtcgcatattgcgtctgaagaaccaactaaatgaagattataaaactgttaataatctgctgaaagcagcagtaaaggggtatgttgcacagtgtacattgttaatgataaactaagaagttttcaagaggtcataaccaagcatctcgttatttattaaaaataggaagttgggatttttagaagaagggtgataaagtggatggtagagccagatcaaaagtaaattttgcaatgactgcccctgtggcaacgataaagaaaactgctgagtcagatagcctttgccactgtattccatcctaccatttgattggtgtgattggcttgaaggtaggaaaagcaggataatatttagaatggaaacaaaatattagatccctgcagttcaatagtgaacagagaaaatgaccgaaattaggaagtgggttaaaatcaattacatgtacagtagctgatgttgagtgtttgtaattcactttagttgtttttacaggcaaagaagggaggacagtgtttggaaatattacttatatgatttaacattctctctgttccacagcagcgatggattttgggtggggaagtcctccttgcggagttggcgccagctagctcttgaacagctggatgagcaagatggtgatgcagaacaaagcaacggaaagatgaacggtagcaccttaaataaaggtaacactttaaacctatgtgtagatcattgtgaaactataccatgaaaatataagtgggccaggcacggtggctcattcgtgtagtcccagctacttgggaggctcagacgggcagatcacttgagcccagcggttgtgccagccccactgcactccagtctgggtaacagagtgagaccctgtttccctaaaaaacaattttagtctgggtgcggtggttcatgcctataatcccagcactttaggaggccgaggcaggttgatcacttgaggtcaggtgttcaagaccagcctgagcaacatggtgaaaccccgtctctactaaaaatacaaaaataattagccaggagtggtgttgcacacctgtggtcccagctactcgggaggct

SEQ ID NO: 52036 - DNA, 1840 bp, Homo sapiens
cccgagtagctgggattacaggtgcgtgccaccacgcccagctaatttttgtatttttagtagagatggggtttcaccatcttggccaggctggtcttgaattcttgacctcacgatccacccgcctcagccttccaaagtgctgggattacaggtatgagccactgcgcccgcctggcgtcatctattctaaagtggtgattttgagccattcgattgttctgggaggctgatgatgtcatggagagctaggtggggggaatcaatttaggattattccagtggctgtcttcacttttacttctgccttcagtttggaggtttctagcagacagggagaccatagttggaatttctgccaatgttttaatcagtatttgatatgatttagagattagcatggttcactatatgtgaaaacaagaataaagttgttttttgtctttctgttttgaatagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataattgtacttgtggtttgtctttttaatatcttaattttccattactagtataactttaagcaaaatgtaaacaaaaattgccaagtctataagaatatattttaactaaattttaattcaattctgacccttctttgtaatctgttactttaactctgtccaagggttgggattaccctaaataattaaactgaccttaatgtaactggaaatgatttggaaatgaacccatgattcagatctctaaatttataggtctttgttcaaaggtgttgggacctagaaatctattttccaaactttattcacggtttcctgtgtccactgggcaagagaaagggacttaactgggtctaaagtgaaatactcatttgaaccactctttagaactatagagttcaaagatgttatgtgtcaagttagcactgtgcttcctttggctgttttcattcagcatataggaaccttatgttcttagaatatgcttatgttcttagagtatttctctgtgtt

SEQ ID NO: 52037 - DNA, 1024 bp, Homo sapiens
gcttaatttttgtattattagtagagacagggcttctccatgttttggccaggctggtcttgaacttctggcttcaagtgatctgcccatcttggcctcctagagtgctatgattacaagcatgagccactgtgcccggcttcagttaatttttgtaatttaagactaacataaaaatcagcttatggcaatagtgatttttttgttgttgttctaggtttgttccccagaaaaatgtattttctttttacctttaaaaaatagaatgtggcaggcaatagtggtagtaaacttttttaaatattaaagctaaagagcctgccaaatttctatggcctttgaatgttttagattggtgttaatgtgtcttgggtgtatattttggaaattgttttctatagccccgctaaagaataaacaaactctaggcacttaagttaaggtaccttttgatttctctatctcagcagaaccttctaagtctcagacacgtaaacccaagtgtggcaaaggaactcattgctctcgaaatgcatatatgttggtttatagactgcaaactcaagaaaagcccaacactactgttcaagttccaggtaaagcagttttccaggattatagcaggcaaatgttttagaatgccatactcaaagattaatgataagtaatggattgcttttagttactatgataaattgattccataaggtgaatgttggtgaaagtaaatattaattgcaaatttacttttaagaaaggagcttctgaaataaagcaatgcaattattaaaaaatcagaaagtaatcaaaacatgtatttaaagtataatttggttttattttgttcggtttatagagtatttgtgaattttatttaattatctatagatattctagacttcataatataaaaggtagagttgttgctgccctgaagacagtctgagtctgaatcattttactcagcacttttctaagcttggtggcatcatctattctttcttttttttttttttttgaggcg

SEQ ID NO: 52038 - DNA, 1045 bp, Homo sapiens
attacaggcatgtgtcaccacggctggctgattttgtatttttagtagagacaaggtttcacaatgttggtcagactggtctcgaactcctgacctcaggtgatccacctgccttggccccccaaggtgctgggattacaggcgtaagccactgcacctggccttaattttttctatttttaatagagacagggtttcactgtgttggccaggctggtcttgagttcctggcctccagtgatctgcctgccttgaactcccaaagtgctgggattacaggtgtgaaccatcatgcccggccaacctggcaaaaatgtttaaaacaatttttttgtggagacggggtcttacctggttgcccaggctagtttcgaactcctgagtttaacagtcctcccgccttggcctcccaaagtgttgggattacaaggcatgagctaccacgcccaggtagcaatgcttgctttttaaaattttagttaaaaaaatttacaattattttgttccagagatggttttcataatgtcatgttttcagtaaagcttgaaggcaaatgatcagtttttaattaccaggtttatttaagtgggtaggggaggatcatgggcattaagttagtgatgatgaatagtagatttaatgtagtaggatttgtaattattttccttgggtcaggaaatttattttggggaactaattctagcaggtaaactttgtttctccttcctttaagtatcttacccaaatccttgagcagtgcttctgtggaaaatgagctggttgctactgtgtagtagtgaggtctgccataaagactacttcttaaaatagtatcctagtatgtactttcatcacctcagttgtcttgggcctaagtacccatttattttccaaaggaatggacagtttttctagttggagccatctcctgagctccatctcctgagctgtttatcactttcttcccattgtctgtcagacaggtataggcaattgtccaagggcacatactttgttctggaaatctaacacacagcacagtga

SEQ ID NO: 52039 - DNA, 1089 bp, Homo sapiens
tgacattcgtgtctccctggtttgtataagttttaagtttcgtaacacacagagagtatgaacagccgattcttgggaagcgtgtggcctcgctagtgtgtgctgaagagcacggtgtgtagtagagtagcttatattccctgagtgcccaggaggccgtagtttttcatccgtgtattttgcagaggcttggagaattaatacagtgtgctgttcagagtgtgtctaagagagtgttaagggagtgtaattatacattattttgtaaaactaatttgtaaaaattttaggtgacatgtttttagttataccacatgtgtaaagattcgtaatcattacaattcaggctcaggatataagaaataactgttatccaacgtttcttttactttctccctttctctccaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctaggtaaaacctttaagttgtgagtgcccttttaaaatataaatttattttactagaaatatttgtgataaattattatggctcaagattgttatgttacagactatcaaggatatttgcatttcttaaacacatgtaaaatcactgaacatcttgtattagcaatgcttgtttttcgagtccggttcttactctcttgcccaggctggaatgcagtggtacagtcatggctgactgcagcctaaacctgctaggctcaagtgatcttcctgcctcagccttcccttcctagtagctgggcctacagataagtgccaccacacctgacaaaattttttttgtcaggtaaaaattttgtcaaaatttttttcagtaagagagagtcttactctgtcactaaggctggagtgcagtaacaccatcttggctcactgcaacctctgcctcctgggttcaagcagttctcgtgcctcagcctcctgagtagctgggattacaggcatg

SEQ ID NO: 52040 - DNA, 1050 bp, Homo sapiens
cctgcaaaatgaggtgcttttgaccaattagggtcaatagagccacaaaaagaaatatatcacctttctcagttattgatatatttaaaatgagttgtcatcagtatttgttcataaatgtattaaaggtatccagaatattaaaaaaaaatttttaaaccactttaaacgttaaaaacacccagtttttataatccattactgaccatgttggaatattgttcaggctgatctctctacccgagctggttatagcagtgttgttttgttgcttctgttcatggttgtctttgactgcatgctggttattgcacatagagaattatttatggggattcccctagggctaggatacatgccatctcctccacaaagccctttaggtttatttctgtcaggcatttggggcctctgctggttaggtatgattacagagttcaaggcttgaggttccctggcttacacagactggaagaacctggtatgggcaatctaagaccatcacatctccctcctttttatttctaccgctctgttcaggactcaggagttttctttttctttttttcttttcttttcttttctttttctttttctttttcttttcttttctttttttttttgagatagagtctcgctctgtcacccaggctggagtgcagtgccgcgatcttggctcaccgcaacctccgcctcccaggttcaagcgattctcatgcctcagcctctcgggtagctgggattacaagtgtgcaccaccacggttggctaattttggtatttttagtagagacaaggtttcaccatgttggccaggctggtctcgaactcctgacctcaggtgatccacctgtctcagcctccaaaagtgctgggattacaggcatgaatgagccactgtgcccagccaggagttctctttatggttccctgaggttaggaagataggctttttctggctcacctttaacatgaagtaacggggagagtgcagtgcagtagaaagaacagtggagggtgattccaagtaaaccctaaaattggagtatg

SEQ ID NO: 52041 - DNA, 2190 bp, Homo sapiens
ttttgtatttttagtagagacggggtttcacctgggcagccaggccggtctcgaattcctggcctcaagtgatccacccacctcggcctcccaaagtgttgggattacaggcgtgagccatgttgcccagcctttttgctgtctttaaatgaatgttgcatcaaaatacatgtgacatttctttttaaaacttactttagaattcccagaagtgggattaccaggacaaagaacctaaaacaagtatttttaatatcatacatttgggaaataggcacatcagttttaaatatcagtgtattcaaattgataatgtcactgctgaacagttcccattacttttgtgtgtccattatttatagtagctgtttttaagtagcttaagtgagagctattaactgaaatgaaattatactttacatcaagggttttatcacttgttttaaacccatcttctttttaaaattaatatgtcttattcttgatcaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggtaaatgtgtgcaaatattagtgtttgttgttcattgtggtctactatgtacagactttaccatagatgagatgataaaatggttgtaatttgaaactctagatttgaggatgaaagttatagatggaggctgtcattttgaaatgtcgatatttcatgattttatcataaaaaattttaaagaagccaaccatatataaatgataactagaaaagtaaaaaatccttactttttttattctaagaaagtattaaaaactgcaagggccgggtgcggtggctcacgcctgtaatcccagcactttgggaggctgaggcaggtggatcacctgaggtcaggagttcgagatcagccgggccaacatggtgaaaccccgtctctactaaaaatacaaaaattagccgggcgtggtggcaggcgcctgtaatcccagctactggggaggctgaggcaggagaatcacttgaacccaggaggcggaggttgcagtgagccgagattgcaccattgtactccggcctgggcaacaagagtgaaactctgtcttggaaaaaaaaaaagaaagaaaaactgcaagtaattgaattaccctgaccttctgtattgtcctttattttaaatagaataaattttgtactcattacacccccgccatgggaatgtatttttcattttataattaaaatcaaggcaatgtttgcacatgtgcatgtcttctgtaaagcaggataatctgttttgtgattaagttgaaacttctggaaaataagctgtgtttggaatcagcacttcgcattcacattttttaacctcatatttgtccagctataaaacaatattctgtttacttctaattgtacatgttttggaggaagattgtgaagtgaaagctagctactgttgagtttattaaaatagctaatagagcttatatattgtattatgattgttttaaatgtaaatataatcagctttcctcttggttaggcaaactggacataagaaaaagctgaatacctacattggcttctcagaaattttggatatggagccttatgtggaacataaaggtaatatttttactgaggagtaaacattataatgctcagagactctaacttgtgatcggcttgtgattaatatagaatagcagtcaattgccaatttttgtttgctaatctctctctgggaacctctgtctgggaacaaagacttttttaggagagccaagatgttaattccattttgtgtgagtaagcatatagcaaagatgaggtggttcatcgatatgtacagaattaagggtataaaaataatttgtaaaaaatgaaaaaggtattttactgtttctgaacccgcacttgccaccttagtttcaatactattatttatcatttctcaaaactaacagtctccaagcgcctctattcacttttttaaaaacgttgtcccagaaacattaggtggcataattccagtatttatgctttcatttttcatatctgcaactactgatacgccctaggatgctatcattgttttaacaagaaataagtactgcttttt

SEQ ID NO: 52042 - DNA, 2359 bp, Homo sapiens
aaagtagcaccttaaaaaaccccaaatctatatttttgttttaatagattatgagcctcaaacaatttgtgagcatctccagtacttgtttgccttgttgcaaaacagtaataggcgatacattgatccatcaggatttgttaaagccttgggcctggacactggacaacagcaggtaagaactgaatttttttttttttttaaatattcagaggtacccaaacatcctaagcatgtttataaagggagatgaagtagaatgctttttaaaaattaaattttttctattttgaatgaaaacctttatttactgtccaatagtttacacattatacttgattccatttatggaaattcatatgggggcacaaactgattgaacatagctgtagcccctgtttgaaaatgctaagttgaaagtataggtagtttctggaatgttgaatgtattactatttgtagtagaagttgaaaagcaagatatgatttttcttttcattaacctaaacttgtaggatgctcaagaattttcaaagctctttatgtctctattggaagatactttgtctaaacaaaagaatccagatgtgcgcaatattgttcaacagcagttctgtggagaatatgcctatgtaactgtgtaagtctgtttcaactttttcatggtacattttattctaagacagttgctcatatgttaactatttttcagtgcagttccaggttgtagctttagtggtttatcatgggacctgaaatatttatagtaatacatttccatgggaacatataaacaagtgagttggtaattgcagttgcacccatccaggtgttaggaacggtgtctgggtgagctcttgcagtctgctcttgctttatggctgtgtggtgtgagctaaagagtaagattggaactggctagaatactaaaagtaaatgtaaaatgcctgttaaaaaaatgtgcatgagtacaatatacaacatttgggtgatggttacattaaaacctagacttcaccacagtgcgatatattcatgtaacaaaactgcacttgtacctcttaacatttattttaagaaagtttcccaacgaatgtttagcttcaccaggcactttgtttttatttcttttctttttttttttttttttgagatggactcttgctctgttgcccaggatgagtgcagtggcgtgatcttggctcactgcaacctctgcctcccaggttcaagcgattctcctgcctcagcctcccgagtagctgagattacaggaacgcgccaccacatccggctgatttttgtatttttagtagagatggggtttcaccgtgttggtcaggctggtctcgaattcctgaccttgtgatccactcgccttggtctcccaaaatgctgggattatatttcatttttagtatacataatttctgtgaaggagaactaatgaaagttataaatgcttttttccatctttctaggatgtaatacaatataactttgttgcttttcacactctgatctgaattttgtcgttctgttttattatagttgcaaccagtgtggcagagagtctaagcttttgtcaaaattttatgagctggagttaaatatccaaggccacaaacagttaacagattgtatctcggaatttttgaaggtattcaaattttggtgtatgtattgttcctgcccattaacagttaaatgctgttctgaatgctattctgttttgatttagtggctagagcttttattgtgtcagctttttctacataagaagcatctgtaatgatccagaagacactttatgaagtaccaaagcagcctgtgtcttaaaaataattttgcttatttcaagttattttatatgtaaagttatgtatgtgtgagaagatattattctgtgattgtgggtagtggggtattgaaagaactctatgctgagttatcataaaggtattttaccttgttgtctaatgaaaacgagaatgtgctaaatatgaaacttttttacattgatatggtcattctgctttctgtatatttagattcatgtggagataattcagtgattcctttctgttctgagtggaaaactgctaagaggaaccctttgttgtcaagcatgaatgtatacatagtgtaatagacaagcttattatctagctagctagctagctgtcttcagatattttttgtgctttcttacttcctcagctcatccatgggcatgcctgaagtagtcattgaattcatttcgctgaattttttttttttttttgagatggagtttctctcttgttgcccaggctggaatgcaatggcacaatcttggctcattgcaacctccgcctcc

SEQ ID NO: 52043 - DNA, 2192 bp, Homo sapiens
tttttcatgctgtgtgtgtgtgtgtgtgtgtgtgtgtgtgtgtgtgtgttttacagttgcatagtactctgccatatagatgtaccatattgtctatttttgggcatttgggtggcttccaatattttgcaattaacagacagtgctgtaatgaataaccttatgagtgagattttgcattgttggaggtatagcctaaggaacagtaaatcctcagaaatgagattgctaggtctaaaggtagttgtctatgtagttttgttagtgactgcatttctaccagcagtatatgcatgctttcttctccacaccctcacaaactgagtgtcttatactttctcagttttgctaatttatagatgagaagtggtatctcattttagttttaatttgtttgtctctcatgaaactatggtcttttaaaaattaaaggttttttttttccccttagacgaaactgcaaaggaaatccgaattgcttggttggtattggtgagcatatttggttaggagaaatagatgaaaatagttttcataacatcgatgatcccaactgtgagaggagaaaaaaggtaaaccatcattttttaagcgattgctatatgctgttttttgtttttgtttttgcttttgttttgggcctgtgatcagaaaactctactgatttcaggtaacctgtgcagctttaagataagcagtagaacttaagactctaagccacttgaattggaacacttcttaatgatatgctttaaaacaggcagctgcgtaattcagtaagcctttaaataatagttttagtttgaatgctgattctatgtttgctttaacattgcatgttttattttgaaatcttaacgcctctttaaaggagatggtaattcaagggaacaaactcatgatgatagcactttgctttctagggcttgtattttatatataattttgctttttaaaaatatacattaaattttctagacataaatcttagcattcacgaaatatccaagtttgttatatatagatattttaataaaataataattctttgtaaggtcaggaattcccaaccttatctttggaaaaagttgcagccagttccctctaccaccgccaatctttaaaatctctagaatataaaggaagttttctgcataagttttactttgtcattctgctgaatgctggcagtttagaaatacagaaaacataaaacctatatacgcttgttcaaaaccgatcttttctagaatccactgttctaattttagatttaagtggctggagaagacgatatgctagagatgagcagtgatgccgtccgaagtctttttcactcctgtggtcaacccaaaatggggctttcatgaaaattatgccccacctccagccaagagaaacttaaggtggctataccatgttggttgtgacggtcttacacatttttaatctgaaaatttaagaataatgcttagaaattggttgtttaaaggaaaatgggttttataattatgaattttgtatttttgtagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaaggtgggtggaaaggggtgggggagagctctcttcctgaacatttttttaaacttttttttttttttttttttgagtcttcctctgtttcccaagccagagtgaagtggcgccatctcggttcactgcaacgtctgcctcctgggctgaagcgattctcctgcctcagcctcttgagaagctgggattacaggcgcccgccaccacgcctggctagtttttgtatttttagtagagacagcgtttcactatgttggccaggctagtctcgaactcctgacctcaagtgatgtggctgcctcggccttccaaagtgctgcgactacaggtgtgagccactgtgtctagcctaaacttattttattattattattattatttttttaagacagtttcacacttgttgcccacgctctagtgcaatggcacaatctcggttcaccacaacctccgcctctcaggttcaagcaattctcctgcctcagcctcccgagtagctgggatta

SEQ ID NO: 52044 - DNA, 1445 bp, Homo sapiens
gtaggggaaaggaagacggcagccctttgcgtgcatttgggaggcgcggagccgagcgaggtggagtttccccctttgcgccgtctgcgcgacctgggaaacgcaggcttcccgggctgtgcgcggaggtgatgctggccaaagcactttaggaaggtttgggttcccatccagaagatggcggtggagatgaaggcaggagctgagagcttagcaagcgttgatggttggggtatcttggccacagcacggctctttcgtttgtaaaaaggaactttttggaagtgagcttcatcacagtgtatcttgttggtgttgacaccgaaggcctgatcatcttagtattatttttgtagagggcagctttagaaaaaactgtggtcagcctacgtcatcgataccctgcacccccgttggccttccctcactcgttaatctagtattttttttaagcctttctttggtcgttctggttcgacaccagtttaccgagtaccaagtttaagctgtgatagtgctgtccttcacgtctgcgccgcccttgaactttacctttccttaaccccctcatatagattgaatccttaggctttgctcccgtttattcccttttttccaccttgtaacgcgggaactatagtttttgtttcagaatgttgttgaaattgacttggccaagccgggcatgctcagtagccgtctttcggcaggcatttaggaaatgctttctggagtttttacattccgctgggggatccggaaggaatggaagtcatggtctctggctttggagcttaaagtctagtatgagaagtgaaataagttagggagtttctataaagcaaacgaataagtccaagctctgggcgtctgtctcacaaggagggtaaatctgactttaacagtaagttctggaatgtttgaagtctgtgtataatagaaataatcaagcttcagtcagtttctcaacgtaattagtttccagactaaccaaataatgtaaactactaatagttctggtggtttttgagacagggtctcactctgtcacacaggctggagtgcagtgtcacgagctcggctcactgcaacctccgtttcccaggctcaagcgatcctcccacctcggcctccggagtagctgggattagaggcacgggccaccacgcccgactcagttttgtatttttagtggagacgggttttcgccatgttggccaggctggtctcgagctctgggctcaagcgatctgcccacctcttctgggattacaggcgtgagccaccatgctgggccaatttctgatatttatttatttattgagacggtgtttcgctcttattgcccaggctagagtgcaatggcgtgatctcggctcactgcaacctctgcctccttggttcaagcgattctcctgcctcagcctcctgaatagctgggatta

SEQ ID NO: 52045 - DNA, 1753 bp, Homo sapiens
cttagggctagagctcgcccagccttcctcgcctcctgggctgctggagcccacaggccctgtcctctcacctcccggcaggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgccaggggcctcctgagtctttgatgagggcttcactcagtggagcctgtggatggggcagagcagggcaggtgagatctgggggtgaagcaagctggcttgggatcagcgaggcccccaggcccccaaccctgtgaggcaggaattgtcctattttctagaggggcagctgagtctcagagggttagggggcctgtccaacatcagacagagagccagggggttagaacccaaagagtctgaccccagagcctagtatcattcccatgtgcccgaagcccctctagggatggcctccctgatcctataaggctgggccactcaactgcagccccctggggagacctggctgggacatgggtagcacgtggtacaggctgtgctgcagtggaggcagaggccacgggcaccaggttgccaggccagccagc

SEQ ID NO: 52046 - DNA, 1918 bp, Homo sapiens
aggcatgagcccccacgcccggcccccagtcccatcttattacccaggtgcccaccccattacccgccaccaggtgctccccctccaacactgtccagtctctgaagaacctgcagacacacagagtccctcgactgcttcccctgcagtcctccctgtggcctcttctggctcccgccttgctctgctcagttccctcctccaaggcctcccaggaggctggcctggccctcactagcccagccccccggggtgtgatgggcagacctctggcatcaggacccccctccctccagagtcacctccgtgtcttttcactggcctatgtgccccccagaggcctgtgggcccgacgccacctgtgtgaaccggcctgacggtcgaggctacacctgccgctgccacctgggccgctcggggttgcggtgtgaggaaggtgaggggagccaggcctgagacccccagggtcctagtgtcagctggggaggctgggtggggcactctgaggccatgatgggccctacggatgataaaacgattcccaagccagaggatctcgaagtcacctggccacatgtctgcccagcctgagccccttattgagtgagggcccccaaagaggacccctgtcatattggagctcctcccagccccgtgtgcaagggcaggggggctcctgtgccactgcagctggtgccaactggtcctgagcctctgggcctggagagtgaggcaggcaagggtcccagaggaaggcagagtagctggaccccacccgagggtccaggatccccactgcctcagctgagctgtggctgctgcaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcaggtaagcacccagcaccaaatgcggggctctgcacaccaagccttgtgcccccctcggctcttcaagccccagggaggcatgggaggataaatgcagggatcagggcaagtcccctcttcctgtgcatttcgtctctgtgtcacttgaggccaatccctagccctctctgagccatgggctcctcatctggaatacagaaggctgtagggcattccccatctgctcagggccctgtttgtggtggagagggcagggagccccgtgtgcccccatgtgcccaaccctgcctggcatcctccccagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtaagagcagcctcctcgggacaagcgggaggggaggggtgccaagccttgtgtccccctcggctctccaagcaccttggcattgggcccctccacctgcagccacccacgggccctgggccaggacactgtacctctgagcctcagtttcctcctctgtaaaatgggcatgatcacacctactttgaaaggttgggcagaggattgtctgcactgacggatgaatgtttctagcacacagtaggcactcaactcctgcgcctccctccccacaccgagaatccatgctaccactcagggcccaatgtgggctcccagctcccc

SEQ ID NO: 52047 - DNA, 1106 bp, Homo sapiens
aggtgctaggctgcagggcgctgagcctggggtccctgtgggctgctctgggaaagctcccagcaaaaggatgtggggagagaagatccaggggatgggtcacggggagggacgacaagacagggacaggaacgggaacagccccagggctgggactgcaggaagtggtgacatccctcctctgggacccctctacccaactgggcccctagcccttcttacaaaccccctatccactctctcctgccccggcctgccccacggagcaggttcgatgcaggctcaggcatggccaccatccgccatcccacaccactggccctgggccatttccacaccgtgaccctgctgcgcagcctcacccagggctccctgattgtgggtgacctggccccggtcaatgggacctcccaggtgagacccaaccccatactgctacttccagccctcatcccgcccttgcccagcctctgttgccattcctgacttccccacctccccagggcaagttccagggcctggatctgaacgaggaactctacctgggtggctatcctgactatggtgccatccccaaggcggggctgagcagcggcttcataggtgagccccctccccacctccagctgaggctgggccttacctggctggctggaagagccctggagagcctgggagggcacctcagggtatgggctgggacaccctgccctgtgctcatcctgcccactcacctcccaggctgtgtccgggagctgcgcatccagggcgaggagatcgtcttccatgacctcaacctcacggcgcacggcatctcccactgccccacctgtcgggaccggccctgccaggtgaccccacaccccacacaccacctggctgccgtggcctccacccctagccatggctggcccctgtggggattatggggggtactgaatgttctcggccttacttctgggggctgctttgcagaatggcggtcagtgccatgactctgagagcagcagctacgtgtgcgtctgcccagctggcttcaccgggagccgctgtgagcactcgcaggccctgcactgccatccaggtacgcaccccgaccgccagtc

SEQ ID NO: 52048 - DNA, 2746 bp, Homo sapiens
caacctgcctgcctacctctagtggttattgggaaactagaatgcaacactgcgtgctgttctacatcagtttttaatgcccacacaattgcaaagcattcttttttttttttttttttttgagatggaatcttactctgtcacccacgctggagtgcagtggcgcaatctcggcttactgcaacctccgcctcccgggttcaagcgtttctcgtgcctcagtctcccaagtatctgggattacaggcgtgtgccaccacgcctggctaatttttgtatgtttagtagaaacagggtttcaccatgttggccaggctggtctcaagctcctgatctcaagtgatgcgcctgcctcagcctcccaaagtgctgggattacaggcgtgagccaccacgcccagcccaattgcaaagcattctatcagttgttttcaactccctgatgtcttattattttttctttatagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaaggtgaaggccagtggggacttttgttgggggacagtgagtggggcaggggcttctcctgctgccatcttctgcctgcccgctctgctcttcctttctgttcacttgggacattttccattgtgtgtgtttaaggggcaggtttcataacaggtggcagcagcaggggataaaagtgagattcccccagggcagcctggaatgtacagggagagagctaggccatagagcatcaagaagaaaaaagaaaccttgtcctcatctgcagggagtgcctgctctgctgggagagacctgcagcatagtctgagggcagagacataacccagtcaacaaacagacctaatagagagtaaaacaaggacaacagatgcagggcagacacaaacactgtgtgttctttaaaggcaattcctttttaccccaagccctgtgacttgcctccaaacttccttacctatactgcccctagtgtgcacttctcaggtccccaaagggctgcacaattttttgcccaggcatgttgaagaggtctcaggctgtggagtgaaatggatctggccctgaaccctgactctgcccgaccaggagcaaacagccgcttttcccctctgagccataatttcctcatctgtgaaatggaatgtagtggcttccttcaaggggtggtgtgaagatgaaatgaatcagggtgcaggctgggcacatatctgtgactgtcatgttgatggcctatgtctcttccatgcctctcagccttgccccagatctcaatgccccaagaagtccgtgtgcctgctggttctgcagctgtcttcccctgcatagcctcaggctaccccactcctgacatcagctggagcaaggtaagtgctggagagggaaccagcgggcatgacttgggggctgggaacagatctgaagcgtctcagtgtccccaggatgtggcacaggcttggccaagagcaaacgctcaatgttggaaggtgggcctgaggcacagatgggaggtgggcccctggagccgtgggccaaggccagggccctcagtgctagtgcatttgcagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccaggtaagacaccacccctaagaattggcagtgccctgcccactccctgactggcagggtcttcagctgtgctctctgctggcagagcgggtggtgccctacttcacgcag

SEQ ID NO: 52049 - DNA, 1134 bp, Homo sapiens
cctgcatgtgtaggtgtctttgccatggccaagtccctggattctcttatttaaactgcaggcagaataggctttgctgtccttccttaaaatgtctgagtatggccgggcgcggtggctcacgcctgtaatcctagcaccttgggaggccgaggcaggcagattgcctgagctcaggagtttgagaccagcctgggcaacatggtgaaaccccgtctctactaaaatacaaaaaaaaaaaaaaaattagccaggcacggtggcgcacctgtagtctcagctactcgggaggctgaggcaggagaatcgcttgaacccgggaggtggacgttgcagtgagctgagatcgtgccactgcactccagcctgggaacagagcgagactccgtctcaaaaaaagtattgagtccctcccactcttttcgtggcctgccctccccacccagaagcgaggagctgtggaaacagagcccagcgctccacaggcccttatccatgttggtggaatggcagctgtgtgtgcagatgaatgaatctgccactgaacggtcttttttccctggtcagagaggctatcaggagaacattccttgaatgttgggctgggggtttcctgggtccctggaggggcatcagggacatcacacacacatatacctgcagaacctcatacatgtccccgcaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccggtgagtggggccgggggcaggactggacttgggcagcatagcccagggctcacagtgagcagagttaaagcacctgccccagggggcgcaacatgaagcactgtccttggacacatcactttacctctctgagcctcagtgttctcagctgtacagtgggttatataagactgaatgaggtccaggcacggtggctcatgcctgtaatcccagcactttgggaggctgaggcgggcagatcacc

SEQ ID NO: 52050 - DNA, 2219 bp, Homo sapiens
ctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggtgtgaccaagggctggcacatagggctggcagggcagggatgccctggggtctgaaatgtagacacatgtgatctagagatgatgtcatgcccaggggtggggagtacggggagaccgtgttgctagcatcccccagtgatggccgaggaacccaactggggtccccatagagggacaggatcacccagggcccttcctcaccatggccaccctctgcgggtccctgaggtagcccagtgacttctgtcatcttccactcgactccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagtaaggcctcatcccttctttgtctgcaccaaatggagatctgagccccccgactaggctccaccccacacagaaccccaggaaccccatccagaggtctccaggcgctgcagggtcctggagcctgccctgcccgacacccacaccctggcctgggacctttgctttccttatccccagtcctctgggctcaccattcagcttccctggacactggatccaacgacctgctgccattctgacctttgccctccccaatcctgacctctgtgtccccccactcaggcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggtaagcagccccggctctgcgtggaaggggatcacctttcctcctggccctttgatgacccagctaggcagactcgggtgggaaggcctccctccataaccccacctggaatgccctcatctcccctactctccagggcccgaggcaggcttgccacctccaggaagccctccatcatgtgtgctcagctcctctagctctcacggctgctccccacctttggcacagccctggcactgccaaaggaaaccattctgtgtacataagcaccccagcctgcctcccctgccaggcagtgagaatgctcagggcagggcctggacccaggcatctcagcagccctgggcttaattgagggcaacaaggcccaggatgggctgggtaaatgcttgacagggacaacagtgaatgagtgacaggagcacccaccccagcacgcccagggcttcagtggatcttcagagagcccagcatttccatggcctcctgcatcaatgatacaaatgagggcttttgggccccaaacttaaagcagcacagcatgtagcccactggtcaagagcctggactgtggactcagacctgggttcaaagcacagcttggccatttgctggctgtgcaaccttggccaagtcactgaacctttttgagcctcagtttctttctttttttttttttttttttttttgagacagaatctcactctttcacccaggctggagtgcagtggcatgatctcggttcactgcaacctccatctcccgagttcaagcctttctcgtgcctcagcctcccgagtagctggcactacaggcacgcgccaccacgcttggctaatttttgtgtttttagtagagaaggggattcgccatgttggccaggctggtctcgaactcctgacctcatgtgatccacccacctcagcctcccaaagtgctgggattaccggcgtgagccactgcactcgtcctgagcctcagtttctttatctgtaaagtggagagaacaatgccaaccatgtaggctgagttggaaaggtacacagaggtaaacacagatgtaaaactgtgg

SEQ ID NO: 52051 - DNA, 1787 bp, Homo sapiens
gcagggccaggatgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttactttctgctatctgcgactccatgagctagacacacccaggccggagggattggggaagtgggcccaggggcacaggctggcagcaccaagacacgagaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacggtgaggggacgttgaccctgtggggctctgccctgtttccagccctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctccgcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcaggtgaagccggggctgcctctctgggtctgaggcccagtccatggcccagccttgagcgggtgcttggaggagatagtagtggatgggcaggtggtgatgagtggatggagagaggaagggaggaatgggatgggatgggtggatgacgaatagactggaagatgagagggaagagagaaggaaggtaggagaaggaagaaagaatgagtgggagggtgggtcgaaggccaagtggatggatggactaatggggtgtcatgagggtgagccctcaagcaaccagatgggacagctaaaaaccaaggaaagggccaggcatggtggcacgtgcctgtaatcccagcacttggagaggctgaggcaggaagatcacttgagcccaagagtttgagaccagcctgggaggccaaagtgggtggatcacctgaggtcaggagttcgagaccaccctggccaatatggtgaaaccccgtctctactaaaaatacaaaattaggctgggtgcagtggctcacacctgtaatcctagcaatttgggaggctgaggcgggcggatcacaaggtcaggagattgagaccatcctggctaacatggtgaaaccccgtctctactaaaaatacaaaaaaattagccaggcgtgatggcgggtgcctatagtcccagctactcaggaggctgaggcaggagaatgatgtgaacctgggaggtagagctttcagtgagcagagatcgtgccacagcactgcagcctgggtgacagagcaagaccctcaaaaaacaaacaaacaaacaa

SEQ ID NO: 52052 - DNA, 2446 bp, Homo sapiens
tggcattgttctctccattttacagatggggaaactgagactcagagaggtgaagttgttttccaaaggtcatacaactaatcaatggcagagctgggatttgaacccaggcagtctggccccagagtctgggttcttagccacattctatctgagtctgccaaacattagtggtctagtggtctgtgtggaagtgtctagacctcagccctggccccactggtgctgggagcatgggaggaggaggagatggtggggccattgcctgggggcggggctgggggaatgagaagtgcctccacctcccaggctagcccagctgctccaggcctcaatggaacgggaagggaaagaagccatgtcccaaatggcctctggtcctagtatctgggccccaggggaagggctgagggcatcagggtggcatctcagctcactgacctctcccctgtgccccagccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtaaaggagctggagaaggatgcatgcatcctccacacctgcagtggtcctgcctgaatccagcgttgaagggaaagtggcctcagcaactggggcttgtgggaaatggcagcaggaggtcaatggaatcaggaagttgagagcgggctgggcacagcagggccaccaccagccccacagcaccttggtgcaaaatagaaaaggacatctctggctgggcgcagtggctcatgtctataatcccagcactttgggaggccgaggcaggtggatcacttgaggtcaggagttcaaagccagcccggccaacatggcgaaacgaaaaacacaaaaattggccaggcatggtggcagatgcctgtaatcccagctactcaggaggctgaggcaggagaatcacttgaacccaggaggcagaggttgcggtgagccgagattgcaccactgcactccagcctggatgacagagcgagacactgtctcaaaaaaaaaagaaaaggacacctgttactcaaggctcttgacttcctcctgccggagaaaccatcataataaacatgccctccacaatgcggactgtcaaaggggtcgcctccaacaggatgcgcctacatatctgtgcatggcagtcccagggtgtgggtaccagaggcctgggcatctgaaggctcccagctcaccctccccgctctcaccccaccttggccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctggtgagtgatagggagcagtgggcgatgccagagcacaggcgcggggctccttcccagctctgctcctctcctctctcccagccgggcacttattgttgcctgcaggcggggtttcctaccacggaggatcaagccaacccaggtgttcccaagtctgacaatggtcccgtcccctcaaccagggggaccccagccctgagtttcaggaggacccttgagtccccagggaaaggagacccttcttaggttatatcagccactctcaagccaccgcgcccccaggatcaactggagctggtcttcactgccaccaccttcagcccctgccttgatccccggagcctggcctctctcacccaccccctgtgcccacagctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccaggtacaggggccaggatggggaggattccaggtcaggcaaggttagacctgcagttgctttctgtacccaaacctcatgcaaacaccagcctgcttggggaccccaggggataaaatacgtttgcgggacgagttcaccagcctgcaaatcaggagacctgggtttttctcttggctctgcagctgaatcctttcctgggcctcagtttcctccactgtaaagtgagtgggttggacctctaggattctgtgaatgaagcttccaccagccctaccagctgagaccctgagcttccgagagaactcttgggtaccggcacagttgggcttggggacattccttgtcctggggactttgccctgataactgtcccctcgctgctctgacagacccatggctcccagctgcggctccacctcgtctcccctgccgactcaggcgagtatgtgtgtcgtgc

SEQ ID NO: 52053 - DNA, 1028 bp, Homo sapiens
gtgttaactattagtgttactctggggggtgagattttctatggcagagggtcccaccaaccctgttcccaaatctgacaacggctgtgccgactcactgatctctgttcccccagcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcaggtatgcagctggcaggaaatggtgggagagccgctggatgtgggggccctggctagctttgccaagagggagacctaggagcccccgtggggtgcagtacccccctgtgtcagaggttagaccctggccccaggccttcaacagttccagactggcacctgactctgttcctctgtcctgtcccctattcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccggtgagggtccctgcagtgggacgggaaggccgggggagggaggaagggacagagaccagggggcagaactggcagaaggaaacactttctggcactcggcgagaactgccgctctgattccagacttcacctcccgccacccacacggtcccaggaccaaggagccggctcaggtggagtggttcctgtccctctccacggcttgcgagcataggctttggactatgctcatctgtgcatgagtcccagttcctctggccacacttggagatgttgcacaagggacctcagctttccacctgtcactgtcccttatctgtaaagaaggggtagtagtactcttgtactctactatctaattatagagttcccaaaagcctgggactgcacctctgcgagtattggagggtgatttacaca

SEQ ID NO: 52054 - DNA, 1998 bp, Homo sapiens
ggtgccaagtctcagtcgtccctggcatgggtgaggtgggacgctagacccagtcctgacactggggcggtagataggaagggagaaggtggttttccctggaagagtttccatcgagttccagctggctgggctgggagtggcaccagggaagggaacaggagcttggcgtgagccgcagtgcccagctctgagcctgcctcctccctcctgaccctcccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactgtgagtgtctcgggggtcatgcaaatggtggagggctgggggaccccgactgcaccctcagcagctcccacaccctgccttacatctcaccctcccagcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccaggtacagggccagcaggtggggagggcaaaagcagggcacaccagcccccaatgggaagaggggggactctcagcacctcactctgtgctcattcagtcattcaacaaacattgagtatccttgctggatgggtcctagaccagtgctgagaatacagaaataaggctccctgacctcagggagatccacttctgcaccaaatctcactgaaaagctgctccgggccatgtcctgtgcctgacactgaagattccagatggaatgagacagttgcctgctctcaggcagctcgcaggctgtgggagccccagcaggatactgtgtcaacactccggagggccttaacaggctttctggaggggtgacaaaaggctagacgtccaccccagcccagagacaggccacatgccatgctgggagcttcacgaaggccactgaggaggcaaggcagggaggcccccagagtccaggggcagcggcagcagtgcccaagatgtggaggagctgcccacacctactgccatacctcctgccatctgcttcctgcagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacggtgagagcagagagggcagggggtacagacaagtggcgcagagggtggcagagaggtccccggtgccatcactgttatctcactctggctgcgtggtccacacccgtctgtccccagtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccaggtacagagtggagccacagcagcgggggtggaaccatggtctcctggggtgagcagagcaggctccctgtctcacggattgggccctgggtagaccgatagcagcctcaacaggctgagcaggaaggcctgagccagctggtgaccccagcgtccctccactccctctccctctccttccccatccgcacgtccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccggtgagtctgcctaggaaagggacgagggatgcaggcaacagtgttccctggggagaaggaactttcaggtcagagtcctcagacctggtggtactca

SEQ ID NO: 52055 - DNA, 1060 bp, Homo sapiens
gacaagagtcccccttccccatgtgaaggacagggaaactgatccagagctgatggccaggccttgggggtcagagtgaggcagggttgcaggttataggaacaggggtctcctgagggctccctctgactcacccccattctggccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctggtgagtagctctcagggagggcagggctggggacccagggtgggaggccccccactcttgcaacggcaggatcaggaggccaagccgcagactgcacctgccttgagaccaggagccccatctcatctcacctcctagccggctattgaccctttgccctctgtccccagcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtaggaggcaggagctcaggaagcctgaaggaccctgtagctgcagtacaagagcataggcttgaccgggcgcagtggctcacgcctgtaatcccggcactttgggaggccaaggcaggaagatcacgaggtcaggagtttgagaccagcctgaccaacataatgaaaccccatctctactgaaaatccacaaattagccgggcgtggtggtgcgcgcctgtaatcccagctactcgggaggctgaggcaggagaatcgcctgaacccaggaggcggaggttgcagtgagccgagatcgtgccgttgcactccagcctgggcgacagagcaagactccgtctcaaaaaaaaaaaaccacaggctttgaactcaggcatgttcgagttcagacactgttccgctacttgcatgctgtgtgactttaggccagtcacttgtcacttgattctctg

SEQ ID NO: 52056 - DNA, 2601 bp, Homo sapiens
agcctcccaaagtgctgggattataggcatgagccaccgcgcctggccagtcatggtgtggtttaaatgagacagtgtctatggaaagtacttgtgagcacacggaagacgtcctgtagaagggaggtgtctcactgtcatccgcatccttgggcgcagcctgggtagtaaagcttgctggttccctatgggccagaggagctcatcatcaagaagtcatgggtgggtcaatgggcctccagcttgtggttagaggctggggagggaagaagccatattcggctggccatgtggaggcagaagggtgtggccctagtcccagaaaggccacctgtcggccgtccccactagggcctggtcacagcccagagccttctgccccagggctacaggttacagcccaagagttcaggcctctgagcagccgctctgtgtccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccaggtatggcagccccccgggaccaccttgctggaggggctggatgggactgttccagccccctcccaacccaccccatttgcacacagacccacggctcgctgctgcggctgcaccaggtgaccccggccgactcaggcgagtatgtgtgccatgtggtgggcacctccggccccctagaggcctcagtcctggtcaccatcgaagcctctgtcatccctggtgagtgactcccagtgacatggaaagctggaggaggcagagaggcctccggggtggtgagatccaagggacccctcttgctgacagggcagaaggcccacaccggagctggctgcagggccctgcccaggccgactccacctgtcagagtaaccaccgccttcccgtcacactttgctttggccacatgactcctcaggcgtcccctcccacctcctcttcctctctccaactcatctctgccctcatctctctcacttcctcactcccctctgcaaggcgtggcccatgccctggtcctcccatcagggttgctgagctgagggcatcaagtccaggcccccagatgcctgaaaagctggatctggccttgaaaccctgggctgagctagctgcagggtgggcaacccctgccctctcatctcaggagcatctacaactctcactcccatccccactgctgcaggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggtacagggcaccaagaatgtgggacggggccatggacagtgggttgcaggatcctggcccctaggctgaggggctggcacttcctagatcggggggacagcggtggggcatttgctggcctccgggaagcccccctcacacctctgcccacggctgcccaggttcgtggctcccgcctgtacatcttccaggcctcacctgccgatgcgggacagtacgtctgccgggccagcaacggcatggaggcctccatcacggtcacagtaactgggacccagggggccaacttagcctaccgtgagtggggccaccaggctgggctgggatgcagagaacaggctggagtggcttcagagaacaggagtgaccggtgaccatcttatccctcagctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccaggtatgggactggaggacagacaggccaagaagaggaagcgggtccctgggtggcggaggttattgggggagggctagaggctcccctgagatcaggaagccctggaccccattgcacagatgtatagtgcagtggttagaaaccagaatctaggactgactaacctgggtgtgaattctggctccaccacttagcttgtgacctcggacaagttacttaacctctctgtgctatagtttcagggcctataaaatggtaacaatggtacgtaccagccgggcacggtggcttacgcctgtaatcccagcactttgggaggccgaggtgggcgaatcgcctgaggtcgggagttcgagaccagcctggccagtatggtgaaaccccatctctattaaaaatataaaaattagccgggcatagtggcaggcgcctgtaatcccagctactcgggaagctgaggcaggagaatcgcttgaacccaggaggcggaggctgcagtgagccaagatcacgccattgcactccagcctgggcaacagagcgagactcagtctcaaaaaaaaaaaaaaaagtacctcacagaattatcttaaagattaaaatatatgcaaaatcctcagagcttaggctcacagaa

SEQ ID NO: 52057 - DNA, 1115 bp, Homo sapiens
gagacagggggcatcatgggaatcagagggaaaagggctttcagggcagcctccctgctgggaagtcacataagggcagagaaatagcccttggaggtcatgctttgacaagagcggttttcagtggagagaagggatagaaaccagattggaaggaggcgacacatgggtgggaaggcagcgagtgtggacaactcctgcaagagtcttggctctgaagggaggccaggaagtgggtcattgactgcgagagcatgaggtcaagggggagttttcggaaatgggaaatcctagaatgcactctggaccgaagtgatcgcatgagaaggaggagacgctgatgttgcgagagcagaagaagccccggggaggggtggcactcaggcgcagcagtgggatggggtgagggcaggagaaggggcctgtccttcagggaccagtatctagagagctggtagatttgagaggctgggaaaactcctgacttgtcgtttctattttctccataagtgtgtgtcagcgccactagctaagaaagtggaagggtggttggagaggctggaggagatgggaggaggtgtgaaatagttgtttttgggggatagaaactcaaaccagacggagaaacccagttggagtggggtgtgatgtgtcaggagctcattgtggtctgtgatcaggaactggagccaagtggacccatggtgtgatgttccccaaccacatcctgtggccactctgtgctggcaaggagggtggggatggtggggttcagccagaatgggggagggaggtgccagggggtagaatgagagctaggctggaccaggaaggaagtgatgcctagaggttatggagaaagacaaagtggccacaggaccggggcctagccagcaccggctcacaggggggcttcccgtccctgcagaggctccaagcaagcccatcacagtgactgtggaggagcagcggagccagagcgtgcgccccggagctgacgtcaccttcatctgcacagccaaaagcaaggtgtgcaggtcagggagtggggatggaggaagtctgtcttctggggtctctgagccccacccatgaccccctttcgccttgccctg

SEQ ID NO: 52058 - DNA, 1068 bp, Homo sapiens
gggaccatggcccaggatggggacgatgggcaaggcagggagccctgggaatttgggggatactgggtctggggacagggctgagggtggggtaccccagcttttgggagagcagagatattgaagacaatgctgaaaggcccttcctgtcccggcccccacccccagcaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggtacccatggccctaggctcctcagccccaagagccatcccagtgggaggggaggcaggggcctgtccctgccctagtgggatgctgtccttgtgcatggggctggatgtgagaaagagtgtatctgcaccaacaagctcttgtctcctccccaccaggctccgagctccacttccccagcgtccagccctcggatgctggggtctacatttgcacctgccgtaatctccaccaatccaataccagccgggcagagctgctggtcactggtgagtccctacgccccctgtaaccaagactgcctgtcctgggctgggctgcaggctgcagattcaggcagatggtgcattcacctgctgggagggggcagtggttgcccgaacaaggtcagcagccatggagatgaggagaggtggcagattcaagactcattttagaggtaggatcagcaggacttgactggtcggtgagggcaaaagaaaagggtgggccgggcacggtgggtcacgtctataatcccaacactttgggaggccaaggtgggcagatcatgaggtcaggagttcgagaccagcctggccaacgtcgtaaaaccctgtctctagtacaaatgaaaaaattagctgggcatggtggtacacacctataatcccagctactcgggagaactgaggcaggagaattgcttgaacccgggaggtggaggttgcagtgagccaagattgcgccact

SEQ ID NO: 52059 - DNA, 1257 bp, Homo sapiens
tctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgggattacaggcatgagtcactgtgcccagcccattttgctttttataaacaccacggagatgagtgtccttgtaatgaaatctttgtgcccttccatgattctttctttaagatgagttcacaaacttggaatttctagatcaagggattgcaaccctgaaaggcttctggtaaatttggcctaatggctggtgcctgccctccttgtgccctgcagcaatgccagcacaacgccgcaggggagttctgcgagctttgtgcccctggctactacggagatgccacagccgggacgcctgaggactgccagccctgtgcctgcccactgaccaacccagagaacatgtgggtaccctagctcaaggcccaaggacacacttccactggggaatgagtggaaggcgttgcactggcttttggggcagaagtgaagggagcaagatggagattgggcttcccatgacctgacctttgcctccccgatcccaggttttcccgcacctgtgagagcctgggagccggcgggtaccgctgcacggcctgcgaacccggctacactggccagtactgtgagcagtaagtttgtaaacagaagtagggggagggtggaggacaaatggtggactcccaagtgagagccttaaagggtgttgctcagaaaagtctcttctaggattatgctccttccctgcctcaaacacttctaagacacctcattgctcttgggacaagcccaccctccttaggcagctttactgtagcagtctcatcccacttctgacacccaactctgtactttagctgggcttaactttttaaatgctttttctttctttttttttttttaaactgagacagggtctcactgtgttgcccaggctggtcttaaactcctgggctcaagcagtcctcctgcctcagtgctggcattacaggcgtgagccaccatgcccagccactttttgaattcttgatgttcaggccttgcttatgctgttccctctgcatggaacagtcttcacccctaaaccacccgttcctggctaacttccc

SEQ ID NO: 52060 - DNA, 1072 bp, Homo sapiens
ccctgcatgtattcctcccgacagccctgagttacatatcattatcccctttaacaggtaaaaaaatagaggtgctgaggggtgagtgtgtcccaagggcacacggctaatgtgtggcagaaactaatttgaacctgggtctgattgactccaaagcctagcatgtcctaaccactgggcagtgcagcctcacgtttgggccacactctccgggggttaaaacccagttcatgcccttgagggggcccaccagagacagggagccaattcagaaacacagattactccggcccaaagcacagcatagagatgcctcccagaggtgaacagtgtggactgggagagggccgtgggtgggaggacagactgagcagaagtggggaaggaggggcgccggcctgtgatgttccagggtcacccctgggaggacactggagggaggggttctgggtctgctggctgtgggtggggcacgttgggaacagaggccaaccttcctctctgcccctaggactgtgcccccggctacacgcgcaccgggagtgggctctacctcggccactgcgagctatgtgaatgcaatggccactcagacctgtgccacccagagactggggcctgctcggtgagctgcaagcgaggccaggacagggggtcagctcagctgggcctgggtgggggaccagggctggacaaggcaggcatcaatccaggggatcaggatcatggggcatggcctgtggttcaaagcacctgggtcagcaggccaggtcaccggggatggtggggtggccagagctatggaataacatccttctgtgtaaagaaaactttggttctttactatttttttctttttcttaaaaaaattttttttatctaatacagatggggtctcactttgttgctcagaaggtcttaaactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcat

SEQ ID NO: 52061 - DNA, 1074 bp, Homo sapiens
gctgtctctaaaaaaataaatcggccgggcatggtggctcattcctgtaatcccagcattttgggaggctgaggcaggacaatcgcttgagtccaggagtttgagaccagcctgagcaacatagggagaccccatctctatttaaaaaaaaaaaaaagtgcctgagcaacatagggcgaccccatctctatttaaaaaaaaaaggtgaaaaaaaaaataaaaaatttttaaaaatcactgtgctgtacacacctgcaacttgccagaaagtcagtcccagaaatggctgtgaactttctggcattcaaagcaagcaggaaaccagttattttatggttatttggttccactccaaaattccttaccatgccttgagctcatggagaatatccctgtagccatgtagcccagggccgtgtgtgtaatcagcaggtgtttgataaatgctggttagctgagtgaacacacaaatgaacaaagaggtaggcttgatgcagtttggtattgagatgaatgtctgccctggtggcagaggagagaaagcaaagtcctgtgggacagagctggggagcctcagctgtccacgtgaaggtcctctgcagcagaagtaaggactccccagtcatgagcaacacagtgcccaagtccagtgggcttgtctgcaacaaagaatctatcggctcatgcaactgcagagtctaagcatgtatggtgtcaggcatggccttatccaggggctcattagggctttatcttggttctccagcttctcatctgactgcagaagggactttctctggcctggtagaaagagcataagtgcacgggttacttgtctatccctgatggggtggcaaagggcagtggtaggttatgcagattggccaggcctggctcatgtctccactatagaggaggaggggatcagggccctcagaccacatggtctgcatgtgcggagacagttgttctttatagaaaaccacggtttagtttctagaaagcaggaactggatactgggcaaacaaaaaccacctgcctaggaggcaaggcctccgaggggctgccgtcag

SEQ ID NO: 52062 - DNA, 1511 bp, Homo sapiens
ccctggggctgcctccagcacttctgcccctcccttgctgggcaccctttgtagggcttctcccatcagtcacggcccataggcagccaaacccatcccgggatatccccgcctagctcaggaggaacaagagggcagtgggtacaagggccagagtgccaggtatcagcacttgtgagcagacagtgcagagcgggtggctggctgggcccgtggggaggtgaagcctcacggacgtcctttctgtccctctctgctcccttctgccgctcttcggctcctggtcccccaggtggacgaggctcagagacggatggatgctgagatctggcagctcctgtccagctttgctgcccaaccccaaccccctccccaggggctctctcctcatccccagcctgcagctgctctgcgagcagcacctcctccttcttcttcctcctcctcctcctcttcctcagcttctctgtctttctcaccaggctctcaggtatgtgccaaggtgcccatcaagggatccccacccaccatgctttctagacttcagtcatttctgaaccaacttcaccaatttctgtgaactacttggactattatttctttccaattttctcttaaatcaatcatgtaccaactcaggctggttactctctttcaaatacatatgaaaggagccatcccattgaaattgtttactgatgtgctgtgtaaacgttggtccacaaaagagacccaccagatgggaggagaagccgacccaggccacgcccagagagagcagctggggacctgggccgggattgggaagaaagtcgtccaaagagcaaggccaggacccgcactgtcgggtgggagtggggggctctgtctctctgccctgccaccaggcctccctcccatgacggtccacccctgccggaaccacctccgccctcccacccccacccctgctcccctcggctcttaccacctgcccttccctcctagttctctctctcctacgaaggcttctctctgcttcctggaagcctctattactggcagctgccccgggccttcctgggggacaaggtaacaaggatttggggggattataggggtgtcatagaatcccaaaatatcagagggccctttgtcaaggccctttatgacacaaatggggagaccgaggctcacggtgggtagagacttgcctggggtctcatgttcaggtcagagcacagctgagactgaactcagctctgcccctgtccttcagcgggccctgacccctgacccctggcccctgacccctgtcagaggagctgtctcgcctgggagggtttctctagtgccttttctctgggcttccttgaccttgtgtctagatgctggcctagtttttggtacttcactcagtcattcaagaagcattaattatttactgtgtgctgcgtcgtgtacaggccgagtgggccctggcctcccagagctccctgtccatcccattatcattcctgtcaccatcagta

SEQ ID NO: 52063 - DNA, 1048 bp, Homo sapiens
tggcacccacgctctggggttggggttgccctatccctgttcgttggacacagccaggtactccaggcttctcccggggctggctgccttctggtcccttctcccctctcccttctggggttcgctatctcctggcctccctgctgccctgtcctgcaattctcagacctatctctgtctcctgtcctggcatttccctgcgccccacagggggaggcgtactttgcgcggatgcgccgggctcaccaggtaggcccaggacgtgcgtggtgtgaagttggtgtggtggggcgtggtgccttctcgggtgctcccagccctgcgtggggagatgcgcagtgcccaaggcattgggggtctgcatgaatccaggcggtgtcccatgaccccagggttggagccaggagggtatgtgcctcaccttgcctcacctgctgtgtggtctggtcctggtgccaactgtctgaagtcagaatggcaactgaggtagcaaggagactaacccgatgctaatccacatgactgtatctagccccccgggttcccctggccttgcctctcaagcaaccaccatgaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgcacatccctctcagaggagcagttgcgggcagccgtgacagctgggaggatcccagagcccccagagggcagggactgggcacagcgggcatcacaggtaactgaggacctggctaggacaggttgtacctagggccacagcgaggagaccagagagctgagtccaggcaggcacctgagcgaagactccagctttcctgggccatttcccctatgccaggccaggccccagcctgatgcctggtctgctctggtgtctcccctgggaaacattc

SEQ ID NO: 52064 - DNA, 1846 bp, Homo sapiens
tccagggcacgtccctgctcttctctgcccagtttccccgtaacatgggcgagtcaggctcttcttttcttccagtgcatgaggccattgaattcaatatggggccctcagcccagccctggggttctgcttcccttcatccaaaattcatcagaggctttttctctctgcaggtgcgcccctggctactatggcaaccccagccagggccagccatgccagagtgagtaggattggggaggtcattggggtcgggttacccagagtccctagggcggagctaggacagaagcctttactcccctttggctttgcctgtccgagcctgtttcttcatctgtaaaatggggataggagaaggccccaccacctccgagggctgtcgtgagagtgttgagtactcacatcagaaatcagagctcccgctcagtggtgagcagagtggagggaagaggggtgctgggtggcgggtttggggctccagccatggctttcttccacctcaggagacagccaggtgccagggcccataggctgcaactgtgacccccaaggcagcgtcagcagccagtgtgatgctgctggtcagtgccagtgcaaggtcagtccgaatccctgtccctgcggggcctgctctgccccgctgcccagaccctgcggggaaatcaggcagcatctggtggaagccgagacctgggcatggggggcagggcatgggggacagggcaggggctgcccggggctgctggaagtggccagggaggctggcctcaggctgctgggggtgcaggagacccactgagtcccctgcctgcctccttccatccgtctacccaggcccaggtggaaggcctcacttgcagccactgccggccccaccacttccacctgagtgccagcaacccagacggctgcctgccctgcttctgtatgggcatcacccagcagtgcgccagctctgcctacacacgccacctggtgagagcctgtgctgcccagccccaggcggtgttgccacctgctgcctgttactgtccatctgagcactgagcccagcgaccctcatccccgcctcagtaccctcacatgcccccattatttctctcgcagtcctgatctcaacaggaccccattccgcaccttaacaccctcccgtgccccatcccccaccaaggcaccccggtgctcaggctgacgccccctcctttttcccctgccagatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtgggccccagccaagcaccagggtcagccgtgactcagacatgagttcacctctgcgccgtctctcagcaggcaggcacctgccacctgcatggccatatcgtggttaggcacgtggcttttgcagtcccatagacattggtctgaaccccagctctgccgcttgccagccagacaccatttgataaacctcaacttcatggtggctgaggggattggagatcgtgcctggcacataataagtgctcagctgttcatgacttttagctttcatgcagttattctacaaacagatctgggagaggccgggaaatataaagacaagtgagacacagtttcagtgtcattcacgtgcccgctccgacttcactcatccacactgctggctctgtgcttgtgttggacacagtaattctcatgataggtcatgtgtg

SEQ ID NO: 52065 - DNA, 1215 bp, Homo sapiens
ttcacaaggagagggacgcaggaggggggaggggccatgcagggatatggtttcaggtcaagtctagccccagcctcagcccacagggagctctggagagtcattcgccggagagtgatcgttctttcaggcccgtgggctcttgtagcctgtatcagcctgtcattggggaccccaggggaacgaggtggtataacctctccaggtgaggaagggtgatggtttggagtaagttgcaggtaacagctgtttgccacggtcctcgcagcctctggagatctggacagggccccagcagcactgtgacagggctgtcgggaggactaataagaccctgccagtggaggactccaggcgtgcctggcacagagccagcactcctattcacgctgggtcttgtcacgcccagggtctctggcatcagcatggacgtggctgtgcccgaggaaaccggccaggaccccgcgctggaagtggaacagtgctcctgcccacccgggtaccgtgggccgtcctgccaggtgagtcctgggccccacgccagcccagccagccccctccatggtgcttcccgctccttctccatgagccctccacacctccccagccctggccatccagtgcccctacctgaatgggccgtgttcggaagtccctcccactgccatctttctgcccccaggactgtgacacaggctacacacgcacgcccagtggcctctacctgggtacctgtgaacgctgcagctgccatggccactcagaggcctgcgagccagaaacaggtgcctgccaggtaagtcccgccctccttccgcccaccccagcaatctgtggcctctggaggcccagcctcaactcacatcctgctcctccagggctgccagcatcacacggagggccctcggtgtgagcagtgccagccaggatactacggggacgcccagcgggggacaccacaggactgccagctgtgcccctgctacggagaccctgctgccggccagtgcgtccagtccctgcctgcacctgcccttccctgaaatgtctaccacccgctcccacacccgcttcatccagggcccttctgagaggcagtggttaaatcctggccttactgcctgctcagtgtcacttggtgtgagatacacttcactttcagggcctcagctgcctcatctgtgaaatggggtagtccaccctcctcagcccctt

SEQ ID NO: 52066 - DNA, 1917 bp, Homo sapiens
tcaagaccagcctggccaacatggtgaaaccccatctctactaaaaatgcaaaaattagccaggcgtggtggcgggcgcctataatcccagctactcaggaggctgaggcaggagaatcacttgaacctgggaagcagggttgcagtgagctgagaccgcaccactgtactccattgtaggcaacaagactgaaactccgtctcaaaaaaaaaaaaaaaaaaagaatgtgagtatcaagtgtcggtgtaaaaaagaatggatggattctggagtcaggcactcctggtcttaaatcccagagtggatgggcaagctgagtaactttgtgcaagtcatttcacatccctgagcctctgtttcctcatgtgaaggatgaaggtatcacctacctctcaaggtccttaggggagttaaatgaggtgatgtcgaatggaaagcagaacagtgcgtgaaacactccataaatagaagcagcaattatttcaatcaagtcgctgtatttcaagtctaaatttattggtgaaccccctggcagccaaagagaaaagggaaaaatgcttgcctaagtgcttgttaagtgggaattactattcagatggcaatgacgcctcatacatgtgctctttcttttcttttcttttctttttttttttttttttgagatggagtctcgctcccatcgcgtaggctggattgcagtggcgcgatctcggctcactgcaacctccacctcccggtttcaaacaattctccttcctcagcctcctgagtagctgggattacagctgtgtgccaccacgccaggctaatttttgtatttttaatagagacagggttttgccatgttggccaggctggtcttgaactcctgacctgaggtgatccacccgccttggcctcccaaagtgctgggattacaggcgtgagccaccgcgcccagccacatgtgctctttcagtggctcccctgggtcttgggttcttatctggactgagggtggattcggccagagctccaggcagcctctcccatgggctgtccttcagctccaactctgtgcctgcagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccaggtacctctgcaaggtgggcgggcaggaccgccaagccctgggccggatggaccaagcgccagtcccaggccacggcccccatcccagccctttctcctcctcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgggtagtgggtggaaaggcaaaggaaactccaggcagcaggaacagcgcaggcaaaggcttggaggcgggagggtcgtggtgccttgggagaatagtgagatacactgcatggaaaaggtggctggagcagtgacagggcccgaattcaggcctccgcaagctcctgtctaaccctggtcccaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggaggtgagcaatactgtcccctgggggtaggggtgcgggcaggcccttgctcctgcctctccg

SEQ ID NO: 52067 - DNA, 1952 bp, Homo sapiens
tttcttttctttcttttttttttttttttttttttgagacagagtcttgctctgtcacccaagctggagtacactggtgtgatctcagctcgctgcagcctccgcctcccgggttcaagtgattctgctgtctcagcctcctgagtagctgggactacaggcgtgcaccaccatgcctgtctagtttttttatttttagtagagacgaggtttcaccatgttgggaaggctggtcatgaactcctggcctcaagtgatctgcccgcctcagcctctcaaagtgctggcattataggcgtgagccaccacacccggcaaaaaactgcattttcttcactttggaagagagatcaaagttttctcgaaatcaaatttccactagaactttcccacctttctggattgctgcccctcaagatgggtgtatcaggcaggcccaggctgcagccctcagcctcccccttgccacccacaggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtgaggggcctgggctgccaccctgggtggggaaagaattcctgtgggctctgctccttctgcagttggtggacaacaaggcagacttggagggaaaggtgttaccatgccccgatgcagccccctgtggcagcggctcatccattcagggcaggacctctcccctgcactgttggcttgggaagaagagctggcctcccctcctcccgggagccctccctgaccactcccccatgcctgggctgggttctgtgcctccgcactggcttccctgggtaccctgtgcactgcatgattccacaccctgccatggaccaaacaccctagagtcagggcctgagtctcgcccatctcggtttccctgtgcctagctcagtgcctggcacacagtaagtctcaggtaggcagagtgagggaggagctggaagactataggcacctcataggcacgaggtgtcaagtgtgcccacagctgcccgtgctgatccaccctgttgtgccaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggtgggtggcgcctgagcccttagggctgggagcaaagggggatttaggctgggtaggcactgatgtgtgacccctgccaccttcacccatacccaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctggtgagtagtgccagcagacacttgaacactaaaataggagaagggacaatgtgtgagattccctgtgttcatgagctcagc

SEQ ID NO: 52068 - DNA, 1114 bp, Homo sapiens
ccaggtggtgacacctccccgggagtccatccaggcttcccggggccagacagtgaccttcacctgcgtggccattggcgtccccacccccatcatcaattggaggctcaactggggccacatcccctctcatcccaggtgcggctctgggcccaggtggtggggtgggaatgaggggcagctggtccagagccctaggccagatcctaccacttgtcttggggctcaccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggtactgccggagggcaggtgtcaccgggtgtgggggcagagccgggctgcccaccacagccggctgcagcccccgcccatgccgcccagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgcgttggcgggcgggtgagcgctgcgggaggtgggaggtgggtacctctgtacccagggggcacagaggatagatgcggacagagggggccaggtttcgggaaggaatgtgagtcgctgaagaaacactgagccctgtcaaaaaagcatttcggggggaaaaccaagatgtttaggaagagccaaatccccccttgctacctacctgcttcaggttacggcgaggacgggccctggagccagcttccagcttcagatcctgacgtggacgctgtccacctgtgtcctgggtcaagttacccactatctcgtgtctgtttcgtcatctgtaaagtcggggggtgtggaataataactacctcctaggggttggtaaggacttagtggagtcacgtatgtaagcctctcagaattgtgctcagcgcattttcagcacccaggaggtatttgctaacgtcacagtcattgtcctcattctgagagacagagg

SEQ ID NO: 52069 - DNA, 1050 bp, Homo sapiens
accctgtctctaaaaaaataaaaaagaagagagaaaaaaattttttaaaggatggagaggaaagaagggtgtgggcaagatggctggctgggcacagcccaagacagctgggcactcccttctcccctccttctttgtcctcactgggccaggctgtggcctgcatgtgtgtggtgtggtggttgcatgcgtgtggcatgtcaactgtgtgtggggtctgttttagagatgggggaggccactgccgcatgtcccatgccccacgtgtgctgtggatgtgtctagtgtgtgctgcttgccctcgttgtgcctgccagaaaccgagctgcctgacacagggccctggagcccactccagccacacagcacctacagcttcccgcacctgcctcctgccgcctctgactccagtctgcttcctttccacctgcagtgccccagttcccaagagcctgcacggaggccgagtttgcctgccacagctacaatgagtgtgtggccctggagtatcgctgtgaccggcggcccgactgcagggacatgtctgatgagctcaattgtggtgaggggatgtccggggccacgagtggtttgggtgccaggggagggccagggtcctacacctgggtcttggagcccatcaaggactatgagggtttggtgcaggcagaggatgggggcataggaagggtgatgacagagccaggcagggggtggcagggagtggtgttggggagtacagggtgggcctggggagggttggggacaaggagcaggtgaggagccatctgcttctgccaaatgccaagcggaatctatccacagaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggact

SEQ ID NO: 52070 - DNA, 1487 bp, Homo sapiens
agcagggcactgtgggagcccaggggagcggtctctaccccagccagggcagatcaggaagatcaggagacaatggctgagccaagtcctgaggaatgagtaggaactgaccgaggaaggctggcagagcctttcccagtcacacgcaggtaatccctgtgccaggccaactccctctgggagccaccccttcttgtccagccttcctctgaactgtgggggtctcctcttttgcactagcacttggtttctggatcaggccatttcccctgttagttaaagcccctcagtcaagttggggccttggcattgacccctgagcatgtatacctacaggcagtcctgggtgtagcagtgggcacacaggtgtcagcctcgagggaggcctctgggggccatccccccaactctgcctgaatggtccaactgcctaaggccactagatgccaggctggggctctcaaaatgatcctccttcgattttccagtttatttccgagccctggtgaatttcactcgctccatcgagtacagccctcagctggaggatgcaggctccagagagttccgagaggtgtccgaggctgtggtagacacggtgaggtgaagggggtttgggaagctcgcgggtgtggcggggcaggaccgaggatggggtgaaggcctctggggctgatggcactgtgtccctccccagctggagtcggagtacttgaaaattcccggagaccaggttgtcagtgtggtgttcatcaagtgagaaggggctccctgggggctgctgggggacttgagcgggtaacctggagggggctgatgaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccgttagacccgagttctgctccttccttctagacctctgcacattgacaataggtaatcaggcctttatttatcctgtacttccaagtccaa

SEQ ID NO: 52071 - DNA, 1632 bp, Homo sapiens
atagcctcccctccctaggaccccttcccacgtctcctcccccagtttctttccatgttctgacctgtctctttctgtcttcccccatgcccgtgtgtcctgctctgacccttgtcggcatgtctgtgtgtgtcccctgtcctccctgccctgggccctcttccccactccttgagtgtctgtctctgcgcctcctccctctgcctcatcctgttcttctccctctctctggctcaccatctctgcttctgtcgccctctgtctttccctctctcccctctgcctgttcttttttttttttctttttccctctgcctttttcttcacctttgtcttaccttttctctctcattctcccccgccccactttctttatctctgtctctgtctttctgtctctttgtgtctccctctctcttgcaatgtctctgcctctctctctgcttctctccatctcgtctccctcgctgtcaatgtcccttcttgcctccttctctgtctctactctgcaggctcagggcagcccctgggccgcccgcccgtggctggcatgatggtctcggagcctgatgaggagtcccctctcagtaagtgacccaggccctggccaggtgggagcgctgctctccctctgcctccctccccatcctctctccccactcttccttttctctcctttctccctgttctcttcctccccaacctgcactttgctgcgagtcacacaagaggctcagaggcacctccctgcagagtccaggggctaggccagccactgcccctgcccaggacacagccaggcccaccctgggcccacagatctaaacacagtgggctggaaccctggcgggcgttcttccccatggggtgttgacgggcagagatgggtgcagcagccctgcagggaccaggccctgcattccagaggccacttgtgtccaccccagcacaggccaatcctgggcccacccgagggacccacagggacccagggctggagttcgggggcctgggtgtgttgcagagagttctgttgagcagggatgggaatcaggagttggtgagtagcctgctccggggccagggctagtcaggtgtgcagcccccacttctaccctgagtgcagggcagctgtctccctctcccggcctctggctccaagggaactcaccagatagggtgagaggagggagaggactggccagagagcacccctattccaaggcagcctcgcccctgctggctgcaccagtgtccttggctctggaggctggttcttttttccttttcttttcttttttttttttttttttgagatggagtctcactctgtcacccaggctggaaggcagtacagtggcacaatctcggctcactgcaacctctgcctccctgattcaagcaatcctcctgcctcagcctcccgagtagctgggattacaggcatgcactaccacgcctggttaatttttgtattttcaccatgttggccagcctggtcttgaactcctgacctcaagtgatctgccggcctcggcctcccaaagtgctgggattacaggcgtgagccactgcacccagcccgggggctggttcttgaaatagaggtggcctcaccttctgccccagtgc

SEQ ID NO: 52072 - DNA, 1330 bp, Homo sapiens
aaggtggagcttatcctgggctcggcagcagcctgaggtcacgtggagttgacaccacgcctgtccccattcagcccagatactgagctctgcctccgcgctgctgggcccagggatgagcctgtcagtgtggctgcatgtgccaaagctaattctccaacacagtggaatgtgttccctgcagcctggagacgggcaggccagagtgaggcaggaagaggagccaaatggcctggggaggagctgcctggggaggcaacggctttgagcagctcgcccttgacttctgcctgtgtccccacccatgctgaccctggccagccttccacctgcctgtgccccccatctgcgctgcccgaggccacccctttacccgcccgcatccccccatccactcactcatgtcctgggtgtcccttgccttctccaaaggaaaaggagtctttacttaccaaagtgatttacattttattgtctgctttatttgaggattcattcggaaatagcagggttgggctctgaagcctccaggggctaatgggacttggggaaactgaatcaaaagggttcagccccagcctggctcactgagccatactaagtcaaatttaaccactaaggggcctgaaggtgggattctgggtccccctggaagtgaggggaaggaccgtggggctcagtgggagctggagagagtgactcaatcagctctcgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggaggtgagccaaggatccaaggctgggagcagaggggtggggggtgagactgtgcttcttcccactggcatgggggaggagggtgaccgaccattccgagctttctcaaccctgtcccactgtatactaggtgcccagaacagtgcctgacacccagtaggtactcaacaaatacttgttgttgctgattacatctcttttttgcttatagacgacctgggcagtggggacctgggcagcggggacttccagatgggtaagttgctgcaggcctcctgcaggtctccctcctgtcccccagggaagccccagagccagtctcctgggctgagggctccttgggcctgccctggggtacaaagcaagaagaagtgggtgtgatctcttaacctgctgagtgacagttgtgcagactgattggcaggtccctgcaaggctggtgtggccaggtcctgtgcttgcccatgccaca

SEQ ID NO: 52073 - DNA, 1048 bp, Homo sapiens
tggcctttgtgtcgggctctgagcccctggcagtttgtacaacaaagtgctgccccgacagattccttcctgtgtgctgtctgtcgcctgtggacagggcactgggtggcctgggggtggggcagggcaccttgatcctgtgtctggggcctgggttgcagccgagtaggggaagcacttgttttggggttacctaggagcctgcatcctggcagagggggatggggaccttgtctgggttcatgtccctccccagagatttggggaccatgggtcacattgtctgctggttccttggcagtgggcaggggaaggggcactgaggcagagcctgtggtgaccgtggcagggaggcaggtgggcaggcaggagctcttttgtccccccgcccctgcactgtctctggattttgatggggtgagctcactccatccccacatgcctggagcctggccctgggcagctgcagccgccctggggactgtgcagtgctcagaccttcctgcctagctgcgggggcagtcgggggctcagtcccaggcttgggctacaaggagggtggggtggactggctgctgaaggcatgtgaacaatgtgtctggagaagcccaaagccctgggttggtcccagagtcagcctctgagcaggcagacaactttgagccataggacccaattctattgcccaccccttgctagggtcctgcccactcagccaggctcctcccttcatcccagatctggaggcgaccccaggcctgagcccacacctcacactccgcatgcatcacccctcaaccacacctacccctcacccctaccatgcaccctctgcatgatactaatcctaatgcttattaagcacttactgtataagtaattctagtgcttattaagcacttactgtataagtaaacgcctcactaagtgccttacctgcttgatcccatttacccagccgattctctctgagcctcagtttcttcatccagaaaacggaaataataataacacaagctcacagtttcttgaccgaaagcctcagagt

SEQ ID NO: 52074 - DNA, 1049 bp, Homo sapiens
ggactacaggtgtgcaccaccacaacgggctgatttttaatttttttgtagagacagagtctcactatgttgtccaggctggtcttgaacgcctggcctcaagtaatcctcctgtctcagccttcattaattaattcaacaatttatttttttagatggattttcactcttattgcccaggctggagtgcaatggcacagtcttggctcactgcaacctctgcctcctgggttcaagtgattctcctgcctcagcctcccaagtagctgggattacaggcgcctgccaccacaccaggctaagttttgtatttttagtagagatggggtttcaccatgttggccaggctgctctcgaactcctgacctcaggtgatccacccgcctcggcctcccaatgtgctgggattataggcgtgaggcaccgaccatgcgcggctgaaaggtgacattggagcaaaaactggaagaagtggagcgagtgatggaatatgtggggacagtgtcccaggcagggggcttggtgtgtttgacgactattgagaggatgcatgtggctattttagaaggcagggagttgggggagcacagtagcaaaagaggttggagcgtggcgtgtgtgtgtgtgtgtgtgggtgtgtgtgggtgggtgtgtgtgtagacagattacatagaacctggttgaccatgattgtgtgtgtgtgtgtgtgtgtgtgtgtgtgtgggtgggtggtgggtgtgtgtgtagacagattacatagaacctggttggccatgataagggcttttcctctcacccgttggtgagtcaggagtcgtgggaaggcctaacccgacaggttcaggaagcggccgtggttgttagtggtgtctcatggcaacataactttgtggaacattccgcccatccttccatagtcctggcactgtgcaaggggcatcattcatgaaatctgtgggcagtgacccaggagggtatgggcaggcccaaccaggttggtgtgcccttgaagccccacagacctgccagggcagcagggcagctgggag

SEQ ID NO: 52075 - DNA, 1087 bp, Homo sapiens
ggtcttacggagggcaaggccttttgttccccagggaggaggcccagtcagagctttaaataccccgtgcagcccagaatagcccccattgtgttggtctgcagctgggggacccagggaggaaccaacatcgccatggaggatcctgagggggctgattctggcagattctggaggtggggcggggaggtcttcaggcacttccctatatggtgcggtggcatttctgtggaaggcttttctagtctggctcaggcaggaaggcctgctttgtgggaagggtggagcagcagctcaagttctgcgtgagcaacgtgcagctgaggggggagcctggtgggtgggggactcccagggacggctctgtgcctgactgaaggtgcctctttgtgcaccagaggtatgtgtgcattggcccactgggccctcctgtaggtgggcctagcccaggcccttgccagggcctcttggcaccctctcctgctctagctattttgggcactggctgtgttcgggtttggggagtgatgggtaatcctgcctagaccaaggctgctggggtgaggttggtggggtactgactggactgccattccagctccctgaatctttgatcactgtagcctctgcccctggcttcagcttcaaagggtcatggtcagcagactctgaggggatgccagccccactgatgaggcagagaagggtgccagacaagcctgtcccttgggacattccctgctctcagtatcagggatagttgtgctttttctaagcaactggtttgtttttacattgtgagacatggaatctagggactggtcaggtttccttcttcccattggctgctggcaagctcagggccacatgagttgtccctttcctagatctctgggattcagcatgtgctctctgtctgcttgcctcactccaggctccatctgcctgccctgcctgagtttttcttatatttctttagttaatattctcttggctgttaagtgtgcatctttgtaagctgtctgcagcctttttggaacagggcaagaggggaggtataaatgaatgatgaggatgatggtgatga

SEQ ID NO: 52076 - DNA, 1982 bp, Homo sapiens
cgtgagtcaccgtgccaggcctttttttttttttcttcttcttcttttcttttttgagatggagtcttgctctgtcacccaggctggcatgcagtggtgtgatctcggcttactgcaacctctgcctcccaggttcaagcaattctccttcctcagcctcccgagtagctgggattacaggcacacaccaccacgcccagctaattttttttatttttagtagagatgtggttttaccatgttggccaggctggtctcgaactcctgacctcaggtgatccgcccacctcggcctcccaaagtgctgggattataggcgtgagccaccatgcccggcaaaaaattcagtttcttgatggtactagcctcatttgaagcgcttagtagctatcttattggatgagtgcaggcacgcaacatttccattgcaccagaaagttctgtcggaagcgctgtgtatgttaagtgctgggtattgctggaaggagttgctgtggtcattatccctggttccctgtcccatattggaaccgttccagctctcattggttcttcttgctgctcctctctctgctgggctcttcctgctttcttctcggcagcctctcactctccctttgcctgaccacacccataatgtgaaaaactccatgacttgccttcatccagctcctctgcccctgttattttcccacgtgctccctgcagcctgtctgcatatctgccctttcagctgctggcatctggaatctccatgtccgggctccgaaattcccactacccattcccagtgggagaaggggaggaggcctcccctggcagtccctagtccccagctcccagcagaggtgccggctgcctgggccccttagcggtgtagagatgatggtttgttgtgacgggggcaccctgcccgctctaacgcgcccgtatcagggcgccaagtgtgctgtttgcacttggctgggcctcacgatctggccgggtgcccgtgagggctggcccgctggcacccttggtaacaaaggtaacaaaggccaatcatggaccctccgcctggtcaggaacataaggagccggtcctgggctgggccctgggggtgagggacgtctgacacccagaaccagagtgcaggacagaggccgtggctgtggctgggctctgggtgctgagtgggacaaggcccaggcaggcataggcaggatgtgagcttttgggggtcaggcaggtggttgctctgggcagttcaggtgggcagggtctgcacctggcattcacacctgcccggggaggagctttggcctgagatgccagagaagctcaaggtcacctcccagcaccatcctttctcctccccttccttttggggaggagaaagtcatctgcgaagtggatggaacaggcatctctagcccatgagtgacaaggacattgaggccctgcaaggagctgcagctggtctgagatcacatggccaatccctggaagaatcagagcttggactcagacacctgcgcttttctacctttctgctcctccccatgggagttgtgaagccagtcgtccctggacacctggctatggagggtcagatcctggccctgccagattctcctccgggggatagagacaattacacctagctctcagggcagtcatgggggttagataaccggcctcctggctgttttccaaaacattctgaggctcctcctgcctctggggtctttatagatgctgctcctggtgcctgggtgctcttcctctaagtatgcacctgacttgctctgtcagcatcaccctccatacccagggaaatagcaaccctcaacaggccactccccgtcccctcaccctgctgtatttccttttcagcactctcaccatttgacatgtatatttggggtattaatttatggtccatcggtctccaagtagacggtcagcaccagcaagggcagagaacattgtgtggctcata

SEQ ID NO: 52077 - DNA, 1747 bp, Homo sapiens
tcccattttacagaggtacacattgaagttcagtgcagggaagggtctggactcctctgctgggatcacaggaggctcgggaagagccataagaaattgagtcctcaaacttataagccaatattataattcagttcaacatagtaagtatttgtttattatcccctagctgctggacattaggaagtatctaaaggttgaatatatacatatgtttaaaagatgaaaaaaaaaaacttggtgtctgtccccaaggagctttggttccagcaggagagaagagacagtaactcaagtgattataattaagactgaatctctagtgttctgaggtagaaattaagtccacatatttgtagggagaaggatgtctttataggggttccaaaaagtctttagagtggaggtggtgattgagtgggccttgaaggatggatgaatagattagctcgaagggcatgggaacagcattccaagaagagggaaccacatgactaaaggcctagaggcaggcaaatgtgccctgtgttaccctgagtgggtgtcgtccagttcttaggagcctcagggggctgatgggtggagaagtccaagcccagcttttttgccattgaagattctcagtgttcttaaagacatggcttctcgaccaactgggactgttccatccccattctgccctgtcttttatttttatttatttatttatttatttatttatttatttatttatttatttacttttgagacagggtcttgctctgtcacccaggctggaatgcagtggcacgatcatggcccactgcagcctcgacctcctgggctcaagtgatcctcccatctcagcctcccgagtagctgggaccataagcacacaccaccacacttggctgatttttgtatttttcatagagacggggtctcgccatgttgctgagtctggtcccaaacttcttgggctcaagcaatccacctgtctcagcctcccgaagagctaggattacaggcatgtgccaccgcgcccagccattctgccctttcttagtgtgaaaaaatcaaagacctttgtaaacaggcggtcagaacttctggtcagcgtgtgataactggtgtagctgacagaattcaggccaaaagcagacagacttgatatcttgattaacgaggcagccttatcaccacacatgttcgatttccgttagccgtttccagccttgacaataaccatgggtggggagccctgtggcagagccaggcctggttccgattttgcctctgcagcctacagctgtgcagccttggcaaacctcagtttcctcctttgtaaaatggagatagctccatctccagccttggcctaaggatcaatgatggtataatctgcactgtctgatatggtaactgctagtcacacgtgactatttaatgcaaaatttaaaattaaataaagttttaaataaaaattcagtttcttttttttttttttgagatggagtctcgcactgtcgcctgggctggagtgcaatggcgcaatctcggctcactgcaacctctgcctcctgggttcacgcaattctcctgcctcagcctctggagtaacggggattacaggcacacaccaccacactggcaattttttttgtgttatttatttatttatttttattttttttaagacagagtctcgctctgttgcccaggccggagtgcagtgacacaatctcggttcaccgcgagctttgcctcc

SEQ ID NO: 52078 - DNA, 1054 bp, Homo sapiens
agatcaaagctttcagccggcctgggccccacctctggtttcacctgagcaattgaagggaattctctagctgggaggactgtggcctcctaggcaggggggttttaggcagggccaccttcctccaagaggctccaccttacgttggcttcaggtgcttcctccttccccccacacctccacctcatctcccagaagacccaccttgtgccctgacaggtactagaagccccaggggccacctttacttcatacttcaagtggtggggggatgcaccctctctagcaacaggactctctcctgctccctccactgccctctcatagtttgggtttctaagcccaggacacttggttttagaaagaccaggaggaccctggctaaggagctgaaaggcttcagaccgcccagaaaagagcccagagccgccttgctgtggctgttagctcccgtccatcaattccgcaccgtttcattctgcaggttgcactttgggacagtgtcataggcaggaggcatagccctgaggcctatcctagcttcatcactgattgctgtgtgaccctgggcgggtgagttcgcctctctgagcctcctctgtcaggtgggaatggcaattcctacactgcagggttttggtgaagattagagatcatataaatagcctacagctggaatgggcagttgataaataacgggaactattattttgtgattttatctttcctccttcgagagagcccctggtacttggtcctagataaacctctgggtctcagttctattgtgtcgtccccctgcaaccccacctgccacctcacccccgctatgggaaggccctaagtcccagagtccatcctctcctccaacactcttttcttatgggatcttcataatgttgggaggggagcaaggtgggaaggagtgtgagtgcagggggccgaaggctctgtaaatgctctcagggaccttccctagggatagcaggttgagccttcctggacagctggtggtccaagctttccctctccactgccagaggcctcaccaggc

SEQ ID NO: 52079 - DNA, 1042 bp, Homo sapiens
agcctggccaagatggtgaaaccccgtctctactaaaaatacaaaaaagttagccgggtgtggtggtgcatgactgtagtctcagctactcaggaggctgaggtaggagaatcgcttgaacctgggaagcggaggttgcagtgagctgagatcatgccattgcactcaagcctgggcgtcattgcgagactctgtctcaaaactacaaacaaacaaacaaattcaagtgagcaaattaatggctttgaggaagccagcaggccaagaaggcccaggctccttgctgagattggaaaggggcgtgctctggcccctgcacttgggagctgcctgcccagccatgctctctgcagggccccagaagatgtgggacaagctgggatgtccactctgccctttttgacttgtctgtgtcctcattggtctcagagccacttccctgggcactgtggtcaagggaaagatgtgggctcaaaaggccctgccttcaagtcttggcccagccctgactggctctgtgaccttgggcaagttgctttacctctctgagcctcagtcaaatgtgaaatggggaggcctgcttcctggtggttatgaagtaaccaggtggatgcaccttgctcagtgcctggaatgtggcaggtatttgacaatccgtgattgcactaagtctcgttcctgctaaagacaaggccggtggaatatctgaggcagggttcccagggcacagccgggcacgccttctctatgacccaggtcctgtactgggcttgttgaatgaatggctgtgtaaggggattgtccattccctgggcctctttcgcagtctcagagctccgggtgtaactgcctctgatctgtcactgcccctccttcgcctaccgaggccgcagctgtaggacagagtccatccttccaccctgattgctccttcctggactgggagaaggaggggggcacaccccagggtgtggcctgggaaaggctggagtctttggacgccttgtccccttcccagatgtgtgcagttggtgggctctga

SEQ ID NO: 52080 - DNA, 1039 bp, Homo sapiens
ctgcaccctcagactacttggggtatatgggaagggttcccagccctggcctgttgcccccctccccttcacccaatccagtcccagctatgaggggtcagactggaggaggaagtgaatatgacttggttccccggcagcttcccaagtatctgctgggcctacctctccctgtcccagggcctaccctggcctttttctcctctcgctcctgctcctgccaagaagagggaggctgcgccgagggtcccggccctgctggaatgttgcttccgcctgggccttggcctctttggccctgccaccccctcctgctcccggggccagctgccccagcacccagagctggctgactgaaacccagaagtatgtgtggaactcacttcgcggggagccgccggcctcactgcccagcctggtggcgtcagggctgtgtcaatagcagccttgagaggggtgtggctcgtggctgctggggtggccgggtcgggggtgctgtcatgaaagccctgagaacaaggtggctctttgaggcctgggaatgtgaggcctttgagtcttgctgcccccagaaccactctcccttcccttccatgatgctcatctgtgccaggcctgcaggaacctcagagcatccctggaggcatctgtggcatcctgagatagccttaggaccagctcctagctcctgaccagggcccattccctgagccatgaaggagggtgtcctgttgctctgggttttaggggagtatctggtgcgcaaagccttgcagagtgtgttgaatgaatgaatgaacaaatgatgtatgtgattaagcgttttttaaaattcatttcacaaatatctgtggagcatcttctatgtatctgactgtgttctagatcttttttttttttttgagatggagtcttgatctgttacccaggctagagtgcagtggtatgatctcgccgcactgcaatctctgccccccaggttcaagagattctcctgccttagcctcccaagtagctgggattacaggaacacgccacc

SEQ ID NO: 52081 - DNA, 1039 bp, Homo sapiens
ggcggcgggcgcgctgctgctggcgctgctgctgcacgggcggctgctggcggtgagtgtgcggggcagaggggcggggggcgggggcggaggggctaggggcgccccggtcccgctcgccgcctcccgccaacttggctggggcgcccaaggctgcgcggcggggactctggcccgggacggcggcgcccgccggggaccccgggccggcgccaccctgcggcatggggctaatccaggggggccaccagtcaggacccttcgtggggctgggggcggggctggcccgtgtgggagcccgtgggtctctcggccacgttgccgagtgctggagtctcgctgggcatggtccggcctaccattcctggggaccaggaggggaaactttgagcagggtgggaacttggcaggacgagggaacccttctgcgccagcttggcagaacggccactcagtggtgatggggaccctatgagtctcgctgaaactttaccacaccgtctatcaccttggggagcttggacccaggtaggcacaagcaaaacttttgggacagaactgaagcttgtgtggaacacccacgggccttggagtcatacagccgaagagttgaatcaatccctgcctttcactgagtaactgtgtgacctggggcacgctagttaacctctctgaggccagccccacgtgggtcaagggaactcaaaatgcacggcctcaaaatgcatagctgcagggcgttgctggactgcgtggaatgagctgcaaagtgcgtggtgcggggatgcagtgcacccttgggggacccgagttccccagctttcctcttcccaggtctccaagaggcagggagaggcctgcccttgcagtctagtcccctactctgagcttaggtggaggaaaagggaattctacggtcaggaatcccgaggcttagaaggcacttggccagcagaggccctgaggacctgagtgaacttgaggaggactgggtggggtcggtgggcagggagctagtggcagatgtgggtgggggcac

SEQ ID NO: 52082 - DNA, 2003 bp, Homo sapiens
gctgatctggaatgcctgaactcaagctatttgctcctgttggcctctgaaagtgctgggatataggcatgagctgctgtgccgctgacaggctttcttggaagtaaaagactagttgtgcttttatttatagatgtattttaaatgcacttctctattgttttagagtttttttttttttttttttgagaggatgagaaacaatgagcaccttaggctacagggcttcctttgaaggggagagagggttaaatattgtgttaacatatcttccatgaaaatatctctctgtattaaaaggcttcattctggaattttatggtaatgccttattcagtgttctcttccacatagatttcctcattagattgtaagttctgtgagggcagggctttggcctggcatggtcaccccattgctaatgcctagaatactgccatacatacagtaggttttaagaaatattttttaagtgaatgaatttgatgatgtctgagggttaacgttttccctaatattccatgggcctttttgctgtgtttcctgagacagcttttgtgcttggtcagccatatctttatttgggctcattgaagtagtgattactaatctactcttgcttgactttttccatctgtttaggtcagtatcttctgcagctgcactgtctggacaatttaccatcacttagaaaatctgtgatgactactagttctcttactctcctaaaaattattcacttaatgtttgtttccttatcttcctttatttctttgtttgcaaataacttttaccgcttgttcactactgtatcagattcctggtcatgttatgctttgtgtcttactagtttctacttttagtttctcataccttcagtccaaaatatttttactaaagcaattttcattacttgccatttcagctacctctgctgctgctgctgctattttaagtcctgaatgtcaaaactcttctgggacattgatctcaaactgcttattccgtgaagtgaaaccaggctttctgccaccaatgtggcgtccctttttgcaattttagaaaaatattttttaaatcaaagatttggcattagccattatactaaagtccagaacaatttctaatagagcagaaaactatattgttcagccatggtattcactaagcactggtgctctatcaccttaagacaaagtctgatttaggctctgttactgttgttctgtaatgctttacactttaaccttgcatccttttctgtaaaattaagccattgccatttgccatttcaattctgctgtgtgttcttgattggtatattgctactataatgattaaaagcatagactctggaaccagactgcctgggttcagatcctggttctgccacttattaggtatgtgcagtctaagtaacgtctttgtgactcaggtttacttcctctaaaataggggtagcagtagtgcttacctaacagggctgcagtgttaggaagattgaattaatatatatgaagtgtttaggactgttcactggcacatagtgagtgctgtatagatttttgctcttggcacaactgtgaggacccttccccgccatctttgagaagctgtgtttctctcaaacataaacattttaataaccatccttctcccggactaatctgatgaatccaaaaacatttcttttttcttttttgagatggagttttgctcttgttgcccaggctggagtgcaatggcgcgatctcggctcaccgcaacctccgcctcctggattcaagtaattttcctgcctcggcctcttgagtagctgggattgcaggcatgcgtcagcgcccctggctaattttgtatttttcgtagagatggggtttctctatgttggtcaggctggtctccaactcctgacctcaggtgatccgcccgtctcggcctctcaaagtactgggattacaggcataagccactatgtctagcccaaaaacatttctaaatga

SEQ ID NO: 52083 - DNA, 1476 bp, Homo sapiens
atagcaggtggtcaggcggttggggcagtttcaatacctagactagttaggaaaggtctcagagaaggagaggttttgtagtggaagggtagcttgaaaatagggtgagttgtaaggccagacacccaagatttggctgagatgggaggatcccttgagcccaggaaggttgacgctgcagtgagctgtgattgagccactccactctggcctaggtgacagggtgagaccctgtctcaaaaacaaaaaaaatctttaggaaacctgtatatttgaagatcaagggctaaaaatccactcagtaccatttagcagaggatgtatgacatccattacacatctgtttcaaaaacagcatgtttccaaaattatacatctctttacaaataaacgttatagtattaataactatagaggcaccatcagaactagttacaaaacatgctgctaactttcacaaggcatctctgagccatctcttaagttctgtattttgatcccggggctttaagaacattttctttgctttaattagttgtaggtctccattttcattgtcttcataattggcttgatctccctttttggcagacttttttcctgttgtccccaccaaggtctcatattctagccatttcttctagccatttcttcttcatctgacacgtaaaattccactgtttcatcttcaatttctgctttgttcttagtattcacctgaagcactaatttctcaacctcaggagtaaatctgatgaatgaaattccttccatagaaatgatcttcacataacaagagatgctgctcttctgttatgaaattctttacttattaagctctggcaaatctgagtaccagtgctcttaactaattttattttcttcctcttctagtcatttcttagtttctgagtccagtcttctttgcatgaacttcatgtacagcaggttcttggagaacttggtcttgtgctcaggtgccatgctggcttcagcttgtgctgtgttctggccacctgctgtttcttagttaagagactagaatgagaaagttacatgtaaggatgtcagttggtagtattattgaaggaagaatatgtagggggtgatgcttgtttattgtctgtgtaccccactggaattgttgctccaagagggcgtgaactttgttatgtgaattgtggggtgtgcctacgtataggacaaagcttggcacgtggtaggtacttagtaaaggcttgttgaatgaatgagtagatgaatgagtagatctacaagtcttgagtattttgaggaaaacatcttattgtaatctccattttattccttttttttttttttttttttttttgagacagaatctcactctgtccccaggctggagtgcagtggcacaatcacggctcattgcaacctctgcctcctgggttcaagcaattctcctgcctcaccctcccaaatagctgggactacagg

SEQ ID NO: 52084 - DNA, 1061 bp, Homo sapiens
ctgagaacaattagtataatcttcccttgatattgcaggggattgattccagaactctccaaggatacaacaatcctggaatgctcaagtttcttatataaaattacatagtacagttatccatctgtatctgtgggttctgcctctgtgtacatggagggctgactgtactgtaattatcttggagataaaaagtgttatgagttcctttctaagaagtttggaattgctgttttaaaattccttatattgactttaaagttaccattacttgttaaagactaataattaacatgtactaagcatgtactgtatgccaagcactgttgcaagttctttacatgtattatcttagtttaccttatgagaaaggtagtactgttttcatttttagagaaggggaaaccaagctacacagaggttgaataacacagaggttgaatagctagagtgtggtagagccactctgactccagaacccaggcttaacaggggactcacaaccaaccagtttgtaacaaattgcagagcagtcaggtcgggaagtctaagaagtggaagatttgtgggtaaatagaaaggggaagaacaaactcttatcttactcccttctcccaataaaattcagtagttatatgcagggtgaaaaacaggaaataagcttagcccctattttttgcttcctcttctttatatttgctttcctctttgcattgctggtaactcacggatatatacttgtcattccactagcactgattatatttgtttttattaatgtcacttctcagacagtatagtgtaatgtaatgtttatcaagagcagggacttgaggttgggcacggtggctcacacctgtaatcctagcactttgaggggcccaggcagttggattacttgaggtcaggagttcaagaccagcctggccaacatggtgaaaccctgtctctattaaatacaaacattatccaggcgtggtggcatgcacctgtaatcccagttgctctggaggctgaggcaggataatcgcttgaacccgggaggcagaggttgcagtgag

SEQ ID NO: 52085 - DNA, 1028 bp, Homo sapiens
tataattaccgtgtgatcgtgtggtgctctgctgcttgttggtcagagcctgagtaaggctgaataaggctggatcatgaaccattctttaaagcagtggcctttgtattgcagtctagttgacatacatgcatacatacaggtgtgtgtgcacgtgtaactgaagaacagctttcacaaaataatatttagcacactgtggaattttctctgatacagcctcttctctttcatgataaaaataaattcgctgattatcacaccactttggaccttttaaaaataacacttaagaagttggaatagccagggatcagaaacttagaaatggaccttatttgttattgtaacttatagcaagtcattgtgtctcttattgggttcttttagccataataattgtgctagttcttttcttgctctgagtgcctgaacctgttgctaagtgaggaagaaaaatccatatgtaagtataaataaacaaatgtctttaatctttttgcaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtaagtataaaggcttccttctgttagtaaaatgttgtaaaatttgatatccttttgaaaacgctttctctatgtgtactgaatttttttctgttgtctgcctttgtttcctgtttttaaagatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgaggtgacttttttttttttttttttgatattttggccaattattgatcagtacttggaggtctcctgggata

SEQ ID NO: 52086 - DNA, 1370 bp, Homo sapiens
gtcagggttgtgttaaaacaaaaaccttacaggaaaggttcagataagcataaacttgcaagagacgatgtgaatgattttttttttttctaaacacttaaattttcatctgaatatgtctgatcttttcttgccaattctgacaattgatactatactgtttcttgggcaattcaaccaggatagggaattagtcataataattgagactttaatgtcaaagaaggcagccatggctatttctgccacagttctcaagcgtgctttatatagtgtccctattcctatatttttggaagtattccttcctcatgcattccggccgtttttgagtgatttaattggaactccttttgtagtttgatgggaaactcagattttgaagatagggagcaatgttagggtatttggaatgggacttgtaactgatgtgtatggtttaaactttttcaccttcatgatatcgctgattccgtcctttgagtactgttctgggggcaaaggaaaaggttatggaaataattagcacaaaagttttatgttctactggtactggtgctttgaagtttgaacactgagcagacatgcctaatagggcaagattgaagggtggaggtttctaataattatattaaactcattatatttatgcttatgttttcaggtaattcattcatttttattgtgtttctaaaaaacactattggattcttaactacgtgtatactagggtaaatggcatatatgattacttattacatatgcactaggtatttagtttatagggcctagtgcataatttaatagtaagtttagtacttggttggatatttacagataaaacttttatgcttaactgggatatccctcaaaataacttcgaggcctagtatcagatgatttaaacataatcttctaatcctcgtttttttgggcagtttagtgctattatagaagcagttatttaaaagtttagaagattttacaccttctcatgcatagcaactgttttgagagttttaaaaaatgcctggtgcttctctgtgtgttttagtaacattcccagaaaagtgtgcctgtgtgtgtatattgggggagacaagggaaagtcatgtgtgaaacactcatgtccatgttagacactaattctgtgtgcttctgatgcatacctctgttctctagatatgggttgctttgagggaagacacataggccctgtggattcacttttaggttactagtgatgctttagataattggatgcttttaatgtaagatttttacagtatcaacaggtgtatatagtaaatccgtttgtagagagtatgaagtttaaaaggtcttagcaggtacatttttcttaccagagt

SEQ ID NO: 52087 - DNA, 2799 bp, Homo sapiens
tctgtactccttccttccttttatattttactgccagagttggttcctagatgtgcagaaagaattgcagtggaattttaacttttatgtggcatttctactttgtaaatgatgtagaaagaggaaggctttttaacttttgctgcttttaaagaatttactgctgtttctgatttattttgtgtctaatgtgacatgtgggtaccagtcctgtgggatgtcatggatgggggcagggtggaggtgggaacacttggggtggtctggggttggcacttacaattggagctgtgttctgggacttttaggacatatttacttgggatcaaactgatcaaactaaagaacatgtgaaacaaccttgggtggtaaacttgtggcttcagatttaggtgattttaggtgagtctgtagacctgggtcctaagtaccaccaatgctgagtcacactgtcatgttggagtttctggctgaggtgtaagtgtatttctgtatcttaatccccgtaagatctgagaatattcttcgttttcactccatgctttatgctctgatacccatgcagacatcttaaagcactggactgcttgctaaaactcattctaggaccccattctttgttttcttatgacttgggtggtggttacttgctctaataacattgctgaataactgaagtgtatgctgtttttagagtctgttctttaaagtccttctagttggtactgttgcacaattaacactttttaaatgtctgaacctttccgttctgggaaaccagtttactctgaaatcttgattaatcacattcagatatgtcattgaacctagaaacacatagcatgcctgttagtctgctatttgtgtccttcagttattcaggggctgaattcacataagcctgaaattgtaatagatttatttccaaaatgtgttagaagtcaacatattgcattttaataaaaattgctttcctgctcagttaaccttgcttgaggtgaagtttttggtcagttatctactctcctggttataatgggcttaagatctagcattctagcgtttttcttaaggcacattgcttctgtgaattcagctcatttaatccggactgctgttgtacctgctagtctttctaatcctctaacctggctgctattctctctcctcccctctgtcttgtagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataaggatgccactgacccgtgcccgtcctctcagtcctctgtttcatatccagctgtttcatttgaatgcagagctgcttcccttgtttttatgtaaaatgtttcagcagcacattacaaaactcatactgaatgagcaaatgacacatgtgcttgtttgcttcttgtgacatacattggtctgcgcaaagctttctcaaaggaccactgtctcactcatgaatatctgctcctctgctcctgaattgctgaatccttccagtgccctggacaaatcttggtgaagtgagattattgtgttgagattcagggttgtttttaatgtttctttctttgccaactcttgggggtttgaatgttttaaatttgaactccaactttattatactgaaaatcagaccgcccattttttctttctaccccttttcagaaaggcctaaagaatgtatttgacgaagcaatattggctgccctggagcctccagaaccgaagaagagccgcaggtgtgtgctgctatgaacatctctccagagccctttctgcacagctggtgtcggc

SEQ ID NO: 52088 - DNA, 1712 bp, Homo sapiens
ttttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagccagcctgagggttgttattttccctccgtctcttacttttcagatattgaggagtgggaatttgactcttgataacatcaatttctaacaaactttgggataaaattttaaagctttattatttttattttctggcattttagtttgagataatatttagccctctatatgttcaggtttgtgctttctcctctaagtttgacccttcccttaaataccaagtaggtccataataattcttagtgaagcagtgttcaggaagctcactgctcatggtggaaggaaatgtcagtgtacctttaatccatagatcattgaaaagcagctcattttcccccaagttttctgcatcagtggttctccaactggagtgcagcttgaacaatgtgatttttaagttttccaggcatttctaaaatgtagccaagtttgggaatcaccacacctagttggttatctcaaactactactatca

SEQ ID NO: 52089 - DNA, 1215 bp, Homo sapiens
ctaaaatgccagaaaataaaaataataaagctttaaaattttatcccaaagtttgttagaaattgatgttatcaagagtcaaattcccactcctcaatatctgaaaagtaagagacggagggaaaataacaaccctcaggctggcttgtgaagggtttttgtttgtttaatacatctgaaaagaatgcatatacaaagaattgagacatgagaaagcattggttcaacactaatgcatctacaagaattaggtttgggaaggtgggaaagattacctcaacatttttaaaaattggaaactgcaaccaaaataagctgaaaaaatccctattaacacttaagaagagtctgcattaagagtctttccatgatttttattaaactagagagcctcacctggctgctctagggttcctcatatgcaaaacagaaataaggggattcccctgactggtccccatgttgttaagtgttctccccacccccaccctacccccagcttcttaatgaagcaggcctccatcctcctaacttgagaggatgtgaatcattccacagatgtctgtcttctagcaccacccctcgtatttcctctacataacaggtcttcagctgcattctaggaacaccatatactactgagctgcaaatctatgctaagcatataagacaatgactgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaaagaggagggaaaaaaacaaaacaaaacactaagatgtcccagattactctccagagtggaaccagggagcag

SEQ ID NO: 52090 - DNA, 1065 bp, Homo sapiens
agaacaattgtaatatttccttcattctgaggtgtatttttctcacattttcatattgtaattaggatacctgttaacattggtgtacatttaatgtagtagtactttttctccttttgccctgcaagttgtcactaaatttgtgctatcataattgttaccttcatagaatgcttaaatagtggtacttctttgacttgttaggtttggactattttccttttcttcttccatttgtgaggtaaattagtggttattttggtgctgggtgctaagaaactcgcaaaacaagggccctgctcaagaaggattgaaacttagtccttgctgggtacaaatttagaaatttgttatataactgtggggcaagggacaacatttcaccaggaagtagcaactccatcatctttcaggaagggctgatggttagggcatctctgaatgattattggagggaagtggctttatgtcacacttgttttctgtaagtcttactctgtatctacccgacttcagatcatggtgatttaattacatggcccaatcatgttttctttccagggctgcttgaatgcttgaatacttttttttttgagatggagtctcgttctgtcgcccaggctggagtgcagtggtgcaatctcggctcattgcaagctccgcctcccgggttcacaccattctcctgcctcagcctcccgagtagccaggactacaggcatgtgccaccatgcctggctaatgttttgtatttttagtagagatagggtttcaccatgttagccaggatggtctcgatctcctgacctcgtgatccgcccgccttggcctcccaaagtgctaggattacaggcgtgagccaccgcgcctggccagaatgaatacttttaattactactatgagtcttttttcaaagtgcctccaccttaaaaaaaattccttattttattcacttgccagaataatgttgcatttgaaccatgccaacggtagcttattaaaacagcatttatttttctcattcatgggtcagctgaacttgtctctagccttcagattgggct

SEQ ID NO: 52091 - DNA, 1073 bp, Homo sapiens
cttggcggaccaccgagcccctcagcaaacagggaggtgagtgtgcacccggtctaggcctgtttgtgttggcctcgccaggcgggggattagctcagctgggctgctaattgcctccgaagtgccggccgggatgctgacaagggctgggcctccagtcccctcctcccgcagcaggcactgtgccaggcttgggggcctggcccagaagggccccttctctcccctgtcagcgcctgcttggcctagacccttgagatgtgggcagggggtcaccaggactggcggctcaggaaggaatcgggggagatgcttatgaagtcatcgactgggccaggccaggctgtgttccacacacccctcccccacatgccttaagaccgcctctccagctccccttctgaatcagacactttctcctgaagctcagcacttttttcctcttactaggaagctgctgggctcctttgcccagacaccctcacctcagtcgctgctctgagctcccacagcatcttctctcttcttgtctctttctccctgtcttcctcatgtctgtcctccctctctgccttttcgtcactctgtgtctagcctttcttagtctcccgcagttgtctagttcctagacttcccttctgtcctgttttcctgtgttctctggcctttgcttggcctttactgctccccagacttcccatggactggttgttctcaggaagaggctgagaaggaggtctactttgtcactgcattttcacggctctcctagagaacttcaggcccaagctctgagggcagctacgaggatagagcctggacacaggctctctgcaagcggacccagcctgggagcctgaaagtcttacttccgtccccacaggcagagcgcttggggcccactacaccttttcctgcagctctggcactcctgtctgcacttccgacttggccctgctctctggccttgccctgcttttcccagacattgggatctcaatcagcccctccagctggtgcccagggacagctttgctataaccttgttggctgctgcctgggtctcctggcct

SEQ ID NO: 52092 - DNA, 1014 bp, Homo sapiens
atagaagagaaaaaaaaaattagcagggcgtggtggcgcgcgcctgtaatcccagctactcgggaggctgaggcaggagaatcgcttgaacctggaaggcggaggctgcagtggggcgagatcgcgccgctacactccagcctgggaaacaagagcgaatctcccatctcaaaaaaaaaaaaaagaaaaaaactttacttaggaagtgtggggagggaaggagggagtggccaaggtcagaggtcagagaagagcctagcaaccagccggcccccgccgtcctagcataggtggagagcgagcgcgtgacgcaggccccgcccccagcacgtgaccgcggcgcgtggggcaggtcgggccgccccctcccctctgatacccattgcgcgccggcctcaagatggccgccttctggcgtctccggcgctgttgaatggcgaaagctttattgttcccttcgggcaggagtgttcgtgtcctctatggcgctgtcaataaagaacggcagtttgaatcggtgctgaacaggtaaccatagaaacggggctgggactccgcgtggagacccttcctgcagcgggggcccgggtgcgccctaaatgaggggtgtatacagacccttccgcgtggcgaactccgcgggactcggccgaatcacggccgcctcacctacaccccggacgtgccccctccaggggcggtccgcacccctggcgccggctctgctgtagactgcggaggggagagaccgcggggacccactcagggcgccaggcccgacctgacaccgcctggggctcgctgtcgccccgcacctccctctcggcccgtccggaggcctcttgtcgctgtctcactccccctcccttcaggtcccttcgccgggcgtcagcggactatggccttgggcctaatccatgccccccttctctcttcccctctcggtctttgtttacagttgcaaatggttagggggaagaatatttcatgtaatttgcgaaagttctatgaaat

SEQ ID NO: 52093 - DNA, 1061 bp, Homo sapiens
gctactactgagagaactgcacgcccaagggcaagttacagattagttatctgacctggaaaatgtggataatggtgcctcctcaaagggttgtgcagattaaataagagaaactgtattcatagctatggtattttctttttgttgttgttacacatattgctgaataaccaaatttagctccaaatggaaactttataaagtgctaactaataacaaaaatccagaaatacattacagacaaaattaagaatgggggaatccaattaaaaatagaagccctctactttctatctccagaaagaggggagcagatcttgttttttcttagtgtttctgcttggagaggaacttttccaaatggcatctaatttttttaaagccaaattgtacagctgtctatgcagaacacttttcagcattttagtgttttaagttggaaactacttatgttcctccatcaaaggtgtatgtattctcttaaggcattctaaacaaatgttagacttttagttggtggcgatttaaaaatttgtttgtgcatgatttcaagtttcctccaaaagttttcaaaataatgtcacatactctaaaacagtattgaatgctttgaggcaaatggcaggctttttgactaagtaaaaataggataatgttcgggttcataaatgtaagaaattagaagcaataataaatcaagggaactatgtaagaagaacagcatggcaggtttcgctttaaactctccctagtaaccatattgcacatgtcatcagaagacacattctaaccctgcaaacggagcaaagaactggacagagagtgtcatttaatgcaatgttaaacaacaagccctgaattaaattgctattttaggtttgggtgggacctttgcatctaaagtattgcagttttactctgtgatttgggtctgttgggttccagtaaagagcaggtgctaacactagctttgaaggatagtatgaaactgcaagaagagccagggcataccagtttgtttttcagtctattttatttcagttcaaagcatcattgcagac

SEQ ID NO: 52094 - DNA, 1050 bp, Homo sapiens
tatggatttggaagaagaaccagtgggaaaggctgaaaaggagtggtcaggaaggcaagttcttatcccacatacttcagtgctgctgaaatcggaagagaattgtgatacagaggcactgccaagtgccaccgaaaggtcaagtggcacaaagccagaggcaaggcttgttgtataaacgttggttaggggaagaatctgtgaagccccttcaggctgaaagcagtcattcacacggggtaattaacatgtgagtcatatgttcttacagctggcaactacaagccaacacactgttagccttaattgttacagactatatctaaaattaataaggcccgtgtctttttaagtagtctgtcatttataatgtaaatgatttaaggtattcttttttcctaaattgtgagattttaattgcattctcaaataataaaatgacagttcattaaatttaaattcagacatccctgcccatgaaatacttaaaatgccagattcagaaaggtataattaggtaagaagtgcattaagtttattaaaaattcactgagcccctactgtgtgccaggctatgctatttgctgcggatacagagccctagaaagcataattcctgtcttcaagaagtctagtaggagaaaaaaaaaattataatatagtgtgacaaatgtcaaattaaaagcagtgaagaggaggtagggcctgtggccaggaaaggcctcccagcagaggtaacccctgagcaaggttagagcatggagtcgtggaattggagtcctccagaagacaggggcaggagcatgggaccgcagggcttgttggaactgctgctggggaagaaagtgcagtgggtgaggagcttcaggagaagctggcgggaatcaaactgttgaggaccttgtttgccaaatgcaaggagcggatggttcttgtggttcgctaatctatctttctgggtacttttgttccatagatgatagtgaaatgtttcgagggtgaaggaggacattcagcattccagagaatcctgggtaaagtaagagagga

SEQ ID NO: 52095 - DNA, 1053 bp, Homo sapiens
taatttctaagaagtggaattttggaatcaagagtataaaaattttcaagcgtttgatatatattgccaaattgcccttcaggaaggttgtaccaatttactctcccaccagctagctgctaaaatcctcataaaactgctggcatgacttctcaaggcaactagataactatgtttgttggtgttattgatttcaactttgtgctaaaaatacttttatatctggaaggaaggaatagggatagagtacttttgtggcatcaattcctaaaaccgtgggaagcgacttaagtgttcaggagagaaaacgtttagaagccactgatataatggctaagccctgaatttacagtgaggactagatcctcgattttatttttctcagtgatcttatgttgcacatgtgcgcacgcacacacacacacacacacaatggaaacaacctttaatctcagaattacattttgtgatttaattgtttttaaatttttaagtcctttgaacttcttagagaaagaaaatatacaaagattaaacttctgttttttttctccttagtcttcaaattaagtgtaatttcaggcactcaatttaagtaagttgcttatagctctaaaagttcctgattccctctttagtgatttcattcgattactcattcagacctttttctttttagctagattgaatgtgtcctttgaactgtttcattatcttggtaaaacagcatttatagatagagtccaaactcagcttcattctctgcagcaagatagaccacactgtcattttcttctgtcactttcagtttacttgacagagaaagctgaagcagaagagcttaaattagttataaatcacaaaaacacttcttaagattggggttccaccagagcttctttaagtgattccttctcatgaaagttgaagcagactaagaaagtgggagtggagaggtgaatgttgattgaatagccacagtattttgacatcgtgtggaatgtgtacccaggccttttcaaactttttttctggttagaaactatgctaata

SEQ ID NO: 52096 - DNA, 1050 bp, Homo sapiens
gcactgtgcccggcacatgggcattcagtaaatattagttgctgtcttcactgtcatcatcggcaaagattatgctttgatagttgtctttgtacatagacaaagaccttcagataatttcttaaggttggatttccagaagtggagttactgagctaaagaaaagggtacatttttaattatctgcaaagctaagagaaatgcctgatagtttcaatttttcttaacttccaagtaaatatgacctcttaaaagagagaacctaacaaattggcccaaagggcacctaaatagaaaaaccacgggtcagcttcacacgcacagccttgattcgtgctcgtctttaggatcgccacacggatcctctacctcaggcttgacaaacacccccccttgaacctgcacatctgagtctcttacaagtacagccttctaattacccccctggtgagcaattgctagctcctaccaccaggcactgactttcaaagcgttaacggctttatgaccctgaagcgccaagcgattaagtgtaggcagaggagctctgaacatatgtgtatgaggccccaagccagggctctgcagaggacactgagcccttgtgctgattgctctcttcctctctcattggtaatatcctggagtcttctgtaggaggttttgttgcatcaaacattattgttttgctaatatccttacagtccaaccaagccctgatgattatgggactgagctattgagacgctatcatgaaaacctctctgagattttcacagacaaccagattttattaaagatgatctcacacatgacaagtttagcccctggagaaagagaggtaagagagggagagaaacagagggaggggagggtaaaatgagaaagaaggaaaaaatatgaatacacacacacatttatattttctgtaaatatacatatgtagccatgttgagaattgctaagtagaggagaaatagaaggtatctcagtttctaaggtggaataacaaatagaatagttctaatttctgtggtaataaggaaaggc

SEQ ID NO: 52097 - DNA, 2706 bp, Homo sapiens
gaaaatgaggctgcttgtcctagttgtggtagaccctgggatccggggttctggtgccatgcctcaccaattgccctgcttgctctctcggcccataagggagcttggaggttcagttggtctagcatttctcacaaatgccagttctccagacttgttctttatccacattttctaataatctttggcagtctggtcattatatcctcattatatgcatgtgaaaatatagaaaccaagggacacataataactttatagcaagcaactggaagaaggctttcattcctctctgaatccacgactctcacctttgtgcacagttgcagatccacactgtgtatgtcgccaggggatccaaacccacgtgtttctgggcacagggatgtatctggttgcgggagtagagtgcgctcttccatacttgtggtggctgatgaacagatgggttgtcttgtgcagtgagaactccgtccttattcctttgtccaaccacactcgcaccttccgtgtgatcggctgtgtttgtgaggtgccatgtgatgagacggctcagatctcacccagcgtattgcagactgcctgatgttttaatgtcatctaccagatgatatttccctgatacgtgctgtagaattagattttgtttgtagcaatgccataaatttttagtgctgactctaataagctcctgtgtatttgcagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacagtatgtagagactgtggatctcaagccctcagtgccagcctggcactgggaaagcgtgtcaattgcagcagaggtgtcaatccatcagacccaagctccattcagtgcattccccttacctgttccgctgcaaaacccagagtccctcattcctagttcaggaagaatctcattttaaggtatctcatataacgcttatttctctctggccaggctgtttccctgtcttcctttttagcccacctggcaccatttgtccaacagaggcaaattttgtttgaaggagaaagcctctgtaactgattggctcacagagcactggaatatttccattaggccatcttccatttgccttttcccgtaggagcagtccagacactttctgagttaatgtctaccatcgtaagtgagccttggttatgtttccttaaaaacctcccgcccagcattctcttccgaatgccattgtatttcacacagttagtggggtctgcccctgtctttctccccttctgtgagaactgacacagacagaaacacacttttattcggcatgcgtgcatgcgtgggcacacacacatatatatacacacacaggaaggaaggacaaagaaattccgtgattcctcattacaccatcgggaaatcaccagcgtggcatttggctggccacatcacattttcttcagcctctcttgttgcagcaggagtgtaatcagcacagcacagcacagcaggggagttaagagcttggagtctggaatcacacaggcttggacttgaatcttgaccctgacgcttacttttcttgaggccttaaacaaatttatttaccattctaagcctcttatgccccttctgtaaactagagcaaataataatgccaccaccttggattgtaattagaattaaatgagaccacatgtaaagcatgacactccacgcctgacacatagaaaatgctcagtaatgccagatactgttattattggtgacaagagcaaccctctcagatgccatttgtcaccatcaaaacttgtcttttttgcatgccctgcatctcacatgctcttcttccctccccacccctcttcccacacaccagtttctagctgttggcagatacagtgtctcacaagtgcgctttatgtaaacacatccaagtctgtcgtcagccagccagcaaggactttgccaaagctcctatgtgcccagcatgtggctagacattgggtgatgcagggggaaaataaagtgtggccctttccctccaagcagtttacaaggctgtccaaaaaaatccagttacagtaggcttccagatgagagatttggcttggatccagtgccacaattttgatgtcctcttgacctctttaatgacattctgctttagtcttcctttcccagtagcattacctgggcgtcaggaaaggggaagacgttattaactttcagaagggagaagacccagaatactttgccataccctaaactatatcatccgtggcaggcctagcatccaggcccccctctctctcccatttcttgcctgtttcatagaaccacatcattgcttatggaaagctgcatcaaagtgtcttagaagatggtgtaaaactgagatttcaagagctcatgtccacagggaaactagttagtgataccgaatgctgctgcatgtcagaattcctgaattaatctgaatcaatgcacataaaagattggcttgtgagcaaaggattttattaaaacattttgatttctgttgctttaagaaaaagaccaaagtttcctgccataggatggcaaatgtattcttcatcactactagtt

SEQ ID NO: 52098 - DNA, 1163 bp, Homo sapiens
agtgagagatgggattgttactcagttcagccatttcttaattatgcccatgggcaagatactgccttaccactctaaaccttgattttcctaatctgtaaaatagggatgataatagaacctactcatagagttattggaaggattaagtgagttaatttacataaagcacttagaatatgcctgtcatagagcactcattatgctaatgtttttattgttgaatctaaagtggggagaaaggaagcatccctccacttgtgctgttgatgacaaaggaattagtgatgctctggggagtgtgctggaaatcctctacagagaattagaaaactccagaatgcccactgcaaaccggacgagccagggtgaaactccctggaaagtgataaagtgtaatttaacttgaaagatgtaaaatgaggaatggagatgaactacatgatgctgcagagacagttagtcttgaaaccctggaggaatcccacctcctaggatgaaggtgggggtagtcaggtgactgctacactgatttctgatccttggagtctatgaccctgcctgttacgtaaagcagagtcttcacatttgttgctgtacacaacaaccagtgtttcactgatggctgcctatggtgttttcttttcctctccacctcttcctctcatggatgtcccgtgaaactagacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcgggatctgcaacaaggcctaccaggtgacctcaggtgccactgggagctcttcccctcacccctgacctactctccatttgatcttccctgatgcccgggttggtggcttgcagatcatatcttgtatccaggatgtgacaattggctgattctcatgaaggatgcagcttgtgatccagattctctaaggagatctggtcggagtgctgcagtgggggagctcattattggagcagagagttcatacgcttcttctcttagacagcagacttgtcgtgaactaa

SEQ ID NO: 52099 - DNA, 1004 bp, Homo sapiens
aaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccact

SEQ ID NO: 52100 - DNA, 1118 bp, Homo sapiens
tcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgt

SEQ ID NO: 52101 - DNA, 1030 bp, Homo sapiens
atatatgaatgagaaacagataccaaaacacccatgtctgtccagactcaagatctaaagatcccagcgcctacaaattctgtgggggttttggttagttggttgattggttggtctttttcatgggtaggggaaggaaggggaggattaatattttttagaaataggccaggcgcgatggctcatgcctataatcccagcactttgggaagccgaggcaggtggatcatctgaggtcaggagttcgagaccagcctggacaacatggtgaaaccccatctctactaaaaatataaaattaaccggacgtggtgtgcatgcctgtagtcttagctacttgggaggctgagtcaggagaatcacttgaacccaggaggcggaggctacagtgggctgagatcacgccactgcgctccagcctggagaagacagagcgagactccatctcaaaaaaaaaaaaaaaaagaaatatcctaattaataattggtgttattacatgcttaccacacattagacactggatgaagagctttttgtaattttttgtttttttgagacagagtctcactctgttgcccaggttggatggagtgcagtggcacgatctcagctcactgcaacctccacctcccagattcaaaccattctcctgcctaagcctcccaggtcgctgggattacaggtgtgcaccaccacacctggctagtttttgtatttttagtagaaacagtgtttcaccttggtggccaggctggtcttgaattcctgacttcaggtgatccacttgcctcggcctcccgaagtgctgggattacaggcatgagccacagtgcccagcccagtaattcttatttcttagaattctagcaccaactccacaatgtaggtgctattattatccctgcattacagatgaggaaaccaacaccagagaggtgaagtcgctatgtagctagagagcagcatagctggggtccaaacccagctgtctgactccagagtctgctcttaaatcgcttgctattttta

SEQ ID NO: 52102 - DNA, 1024 bp, Homo sapiens
cgctaaggagatggctcagtggcagctgggggccctagagaccctgagccgggaaagggaaggcccacggggccctggagctgtcttcacaggccttcaactgtcagagggatgtatttaggacacagatctggccacgccgtggcccaccctcaccccccacagcgcctgagatgaaaccctggtagcttagccagacagtgccctctgagacccgacctctccagcctcgtcactcactctcccctgcctcggacttcgctctcaggtcagcagactaccagcagcctccatcctcccaccagctctgcccagccccatttctgaggcaagaaggaagcgtggcccttccctcactgagcctctgcatgtgctgcccccgtgccagagggcccttccctggcctcttcctggccaacacctgctgacactttgacactttgagccgtgactcagatgtcacctcctccaggaagtcctcctgtgtgctgcttctgcaccctgtccttctcctgatccttgaacttaggctctactgcggtcatctgtgtctgcttcagcagcacaggccaggtcagagtcggcatctgggtgtggactgcccacgtggctgtcctcacaggaaggccagagcagccaaggcaagtgctgtcttccccattcaacaagtgaagagatggagtcttggagagtaactggcccaaggtcatacaggtattaggaggtggagcagggatcgaagccctgagtctggcatcagagcactcacggggtgaggtgagtctgaggtctgcagtctttagagaccttcactgacactggggttctcagacatcaccttctccgacagtgtggacagagccctcactgtccacactcccccgaacagtcccatgccactccccatcctctcaccatcttagttttttacagagcacctagcaggatcgaaagttttataggccgggtgcggtggctcacgcctgtaatcccagcactttgggaggctgaggcaggtggatca

SEQ ID NO: 52103 - DNA, 1001 bp, Homo sapiens
tgcccactaagaggcagctcttaccccgctaagcccctccacaccagatgtgcacggaggacgtgctaaatgccaggcaccgtgctgggggaacagggtgattatgaagctggggccagtcctcagatgggaggtatgactttgcagcatggaccttgaatgccatcatggctcttacaggagacaagggtcaggtcatcatcacaaaagccctgtgggaccggaattgttatcaccccattttacagaggaggaagctgagactcagggaggtgagggggcttgcccagggactcacagctcctaagtggcacaactgggattcagaggcctgccagcttcgagcccacctcaactatcccactgtgccaccaaccaaggatgtctggcacttggaacagcttgtgttctgggagttcagaatattactttttggccaagagggtgagaagaaggcttcagggaagagaaagaacttaaactgggccttcaaggagaggggaagagagaaagggcattcaggcagagggacccgtgtgagctgtgtgctgggggctgagtgtggaccagtgtagctgggtcaggctgctcttgaggagctggggagaagtcagaggggcctgatgccctcttgtctcctgttttacagtgaatttgctggacacgtcgaccatccacggggactggggctggctcacgtatccggctcatggggtgagtgatgggcactggggacaacgtcatccctctgtgagcagagagaggctgccactcacagagtctgcatgagatagatcaaaaggaagcagaggcccagagaggtcaagggacttacccaagggcacacagcagttagtgctgctgatctcttaacagtttagtgcatacagacccttgagattacagaaccaaccctggcaccagatccctgattcttcaagtctgaggccctaggtccggggatccccatggctgcatcctacagattcatgaggtgccag

SEQ ID NO: 52104 - DNA, 1050 bp, Homo sapiens
ggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccctctgcaaatgagggcagcactgggcagtgtgaaggtctgcacctccatccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagtacccttgagcccaagactgggccgggcccctgtgtttggtcctccaggcctcagagagccagttctctgctggtggggcaggggcgggtggctctcttgagccagaggccagtctgaggtggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatggtgtgtgtgcatatgtgtgtgtacccatggagttcgaatatctgattctg

SEQ ID NO: 52105 - DNA, 3030 bp, Homo sapiens
cggggtgggggctcccggcccgcgcccccgagatggggcccggcgccccggagagcagggactggcagagtggaagggagcgcgccagcccccgcgtcggtgcctgcccatcgcccgcggcgtacaatggggtcccctccccgagaggactgcgcgggggatgggtctgtgggcatctctccgccgcgcaaggtctccgggcacccccgccggccaccgccccgcggccgcggcgctcagcgtggcggctggagccccgggaactctccagctgccgccggggccggaccagatgctcttgccatgtgttggccttggccagggtcgcgggccctctccccgtggcctcgtgtattggtaccactcgacccccaggggggcaagggtagttgctaggtctcccgagccagcttgctctggagggaaagttagtgcggtctgggtgtgtccaccaggaatggccgagcttgcagggcaagaagcgaacgtgaataatggttctcacgtgtactgcactttacagttttcaaaccactttacagtttatgaagtacttcgcactatacgcagctctctgtggtttacaacgtgctgcacagttgacaaggtactttaagctttacaaagtgctttcccgcccaccagcgtgttggatccctcaaaatacaccttccggggaagacaggtaggtatgattcctacttctcttgaacagatagggaaaccgaggttctgaaaagtccgatgtctcacccagggccgttgggtgacaaaaatagaacccaggtctgtggtctttctttgaaaccagcactcacttagctgggttttgttgcccctaaactgcgtgagcccttccagggttctgctcccttgggcttagggatgatgtctgtgtgcacctctcaggccactttagggttgtggggcgccccttcccttcttgcagcctaagaaaaaacgcatatcagaccagacgtgggggctgcggcctctgggaaaggcgtcgtgggggaccctgtgctacaacttcagtttctctttcggtaatgagcactttagtgaccgcagtcagggggtggggggtgtccctggatggcagccacagtttctggcactgaggcagctgtccttcggctcctgggggatttggcggctgactgcggtttcccggagtggggccactggggcacctagggtgccacgggccctgggtgtggagggcagccctggggcctggctgctggcgggagctctgtggaatatggctgaggtaccacttattaactctggctttggggaaatgactcatgcgttggcccgctatacattgggatgtttacagtattatggggagcttggcataaatattgctatttaggttgcagtcagcggtgctggaggggaagaaaattggcccctctctcgttggaagaggcctgggtgtgtttttaattactctggggtagatggaagggccacatctgtccagccatcgccctggcagaggctggttggaatctggtgggctgtggccagcctggaccctggccctggacacagggctggtgggcgctgacgtcacaggagggtatggctacttggactgccacttgggggcagggtggggaagggaagccacagcagggtgggaggagggctgcagcaggcaccccaatgcttgcctcaggctcttgttccgtttgccccctggacactaggaagttagtccatcagtggttaataaggagctggccgaatggatggggagatggtgtgaggtggaggtcagagggcctgcttctcatttactatgggaccctgggccaggtcccttccctgtgggggcctcagtttctctgggtgtaaaatggcctggctaaatatcttgtagagtccatcgtctacgccctacttcccctctttgagcctcgttttcctcccccgtctagtgagagtgatgacagcgcctgtcctgcctgtctcctggggtgtttgtgaggatcagaccagatgatgggtgggagaagtcccccttcaaagccagggatggacggtgctgcctgtgcacatttggggggcggtgctgcctgtgcacatttgggagacaccagggtcctcctgagggtgacacagtctgtggagacaggactgggccgtggagcagtaggagggtggcccctctggctcccagaacccagagccacatggctaccacttccttcccttcctccttccttgtctcctcagcccgtaaagggctgtcctgccggttaagtccccaggaaatccccagctccagccttcggaatgggggagaggagagtgtgtgtgtatacggggggtttctaggttaggacggtaagcttagcatctcccccaaactgtgagaccgccccccgaccaagtgaaagaaagcatggagcatgtgaagtggcggcgagcaggatggaagagcactggggaaacgtccaacaggacaggaggccggtggcagaccctgtccatccctggccgatggaatccaaaggtcaaggtctcaagaaaacagcctccttacatctgctcctttgctctccaaatatcgatagagtttcctctctggctgacagggtgctggactccggggcaggcaaggagacgggacaagctgacagggaaaagagtgggcgagacagagcatgatacggggtccaacgtacttcccagaggaggctgtgaaccccccggggcggcaggtgcacttgaggacagaacagggttatttcatcttttatgctgttatgcattgcctcattttctcaccacccattttccctgctatgaaactttcttagccacctgtcatgctaacgaactgtgttctcaagagttaaagaggttgactttagaacttataggatgtggagaattttacctaaaaaaggaaatagcatgtctatatgtccatagaaagacatggaggcaggatgatcaggtgcttactttgatgtgtctgaggagggtgggtgttgagggcagcagtggggg

SEQ ID NO: 52106 - DNA, 1009 bp, Homo sapiens
ccatgatccaattgcttcatcacttagattccctgggcctagcatagcgcccagcccctagtaagtgctcaactgatatatattgattggaagaatgaatgaatgaatgcacggctctcagatgactgaaaggaggatatgcttctgtttgttcttttgggtgacagttggcagagtgctgtgacatccatcatctccctttaattgaacggagtgggattgaagtctgcaggggcttggcacagggccaggccccagggtgggggtgtgggatccgaggtgaattaggcatcatgggcctggccttggggagctcacacactggctgtgcacagccccctgggaggaaggtcccactggtattgttctcctggatggacagatgaggcttctaatactcagagccaggggcggaggcgggggtggcttgatgaggccacacagctagtcagtgggacagacgtgcactcagatccaacggatatcaagccaggtggcccttcccccacttcttgtgggcacttgggtgggaggtgtcagggatccctggcctttgggggtcttgacatcccaagctcttaccagccatgtggctgtggacaagttgcagggggcagcatggattgtcctgccctatggaggttttattctaatggacaggactgatgccagatatctagtgagtagcttaagtagggatggtgctaagaagaaaactgctgcagagatgggagggccagcgagaggagggatcaggaaggcctttctgaggaggtgacgtttgagcagaggccagaaggaagcaagagagggggttcagggatatctgggggagggtgtttcaggcagtgaggagagctgggcaaaggccctgtgacaggggtgtgcaaggcagccagcgtggctggagcgggagggccaggggagaatgggagcaggtgacacagagggaccagccatggcaggactttggcttctacctggagtgagatgggagcggtgcagggct

SEQ ID NO: 52107 - DNA, 1061 bp, Homo sapiens
agcgtggagtgcggagtgggaggggccttttcctttggctgtgcccaggctgcctgtgggggagaggcaggagatgaggctgctgagtggacgggccccctggggacagtttgtcggggagcttgacaaggttaaggatcttctttggacatcctttcactttctctcaataacctggtgtggatctatcatcccagtatttatctaaacccttgctggacccatttatatcctccgcctctccagcttctcggcgtaatgagctccagatgtggtgaaagggccttccccaaacctctgcctcaagccgggagggtgctgggattgcagggatgagtcttcgttcaccaaaagacaggaaggccttagagcctgcaactcaaccttagcttcacccttacacaggcccaagacacttagattcgtgatcccctggggttccaggccgctgtaaggaccccaaatcctgggcctgagtgttctgtgggctccttagggggcaccccagagacactggaccctctgtggccaccccaggagtgagacaggcagccaggaagctttcagcccatggagatagcagaaatgtccccaaaccaaaccaaaatggtggctcaaaggtgctcagaaacctcccgtcttgtggttcccagctgtcagtctcaatttctaccatctcaagccatgttctcactgttgttctacaaatgactcacttttctatttcctgggtaaatgtatgaagacagaaagtccatatcccgccataaataaaacaccagcatctcttgacaccacagaagttaactgtaactataaatacaacagaggcaggacagggtgaccatgtccggctccagcctggtgctcactctttggctgggcttctgcagaagggaggacacctgagaccagggctcaggggaccagagaggggcccagggagggaggaaaaggtggcgcgaggtgtgcagtggagcttaccactgctggggcagctggggctcgatcccccaggcctggtacggggccatggagagcacacctcagaactgccaccc

SEQ ID NO: 52108 - DNA, 1081 bp, Homo sapiens
gcggtttcaggatggatgggggcagcggaagggtccggaggggaggcaggaagctccactgggcggctggcctgggacggtcccctgggagaagcacaaggagccttcagtcagactgaccgccaggacctcatggtcctgggccctgacccggccctgaccctgagtcccgcctgaggtgtggactgggccccagtccttcccttcgcccgtgggcggctttatctgggagtctccggagggtgtcccgtctgggttgagcaggcctggccgcctgcagatttatgaggtgtgggggaagtggcgggggcagcgggcgtgtgaggcagccctggtgggagaggggagagctggaggatgctctccagcccatggacctgcgctgaccccatttccaccccgaactaaccccaccccatctcactgggccagccccagaacaaggcggcacctgctgcctcagtttctcctcacagacaccttgaggggtgagtagagagaggctacaggcaagaaccttagatatgaggaggctgtagacagaacatgctagaagcttctgtacccgggtcagaagatgtctatgatacgaaagcagtttactaacagtatgctgggtatgattccatttgcaactttgaaaggaataaatatgcatctgtgcctctataaatacattttatgtgcagtaaaatgcctaaatgatgtttagtttgtgacttcttctggggaaagagctttgactttcactttatacctgtctatattgtttcaatatcttgtaagcatatacttttttcacttacaaacttttttaaaaacagagtaatggtagggggtgatggtgggtgggagagggcctttgtgtttatgggtgatagggggttgcttttgtggggtcctgagggtgctcagggtttgggtggttctggaatacttgagtcattctctgctgagagccctaccctccgagagaccccagcctcactggggagaccccacatggatgagctcccaggataaggcaggcacagacaggttccagggaggtgggtagagacagtcagggagggtttcccaa

SEQ ID NO: 52109 - DNA, 1107 bp, Homo sapiens
ccagtggtcttgccaagtgcaggtctgtaggcttcctaggctggcagcatcagcatcacctgggaggcttgtggaaaatacagattcccagccaccaattatgagcctgcccccatgattctcttctgatctcatggggatcagggaatgccaggactgatgtttttaaaacgtgcctgagtccattgtgatgcacagccagctgctaccctgtgccaccaccaaatgatgttcaaagtgtgacagattatgagaagcaaaaaaacaaagagtagcacgaacacaccaaaatgttggcagtggtcgcggagagcgggagggatcgtggggggagataattattattttgtactttatacttccatctgacttttctgtgttttccaaattgtctctaatgagcatgtattgcttttataatgaaaaaaataaataacagagcatctggctgggaactatttggagaggggtgagaataagcattggagccatgtccacacagacccgggtcagccaccccgctcttgggcagggcacttgacactgagcactgagcctccgttcccttgtctgtaaaatggggataggaaagtctcaaagtatagctgggagtgttgagtaagataattccctagagctaacaattctccttcctccttccctctcctggacctctctctccctggcaacccttcccctggacgcccttccctgccaatgcccagttgaagcagttgaagcctcctccccggctcatccagaccctcatggtgtgtgcagtctgccaggggctttcagggctgcctcagcaaagcccattttgcagatggggaaaccaaggcccagggcagccgagggacttggttgccagctctggctccccagcagagggaggggggcgtccacgtgtctgctgcgcatctctgcctgtcgttgccttgctcagtgtgtgtgagggggcagcaagtcaccatctgtgttttccaataaaagaaaatgaaaattgaagcacattaaaaatagctcaattgggattccgagcggggctctgaggcctgctgtggcagacgcccagcctgcctccccctcctcccagcctggcaccga

SEQ ID NO: 52110 - DNA, 1081 bp, Homo sapiens
gaaacggcaaagttggcagagtgggaggtgggtggtaccagcgaggctggcaaggatgtggggagacagggatgatccagcagaggggcctcagagagctgctaaccgttcatggccctgtcctgtgctacctgggcagcccctgcttaacccctccaggctcagctcttagctcccaccacttccagccccacccttcagccagcgcttgattcccacaaaccccgctgtggctcagctcacctcctggcctttgcctctgcttcccctctgcctagcgtgcccctcccactccacatcagtcactccccactcacccagtctttaagcctccatgcaggcgtcacgttctcctggaagccatccctaaatttggcattttcttcccctccttccgtattcatttcctgtaacctgcaataaaccatgtacatcctcattgtgatcttagccacatagtgtggtgattaattatctgtgtacagtgacaacagcttcccctgcaggagagattgtcaccgtcacagtggggatggagatagaaacatttccagagcttcagaggcagctcgagggagcccagcagctcccaaagtatgggaagtgaaatgatgttccgtactttgcagacaaacatttttaattgtagtagtctgtgtttattttccttcctgtcatggcaagagatattggttttccatttataatcatgattacgctttttcctctttaagatgcatttaagaaagaaaaggagtcaagtggaagaaaaagtagtaactaaataattgtacaggttgtagttggaaatggctaaagtcattaatgttgtctgtatgaaaggctcaagcctggccaaccctagtggagcagaacactggcgtatgctcaagtctggcagatggggagaggaggcccgtgtgccaagccctgtgctaggtcttagggatcccaggaccaggacccagcaccacctctcaggggaccacagagctttgggagatgatagcaaataggggtagttaccacccagaatatcttcaagtgccgggatatctcgaagcacccgtggctgcagagc

SEQ ID NO: 52111 - DNA, 1032 bp, Homo sapiens
gtagagaggcggagtctaaaccgagggcagtctggagagttagagtcagatgactggggcaatggaagtaggcggggctctcagtaaagaaggatgagggcccggccgtgagggtctggccgggcacggtggctcacgcctgtactcccagcactttgggagggcgaggcgggcggatcacgaggtcaggagatcgagaccgtcctggctaacacggtgaaaccctgtctctactaaaaatacaaaaaattagccgggcgtggttggaggcgcctgtagtcccagctactcgggaggctgaggcaggagaatggcctgaacgtgggaggcggagcttgcagtgagccgagatcacaccactgcactccagcctgggcgacagagccagactccgtctaaaaaaaaaaaaaaaaaagaagaagaaggatgagggcccaacagaaagattgacagcgcctggtaggtggggcggggtggtgactctttgctctccccacagaaacgctaatggactccactacagcgactgctgagctgggctggatggtgcatcctccatcaggggtgagtcagtggtccccaaaccttgcattggtccccaggatccctcaagccctgctgcagggcccgaatgccccctcatattctaacccctttccccctcttcaggacccagagccaggcctctctcagccccaccctcccaatcccctaccattgatggagccatgatcccctaccattgatggagccagttaccatgacaacaggctggatgctttcagcctttatcccgtggaatccttagggcaaggctgagaagtaggtgctctcactacccccgttttacagatgaagaaagtgaactgtcgtttcctgagtacccattctatgtcagatactgtattaagtacctttatacacatcatctctgatcccatggagaggaattatctccattttacagatgagaaaaccgaggctcagaaaggtgtagccacctgcccagggccctatagataataagtgaaa

SEQ ID NO: 52112 - DNA, 1444 bp, Homo sapiens
aggtggatgtacccatcaagctctactgtaacggggacggcgagtggctggtgcccatcgggcgctgcatgtgcaaagcaggcttcgaggccgttgagaatggcaccgtctgccgaggtaagggccagggtggggcacgtgcccctgcaaatgcatagaactggtcttggctgcagactcgggctgcagacttgggcctggcctctgaagcttagagctgaccatgaggcactctagggccagggtttccaaaccagcaaccatcgttcagcttcttagagggaggcacttgaatatagcactttctgaaaacgatccgcgcacatgccgcaggtggtataccagataatctgggttggcacaggataaaggttttttgtttacatcatcatatgagtatgtcaagtggtgtcaatttcttcctttacaaaggtgatatggttccccttttaagaaaacgtatgttatagtaagtaacatttatatattaataagttaacatattttgagcttttactctgtcagtatagaccagacaatgctgaagtgaccaaacaataaaagtttatttctccccttaatgctccatgtccattgtggatcagcttgggactcctccctctgagagccaaatggatggagcaccaccattcgggatgttgccatctgcagggcagacagatggaaggagtgtggcagttggaatactggctttaaagcttccacctggaatgcgcccccgccataacctctgtgcacatttcacgggccaaagcaagtcacaaggttacttcctattcaaagagatggagaagtgcaattttactgtgagccaggcccacgactcccccttgtactatgtgctgagcacttctatgacttaattcatttaatcctcacaaggaccctgtgacagaaagtactgttgtatatgaagaagctgaggctcagagagcttaaacagggactaagtagaggatctgggattccaaagcccaccctcttaaccaccatgccacactgttagcttaaggaaaactattaagtaagtataagtggtgtttgaatatggtaaagaaccatgaaggtggtctgcaaacaagctttgcaaacacgagaagtttgtgagaggtacaccctggtgctaagaaggctgtgaaggttgaaggacctgggttaaatcaccccttccactcactagcggtatcaccttggccaagtgtaaaaccctccttcctaggctggtgtgaggagtcaggaacttgaggcatgcaaagtacttgtaatggtttccagtacacaggaagtgcttaatagatgttaactaaatgagatgatgtgtacaaagcccagatgctcagcctgtgagctgcaatggtggtgctgggggtataggggacttgaagctacttgtgtcatgtcctcttgcattccccattggatt

SEQ ID NO: 52113 - DNA, 1073 bp, Homo sapiens
taatccagaagtgacatcttgccacttctgccatattctctgcattaaaagcaagtcacccaattcagcccataccccaggggagggaattacacagggtgtgaatgccaggaggtgggatcatggggccatgttagaggctgcctggcataggcaggttctcagagtcagagctactccttgcagatggtgagggtgcaaggtggggcagggttaaggtgtgcccagccctggctcccttccaggctcccttccactctcatcttcccctggacctgaaagcctccccaaggcctcagcccagcccagccatccactgagtgtgagtggggtccagtcagggtgtgattaatgagctcagggagcccagaaggacaccagctgttgctgtggcctgtgctgctgtcacccagatgtgaggctgctgcagcccaagccccataggcactggccctgctggagcaggacgtgcaggaatggtgattccagctcacatccaagtaacattggccaagtgctttctcgtcctctagcttagggcttctcaacctttattgtggatcagagtcacctggttagttggttaaagtgcaggtttctgggtctgactcaaacctctcccccaggtctgggaatgtggctctgagatggggccaagaatcagcagggtttattttgttttgtttttttgtcttttgtttttgtttttttttttttttttttgtgacagggtctcactttatcactcaggctggagcgtagtggtgcagtctcaactcactgcaagctctgcctcctgggttcaagcaattcttgtgcctcagcctcctgagtagctgggattacaggcgtgcaccatcatgcccagctaatttttgtatttttagtagagatggggtttcaccatgttgaccaggctggtctcgaactcctggactcaagtgatccacctgccttagcctccctaaagctgggattacaggcatgagccaccgtgcccagctggaatcagcatttttaaacaagcagtcctgatgattctgtaccaggaccatgagctcagacgcacgatg

SEQ ID NO: 52114 - DNA, 1030 bp, Homo sapiens
tctttctggagccccttgtcatctctaagatgtccaatcagacagctccccccgccgggggaggttttccgggacctgttaccatcccgccaacccatccacacactcctcttcacacgagccacgtgttctcaggtctgtgaggagctcacactgaggctggcctgcctcttcccacccagggcagagaccaaggtctcaggggagcccaggggtctcactcctgctaaggtggaagtgggtgcaacaagtatttattgagcaccttctgtgagctcagcaccatcctagaacctggaaatacagtggtgaacaaaacagacaaaatagctgctcttttggaccccacactccacctgggaaagacaggcagttggggaatacagtgggaaatacacagtatgtcaggcggtgattaggacgacggggagaaacaaatcagggaaggggatgggctgcgtagcccccatggctggggggccaggggttatcctgcggggtgggctggcctgggactgctgctcttgctggtatcctgggctttctgctccttcctcgggccttcccagtctcttcccatgggacctggtggaggttggtttaagttactgttttcataacgaggattttgttttctggtcacagtaacctgcttgcccaatgagacaacaggccaaggagagggctgtgagtgcacggccatttccatctcacttgcaatccgtgagctttgtctcctgtcctctctgtcccccccatcccccaaacaaagggggccaaggccacagcttgccagcttcacagctgtaaaaactgaggcccaagaagttagatgaaatgacttgtctggggaccggcactcaaactcagggtctgacgcctgactctgtgcctcttgctggaatctacttgtaagtaacagaataagaatacccggaggaggcaggcacaggctcttatcaattgggtgctcactctgtgccaggctgctgccttgagcttggtgaacactctgctgaatccttacagt

SEQ ID NO: 52115 - DNA, 1022 bp, Homo sapiens
gcagcccctcgtggggtcccctcccgccccctcgtgctgcagtctttgtggcccaggaagaatgcctctctttatctcccagacgccccttccctttgattctcctctacccagcgtttctgctgacctctgcgtgttgggaatccaattagaggagcggacagggagagtgacagccgcgccgaatcccgcctcagcccctccgagcacgctcagccaagctgcaagcagcgcggggcctgcttgtcatgctgggccctgcgcagggctttgtggggattagctgctggggggtggggtgctcgcagatgggaccagaagtgatgctggtgaatgtcacgtccaggcagagagtggaggagggggcccgcccagtgttgaatccagcttggggaagagaagagaagggggctagggggcagactagcctggcctataggaggcccatgggggaaatgatggcccagttgggttatttggttccccatttgagggttggagggtagagctggcagccaagctcagctgtgtctacagtggagtgggcaccagaaggatttccacctgggaggggctttgggggattgattggattgcaggggtgggtattgactcttcatttgcaaaacactttatgtatgatggaggtggggaccctaagaatggggaggtggcaggctttgagagatgtgtctagagaatctgccaccaccagccaccccttggcagggccaccagtctaaggccaaagactatgcccttccccagccagcaccatgaaagttacccttctggtttacagctgtggaaactgaggctccgagaggagaaaggtctggctcgaggacacaagggtagtccgtagcagagatgtctcatccccctgtccacccgcaccacccagccccacccccaactccctggacctcctgagtgatgagagtccctgatgcccttccccacagagggatatggcatctgaggaggtggatttcaggccctcaggggaagcagtatcaggt

SEQ ID NO: 52116 - DNA, 1043 bp, Homo sapiens
gaccctggctccgagttcagtgctccctccaggccaccatgaagcttctcagtgaaacctgaggtggggctgggcccaggatcaggccgtgttgggtgcagccagcccacgctggaggctggcctgagccctgcattggccccaggcccttcttggctctcaattttggtccaagtctcaggggccgttcaaagattccgaaggcatgtgaacattttggaagcaatttgtcagtcctggaagctgcttggaggctccaaagactgtttaaagattccagaatctgttatatttgcaagggctgttgttcatagtttccagagtggtttgcaggccctgggcgaaggtccggaggcagtgtgggggtctggggctggaagcatggctgggagcccggggcggtgctggaagtggaactgacggctgtctaagctcccagttttctctccaagggctcagtctatgaagccaccatgtccatcgggcatctgctgttctgagaggcagaaggtgtgtgggtgttggcagcagcaggagaggatttaaaatccaactttaccattcacgtgctgtgtcacctggagccaattacttaacctctctgggccttcttttcccccatctatacaatgggacttagaccacctgtgctgcaagcctaactgtccaccacccatctcatctcaggcatctgtcggattagtcagagaacatccccatccagaactagttaacactgttcctgggtgtggacttggtgtctctatccagggtggaagcctggccttctgtaatagccctgccggccctcctaaaaccagacctctctgagccccagccctgctgtgtctgtcactggggaggagccatgcactgtgccaaaggccctggttgaccaggatgtctgttcctacccatgccccgtggaagtttctggctggtcacaatcccagtcctgcctcctgccttcttcataccgcattgccttctccagcactcttccttccaagcccattggcccaactcccccatccccacccacc

SEQ ID NO: 52117 - DNA, 1123 bp, Homo sapiens
gcctgactcccagggtggtcatgaaggtcagatgagatgatggataggcaggagatgtataaagtctaaagtgatgaggctaatggtggctgagtgatttgcctaaggtcaccctgggggagatgggggccaagccaggacctcagtccaggtctcctggccaggacgtcgaccactagagccccagaccatcatgggtgcccctctgagaagttttacttttctccaactccctgacccacttgcagagctgcaagcaggcaggctggctcccagctgggataatcactggccgctggctgaggtgttaaatgcatcgtgccttcctggtagacaggaagatcaataccaaggtggatgggcagcctcgctggatgccacagccagcccccaagggtgagaatgggccaagaataaatataaccaggcctgctccctccacagggtcagaccaggccagatgaaaatgctgtagctttgatgggaccacctgtggcattatcatcatcatcccaagcaacatgattagaccataaactcttctaaacttgtttgttcctgacatgtgtaaactcactgaatcctcataaccacgctctgaagcaggtcctgatattattcccattttacagatgaaatgtggcacagaaaggcttgtgactcaccgaaggtcacacagctagattagaacccgcagttgcctgggtcagagcccatgcctgctgctgggatagtctgctgcctttttagtcatatggaccatcctgtggccacacatgcccacaggctccttcctgttcagaaatggcaaatcaggggccttgtctccagcccccggtgtgctttgggcacaggggtcttcagtgcctgagcttcttggagttttcagagcttggactgtgctttagccaagagctcctggacatgtatagacacgtacctagcagatgcccatgctccctcattcttctagagctcagagcaggcaggctaaaggcgagcctggtccccatagacactctgggcatgagtgaccccctgcttggcatgaactctcagggatccgagcccttggactgcagtggtctcagcctcactgcccatcggctaggggcctgcatag

SEQ ID NO: 52118 - DNA, 1014 bp, Homo sapiens
ccctgctgcaggtgggaaaccaaatcaacatgtctgcccctggcaggagccagagaagcatctgccaagagagttagacaaatgaggatcgtctggggggatgctggctggtgtctgaggtggggaggggagagtccaggatctgagtcagatcccttgtcccagagtggctgggagctaagagtgcagggtgggttgaaggctgaggcctgaggagtgaggaggcccctgctgaggctggatgccagctcagggatttaagctgtaaccctgagggcactggggagccacggccagattctgagcaggagagtagctagatcagctgattggccactggcagtgcgggagtgaattggagtgaggaagcaggaggcagggaggctgccttccttcaggcagtgagtctactaagtgcgttcagtgtgacctccagaagcatagatagtgcactctttagaaaaaggtgggcgcacctgcctctccccacggccttgggcttaaggagtatgtttggcatttccttgtagtaccagttcccagaatatagctcacactttctgcaactggggtctgcaaaccccagaatggggagagggtcccaaatatattctcaggggcccaggaattctaggagaatttaaacttttgatgtttagatttggatgctgattctaacagacaatttggttttgaccagttctaaagcaacacttctctcccagtgatctctcaagggggaaggcatccttgctcctggcatcggaggactggagaggtagtctccaagggccacaaaagaccatttccgtttctaaagagtctgttcttgtccagccctgagaaatgctgtcacgcctgcctcccccaggacagtgagctcttccagccgtgctggagctggtctggctcactgtgtctccgcagcctgacacaggtccggacccagggagggtttatgaattgaggcaggttctttctggatgtcccacagctccctccttgtctggccct

SEQ ID NO: 52119 - DNA, 1090 bp, Homo sapiens
tgttggagatgattataaggggagggccaaaatgatcgtgggaatccaatccccgtggcagtaggtgggagatgctgacctgggcttcctcagaaaggtgtgaaatgttgacaccctccccttgggctcttcaagggctcaagaggggctgtgttaggctgggctggaaacagagggctgaccatcatgggttccagagggagctatccacccccctacctagccagaggcagccaggattccattaacctgattctctgccccacataaacctgcaaagggagcccctggagggaggggtactggggagaggaagaattgggcttccccaggccccaaatggagcagccagtggtgctagtttcctctcttgcagtccaggaggaccttcgaggcccctggctgtttgagcggggaatagggagagcgatggagagccagaaagtagggacaagagactccaggctggggtgcaacagcaggaatagcaggaacagggtgcacgtcatcagaacaatgggtcctgagtcactctgtgcctgcccagccctgcatggccctgggtgagtcatgtcacttctctgagctgtgggttcttcctcaatagtaagggcaaaccaatgccacctctcagtgttgctgggctgattcacaataccgggcctcaagaaatggtggctgttgccaatgctataattttacaatcttgaccccatgtatcccttctcagcttgcaagccacattcatcctttttctccttggagcctcacaatacttctgcaaggtgtccaggattcttaccagagaggttaagggacttgttcagaatcacacagcttctaacccttggcctgggatgcacccctagtgattgtcatggagtgggccatcccagccaggctacgccactcttcttcagtctgggtggttgctattcctctgccatgattcacgtcagatgcctcttcctccaggaatccctccctgaccacacaagagcctggttagtacaactctctgctttcccacaacctttgagacatttatcagagtgtttatcagcagtcatcacaaccgttaggtgctccc

SEQ ID NO: 52120 - DNA, 1036 bp, Homo sapiens
gatatcagaaatgaggaacacctgttgccacttctctgctgaatccgaggcagacagtaccaatcaatcacgatgctcttcctgccaacccacatgctacttcaggatcttctgaatctcaacgcaacactctgggcaaccaccagtcaattggtcagagttggagggcaatctgaaactatgcataccaaccctaaatcctaaccctggacttgcccaaggccatttggccagaacgatctgttctgacactcagacgcagggtctttcactcactctgcatctccatttgctcctgaaagcaactcttatggagtatccaccaaagatgagtaaggcctggtgaccgtcagcaagaggctcaaagtctgggggagaagaaagtcaaaggggaagtaattgtgatatggggagaaagtcagggatatacacaaatccctgtgggaatttggagaagagaacaacctggctattcaaggacagggttagggggcagggtggtggttaaggaaggcttcccaaaggaaaggacattgaaatcagcactcagccagcaaatacatggcaaacatggggtcctggatagggtccagatgcctcaggtgtctgaggatgaaggacatctatgaactgacattagaaggcatcgtagcagggccaccaaccctggtgaatgggcaaagttgggacttgggaggagaaactcaggaggtaggaagggaagtttctaggctgttttgagctgaagcccagtgaactagacggtcaagcccctactgaactcacctatcgtaccctacactccttcacttgtagccctcatcatactgctaattatttaacataggtctaggctgggagcccggatagggcagggactggatctcatttgttactagctgggacttgaacgtagccctggcgcagtgcctggctgcttcattgtaagtactcagtaaatcttggacggatatgtggatggatggatggatggatgaatggatggatggatggacagagagatgtcatgcagcct

SEQ ID NO: 52121 - DNA, 1048 bp, Homo sapiens
gcggccaagaccagaccagagactgctgaggagggaagacctagtaattgattggctgtggggggacagggtggagagtgatgccacttcccagggcagagaagagtgagtttcatgaagcagtgccatagatacagaaatgatacagtgcccggtggtgggggtcgaacctggccaggcaacagagcaaatgaagggcggcttagggcaggggcagcctggggagtctgagagggagccaggacactgcaagggggagagggcagccagaaaggcagtccagatggagaggctggcaccgcacagaggggagagagagcagccacccactggcggcccccccgggaatgccccgcagatggaggagggatgctgagctgggcaggctgtctccagagagggagcaggaggagcctgatcttggggccaaaaccctttggcatctctaaggatggttctagaccttcctggaagccttgtgcccccattctgcagaggaggaaacccgttcagagaggccgactgctcgaccagagctggggctgcagcctgcatgtcctgactgcccagaagctctgggcagtgccaagatggtgaggctgccccttcatccagccatcagggaaaggtcggtgcccaagaggaaggcgagagggagggcaggacgactcaggggacccagacccagtgcagtaatcctcatgattactttatgtggtagatgctcttaccaatgagaacaatgtagctcagagaggtcaaataacttgtctaaggtctctcagcaaattgcttttgaaccagatggcttagtactgccaggaactgttacaagtgtttttacataagttaagcaatataaactgacaacaactctaggaggtagatactgttgtcccattttacagataaggaaacagtttaagtgacttccccgaggccacactgctcacacaggtgggtctgggtttgccagcagcctgcacactaaccactatgttcactgccctcctgcttgcatggcctccaaagcccatgctcattccac

SEQ ID NO: 52122 - DNA, 1048 bp, Homo sapiens
tgcactccagcctgaatgacaaagcgagattccatctcgaagaagaagaaaaaaaaagtcaacaagtgatagaaaagacccctaacagattagaaaacctcagctgtgcgtctctctggcttgacaaagctctgagctggagaaacccaggcccccaaagggggtggtggagagggaactctttctaactggtagaagccagaaggaagctcctggagccctttccctggttgcggggaactctcctacatccatttgggagctctgcaggtggaactgcctactcaagacgcctcagcttatttgtagctaggagtggttctgggctgctgggatggaccctgctgtctggagctggatgtacccaggagtagagatggggcggagtatggacgtgaggggtttccggggaataggcacacagggagagccctcaggatcgaaagacagagaagcaatgagaaacaagcactggattaggagcagagaccgaggcttggctttgccgttcatttgctgcatgacattagcaaatgaacggcattcatttagtcagtgtatgagtcagctactcctgcaataatgctgcataacaaaatcaccccacaactcagtagtttaaacaataaatatttattttctcactcactagtgtgtgggtcagctagggtttgactaatcttggccatgctctctgtgctgggcaggtctccagaatgtgatttgggttcagcctatttcatgtgtctcctcattctccttggactggcagccaccccaggcttgtttctctcaaggtgaagtgtaggagcatggagggagccaaccatatctcattggccaaaacaagtcccacggccaagcccagcatcagtgggatggagaagtatactctgcccacagtgagtgggccctgcagatttacttggtaaaggatgtgggtacctaatcctatcacagaaaaggaagaactggggtcattgttctaatctaccatgcacgtgaaaatcacttcctctgaggcctcagtttccccaccaaattgtac

SEQ ID NO: 52123 - DNA, 1052 bp, Homo sapiens
aaccccagcaccatggccttctagttcccgtggttgaaattttaccttgtgtcattgatcatttagttcttgttcgtctcccccatcatcggcactcgcagcacacaatgggtctgcttttcctcaccatggttttcccggcacctagagggggctgcaccacagtgaacattcagcgaacatttgcagaagggttcggagaagcgtggggtgaggtggggtgtggagaagtgcaatcgggctgggaaacaaggctggggactcaatttccagacaaatgcattcagtggtcggttttaaacagaccctaaaattcaatatataaatatctagctcattgccttaaaaggaaaaagtgtttcttctgggcaagtgactgggccttgctcgcaatcccttggcattcaccggggccagaactgtcttctgacttcatccagccatcatgccgcctttgaaccacgctctgcctttccagagcacctttctgcctcatattcatgagtcgtgctcatggccccgaggaaggaggctgggctgggcttgagggataaggaaacgggttgggagaggtcatgccacatactcaggtgtactccgctggacagtggcagacccaggagtcagtctggctgttcagagtgagccacgctaccctcctgcctctccacacccacagacaagaccatagcagagaggggcaggagggagggacagaggctgagccttagggtgggcagtcagaggagagcttctctgaggaggtggtgtttaagctgaggtccgaatgacaagcagacagccctgcagacctgggggctgggaggtgtagcatttcactgatcccgggcttctatccagcgcccttggccattctccagggctgccccggacacagcctaagccctttaaggatctcaccctgagcaagcccagaacacccccacctctgccagcttccggaagtagtgggaagggtctgtgctttggaatcaggcagccgaacctggctttgagtcaagcctggccgctcaccagcatgcaaccttgga

SEQ ID NO: 52124 - DNA, 2473 bp, Homo sapiens
caccagcctgggtgacagagcgagactctgtctcgaaaaagaaagaaaatgtaagctggcttccccctcccaatagcaggggagagaaggccccctagggaccctgattccgactcaagtgctcttccacctcacaccatagtcgctccctccagctgtggctgcctgcccactccccactccccactccccagtactccttgctttgccatcttcctcccggggaagcccaggcagctctctaccaggcacaggaccccttcacccgcatatttccctaacacacgtgcttctctcccaaagggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatgacccctgttctctgtaagttccaagggagaccttggtacccttgggatgcacgtgacccaggtgctaagggttgctcttctaagcagcccttcctccctcaggcttccagaaagcccagggcagagaaaacacatggagaacgacagctccacgtggcctttctggccctggcttgtcaaaagcacaggcaacaaaggaagtgagttggaagtggctcagaactcagccttcgatgccctgggaatcagggtgagcccctgcaggtacataagtagcagagaattgacgagagtgcactcgg

SEQ ID NO: 52125 - DNA, 1031 bp, Homo sapiens
aaactgaggctcagggggatgaagtactttgctcagggtaacacagccaggaaggagcagagcaaggccatgagctttggatttttctgtttccaatgtctcctctaccgtgctcaattagatgatgagaaacagttggtgtctgatgctggccaataagagaaaagaaagctcaagtgggctggggctgtcagggagggcttcatggagaggctgtcttgaaaatgacagaggtcaaaagaaaggtcactccaagacgcagctgccagaatggtccaacacagtgaggagttgtgtctggatgggccagtggaacgggggaagtgaaggttgatataagtggaggttgaggcagtttaggcgtgatgtacagtccagccacagcaggttcttgagcaggagggtagcatagtgagcatcaggttctaggaagaagcaccagttcagccatcagatggggcaggatgcctcccagctactcctctccccgagaaggaattgcccccggagcggccctcatttattccaggagaagccaggccctgctgcttcagtttccatcctcactgacgcagataatccaaagagtcacttcagctgcttggaacagcagggttgggtcttgtgctacctgattcttaatttggctgatgtctaccccatttcctccaggcttctctagaggtggcaggggtggggtggggagaaagctgccagacaccaaaggagctgagcctggcgggggcgggcgtgcgggtgggcatgagaaattgctcaggaaacccatccctgccctggtcaccctagtcctggagagatcacccagacatgttggaatgagtctggggtcctgtcttttccaataatgtgttatcctggggaaacccagagggaagttgagggagccccactgtgctgtgtgatgctacatacgcatgcgaatacaccaccgggtggccttgacccagccttctgcaaaatggcttctgccatcaaacttaaggtggagaatggtcttgcagctgccagtt

SEQ ID NO: 52126 - DNA, 1032 bp, Homo sapiens
taataatattcaccattttaaaatgtatgattcagtggtttttagcatatttacaagattgtacagccaacaccacaattgattttagaaccttttcatcatccccaaagacatctgtatcattagcagtcactccccagtcctccctacccccagtccctggcaaccactaatctactctttgtctatggatttgtctattctgaacattttatataaaatcttatgtagccttttgtatttggctttagcatgttttcagggttcattcacgttgtagtgctttcattcagtacttgataactctttatggctgaataatattccattgtatggatataccaaatttggtttacccattcatcatttgacgcacattggggtttgtttccaagtcttggctattttacataatgctgctgtgaacattaatgtacagtttattttgtgaatatgttttcagttctctttgggtgtgggcctaggaattcctgggttttatgttaattctaggttttacttttgaggtatagccaaacagtttcccatagcagctgcaccattttacattcccattagtaaatatatgagggttccagtttctccaatgttcttcttcgtttttttttttttgttgttgttgtttttgagatggggtttcgcttttgttgcccaggctggagtgcagtggcatgacctcggctcactgcaacatccgcctccaaggttcaagtgattctcctgcctcagcctcccgagtagctgggattataggcatgcaccaccatgcccggctaactttgtattgtgtttttagtagagatggggtttctccatgttggtcaggctgtttcaaactcctgacctcaaggtgatctgcccacctcggcctcccaaagtgctgggattacaggcatgagccactgcgcctggccttcttcttcttttttttttttttttttttttttgctgagacagtctctctctgtcaccacccaggctggagtgcagtgatgtgatctcggcttacta

SEQ ID NO: 52127 - DNA, 2444 bp, Homo sapiens
cttacagattagtttgaacctgaactgacacaagattgtttcatgagggctttgtttttaataactacctattatgagctgccttgttccttgttgtatgcttacttcccttaaaatgtgaggttaacaatttacattgactgatggttccaaatagagtccctaattttaaatgttcactgcatttagctttccctggtatgatctccatataggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgagttgtagtatccaaccacagttctgttttatcttagaaataagaatgaatggatttatttccattttgcaatattatttatgtctttatctttggtttataataaagtctgatattgagtctcctgccatgtgtgtctttgtgtgtgtgtatacatatacatgtatatgtgtgtatgtatacacatagatacgtacatactggtactgatactctttttgtgtgtctgtacatatacaggaggaaagtaaagggtgggaatggaaggacagtggcaatataaggtggttggaaagtaggagaaaataaatgattagaaaaaacatacagaaagccatatccaaagcaccagacctctcaatgacagttctgattcagaaattgttctggctaaatgatgtgtttaccacgtagttagatactttctgataaaacttccacggtgtggatcggttttgagaagtgccttttcctggtgaacaaatgtaaaaatatatataggccagaaaatctagaaagattatgggagtctatagttttggtttcagagcttcaaacagctttaaagaattctcactaacatcccctcaatgctgagtactagctttctgaggatggctggaccaatcagggatatctgcctttctgttttggagagaccaagcaaaagcagtattttaatgaatttttgtatcttgtgcccttaatgacattttatttactctttttgactttgaatttttactaagttcctcttcttgaaataatttttatgtttcgaatagcttcagacccacacacctctctggttcttttagtcctgtaccttttaaaaacaaaatggtggtttcagaccccatctgctatatcttgcatgactttcgtaggtacccagattaagacatacttcatttgagatgttttatcttttgttttagccttttttttttaagggttttctcccctatggtgttactgtgaattaccagaagcagtactgatgcttcactttagggcattaccagtcaagtgttaacttaggtttggagcttatcaaagtctggctaaaacttaaaaatcaaatttataatttataggattgtaataaagtgtactaaaggaatacagtttgagaacattcagaaaaagattctggtttcagttcattcaaaagtcagggattttctaagaagagtggttttcctaaaactttcttaaaatgatttcttgggcaactccttgtttgaaggtttctagtttcagtagtatattacctttggggctaatgtcccaggcaaatgtagctgcctttttactttacacctctcgttattcatttttcttcttcctctttctagtcttatacatttagctctcttccttctgttcttacctccaacctttcccttcaccctgtgctcttttcttctgtgttctttttggttcttacctttcttctacctttgctgtagacctgctaatgagatacttggggataacccttttaatgtctgcggtggctcaagagtgggctgacttcttagttcaagggctctaagtactacgcattgatgatctgatatctcagatgctgcctcaccttttttgtgtggttgtgtctccagtaaataattgatttaccataggttccaagttgataaacgtttctttgaaaattttaaaccatgtgttggtgttgctgtttgcttttttctgaaagcttttttttttttttaatttcataaacgtcaggtattgttcccacaaaaagtaaacgtcttagcaaaaggatttaggatttgggagctgtctttattgtgttgtagttaattataatgcagtggtttagtttaagttatctttgtttttggggggacgttaaaattttaagttgaggatatcttcaatgcttagaaatgtgctgataacagccagaacttactaatatattatttgtggttatgaaaatagtgattcttcctttaaaacaacttaatgttttttttgaaaatttctggggtgaattagggatgtactttccctagaaaaaagtgtcaact

SEQ ID NO: 52128 - DNA, 1141 bp, Homo sapiens
tcagcggtagccctgaggttttttgagcaaggggggttacactgaaatatgtttttggaaagaccaatctcatgctaagcgtgaactaaaggagtaaagaagctgagattggagagataatttaggctattggtcaatggaaaaatgttcttaatatcaaagttgaatttttatggaaagaaaaagtttgggtgtttttgtctgattgcacttatataattggaaggaagttctctctgttgacctaaatattgtttttagatttatcaatttttgaccgtaagttaatgtgatattgtagtcctatggtagtcaaaatgggtaaataatggatttttcataccaaatattactgtttatatttaaaaactacctcattttgttttcctaaatatttccatgcatttttatacttactatacttttgaatatatttgttttaacacatgatggttttatttggtttcctagtaccttttctgtgaagatgaaagtttttttaggtcatgccaactaaacttgacaggttgtctttggaattgagtgtgtttggttactagcagcgtcacataatagtggagcgtttatgaaatagagtcaaatctccttcagttggacttcattgatttagaataattgtcccccagtaaagtacccttctgtttattggagaaatgcctttcctgtctttgctcagattgttaccctgtgtaccttacattattttcctcaatgagttttgcattcctgtattaactgattctccaacacttacttggcttttttattttcacatggaaacatgactccattttttttttccctccactgcctttcagcagtcaaattttaccagaaaaatcttactagttagttcctggatttaaattgtgtattgggtaacttttcactagagaactcaagatacattctgagttagaagtagcttagttgtacatagcctgagactttcatggaaagttattctaaaataagtaaaaggaaatttgaaatgggttattaagatgcctttcttaagcctttttcaagttaatggatttttcagtagagacatcagaagtgtgtgtgtatatgcatgtgagtgtgtgtatcatttttctaggctccttgatgtcctagt

SEQ ID NO: 52129 - DNA, 1128 bp, Homo sapiens
taggaaaaaaatcagggcagctttagaccagacagacacacatactgtgttactttgggaaagtgtttgtggtgggccattttcagtaatgagtcgattatgaaatagataactttttaagcatctggaactgtttgtgtgtgtgtgtgtgtgtgtgtgtgtgtgtgtgtgtaaaacttaaatcttgataataatcttttaagttaaatcatgagaatgacagactttgggactttctaacatagtttttttttctttccttaagagaataatataattgaaattcttgcatcggctgttgagttataagaaatgttttgtaagctttgttattaaccagacacaccttaagcttggtagttggacacataacatctgaattgtaagctttctctggaacattttgaaaagtgaacacaaaccaagactgcagcaaaataagtaaggatcaggaaaatttctactatggaatgtggagggaaataatatgtgaaaaagtaaattctttccattggcttctaaagctttgcatttctccctagcttgtagggccttttactttcttttgataagatccttgctactacccagtggaagtcttcaagcacatatctgtggtgttattgttctttcagcagttcagtggaagttccaggcaagctcctgcttcaagcaaaacaatttttctttttttctaaaccttaagaaggctgttttacttcagtattttacatgatactgtaacccagggattgctattctagttggaactcataatttcattttgactgttgctcaggctggtcttgaactccttgttgtaagtgatcctcctgacttggtctctcccaaagtgctgggattacaggtgtgagccactgtcaattcctttttgaaactgtgactttccttatgttcatgagattaatcatgcatttatgactgcttcaaattatctgagcctattattacttccatgctattttgaagtcttttagccccattcttacttctgagttctattgtttaatttccaaccatctttagaacatttccatttaattgtattagccagtctcccaaatttcccattttgtttgtagcattactagtcttctgaacttaaaa

SEQ ID NO: 52130 - DNA, 3697 bp, Homo sapiens
taaaatgtaggacctatattttcaagataagtttgcagattggatttagtaacccgatcgtctcttcatgattgtatgcctttttccaagggctgtaaataggtataccttgggccttgtctgagaagcataaccttcttgaacctaaaggacccttcagacgagagcttagtaaaataagtttagaatgagattctattctaccttcataacagagcatgtatcttctagcaacacattctaatatcattgtcagaaataatttcttatatctaagtatctttttattctctttgttgttcccttctaactcaaatggtggaataatcaatctgctttcttattggggtacgtattttaaaataaactttaatgaagcttgtctgagtttatctagatcattgggaggtggtattttatgtcttccaaagatcacactcattttcctatagtgtaccaggtgactagaagcttaagagcatcatagcatctgtcttgatgatagattttggaagagttcagaagacaatctattctttatcagattgaattttcaagctttgattcttttcttgaagttacttctacatattaatcagtgaggaaaatttcttaacaaagcttattatgtagcatgaagtagaagattcaagatcttgcctgcctttctctgtgttaccacaagtgtgtgtttatctacagtacttggcacacacacacacacagtgtcttattgtgtgttctttagttttatttaggaagcactggcatatttaactgtactagtgtctactgtgtatagtaaatgaaacttctttggagactgagtcttttaattatactccttgctttgaagagaaggagataatttttcattaaaattagaaagttaaacggatattaagttgatgctgaattgcaatgccagattctagagtctatgtcagctccattttcagtctagcagccgttagtaaaagacactcggaatccattttcccccatccagactattaatattaaataagactgacagcaaggatttagtgattagaaatactatgtactttgttccactgcctttcaacaagaatcaacatgtaaagttgaaacttcctgaccagaatttggaagactatgatgtaattccctgggccttgattccagaagaaggagctctctgaatatgggtttactagttggtggtgaattcatgagtcgccaactattaggcctttatgtccagatattatcctaatttatggagtaaggtccctgagttctcctctttccttccacagggcaagcaggaggacttcaagacgacagttctggagggtatggagacggccaagcatcaggtgagggtggcattagatgcttgccacttagtagcaagagccgccaagtaggaattgatgcttgcaagtgtttttggctgtggtatccacattttagccagaagcgcaggtgaaatttaacccacaggacataatagtatagtaggagagagtgtagtgagaacaaaggcaagcaaaaccttttgaagtcctcaggccgatctcagccctccactctttgtgttttcgaggagatggcgggtacttttctccccagcagcctttctattaatagtaaacatgatatagaacatagacttaggaatcatgggacccttaaagagaaatacagcagtatacacagagaggaaaagtcacaggctcaaaagtctaaaagcaaaaacaaacgggactgagaggcattctaggactagtcagaggaactatgtgggcaagtgacatctttttaaaaatggttgttacagggtattgggtaccttttttcagttaacattacgtagttaatcattcttcagtttaaacattttgtttctcatgtgaaaaatgtcttttgaaaagtctgaaatacttttttctgttcagaccaaacagtatgagatttttacttctaggaaaaagtaaagaatttataggggccaccatctggaacagttaaaatttatcccagcaatccaaaataacgtatctggatttcatcctttgtctcttgaaggatgtttttgttccagttgctcaaagctggtttatagatacgttttgatagaattggaataggcactacttcacttttggaggttgtcacttttcaactgtcttaagtctactttaaaattatttgttttgcagtttgcatataacaggtcctgggactgtttctatttcactctcttgaactaaaggtagttcattgttaatacagcaattagtaataaggggatccagaatgttaggagcagacttttaaaaatgctgtcccaaggattgcaggttgataatcagtacatggttatcttagcagaattaaaccctgttcagagtctagatctgtggcatataaaccttgaagaatgcttttcatcaaatgacgcacaattagatcttccatggaactgttgaagatcagggatggcctttagagttctaatcttgaagaaagaagttgagttttcttgttttttgtttctgttttttttttgtgtgtgactatttgctcttttgcattaagtaaacaatatcatatattgctgaaagtgaaagcagactttcatataaaagtgtgctgctgattactgttagtagaacatgaattttaagtgtttccaggaatgatggtgactgttgtaaaaccttcaagatctctcttccaatctttgtcacgttcagaagcatgcatttgtgaaatgatcaatcagggttagaaatgtgcttgtaagagatcaacattcttctcttaatgaagccagatgaccctcatgggtatcttggtgccaggatcatatcttgacttcttaaaacccacctcaagttggtgtacacatcctaaatcttagagctagaagagaacttgaggtcatcttgtctaacttcctgccttcaaacagtattttatctcccttattttatggattaggatctgaaacccaaagaagttaaatagattgaccagcaatacaccagcagttctggagaaggagaacccagggatcttgcttcttagtgcaaagactattccttacacccttagaatcctttaaaatagtgtttaccctagaaattaaaaactctgaagtataggaggttgtacaattctcttttcgttttctctctcctccccctattccttattccttttattttaaaacattctaggacttgatatgatacatctctagttttctcatattaagtaaagtctttaatatgtagatcacctcaggcttttattttcacgctagaaatctagttatagttatctacttgatataaaaaattaaaggcaagtaactctcatggaggccttcttttctttgttaatttttatatctctattaccttactgcagtcaagatgctacctatatcttacacgaatcaagaggaagtgatttaatggaatagaggacctgtcatctcacctgcctctcccgctttttctacttctaattaacctacttcaaaaggtctaaattattccttcaaatatttaactacatttattatgtattcagagaaagtataagccagtcagaccattagaaagggcagttctgctttagagtgactgcattctgaaaggtgatgctggaatttcctgtataaaggtggtgagcaggaagg

SEQ ID NO: 52131 - DNA, 1325 bp, Homo sapiens
agaatgttcagtgactacttattaaatgtatagaagataacatagctaaggaagaaaactaccatttttggcagggagaagtggaatttaatagaaatcattgattttcatgttaatagtatatacttatgaattataccaagaattgacctatttagagatacttggttgaaatactcaggatttaatgtgtagataagttctttataatgtgagttatttttagtcttggtggttttgttttgttttcagtttttatttattttgatttgggaatgggagctggggacatcaaagccatatagtttagaaaatttcacattactgaaataaactgtatccacaatagtaagcatttcttcttttcttgctgtaatttcatgctccacctacaatatggcttttactatttttttattttttattttttttacccaaggaataaattatcctgacagtctttaattttgggtatggattagttaaatgtaaggattgttgatttgatttagtaatgtgagacacaatgtttatgtcctcattatctacagtagatggatagttttttctcctggtctctaagaatagtatttcttaatgtgtggcccatgattggcattaggcgtttttgcttgaccacttgttaaacatgatttttttctaggtagtgtttgccatttgaatgtctttgtggaaacagactccttaatagcttagctataattttctaagttaacatctttacctgccttgtttttttaattctcctaatcttactaataccttagcattagttttgcttccattatcagtgcttccaacttcttgttttatgtgctttaaaatgattatatatgggctgagcatggtggctcactcctgtaatcccagcactttgggaggctgaggtgggtggatcacttgaggccaggagttccagactagtctagccaacatggggaaaccctgtctctacaaagaatacaaaaaacattagccaggcatggtggtgcatgcctgtagtcccagctacttgggaggctgaggcaggagaatcgcctgaacccagaaggcagaggttgcagtgagccgagatcgcgctactgcacttccagcctgggcgacagagtgagactccctctcaaaaaaaaaaaaaaaaaaaaaaaattatatatggatatctggcgcctattttgttacttatatgtaattacttaaatggtatggaattttgaaactctttaaattgaatcttgatagtttttataagctggtggataagtacatctataaggtgattttagaaatacatttgcatttattgt

SEQ ID NO: 52132 - DNA, 1055 bp, Homo sapiens
caggtggatcacctgaggtcaggagttcgagacaagcctggccaacatggtgaagccccgtctctactaaaaatacaaaaaattagccaggcatgggagcgggtgcctgtaatcccagctactcgagaggctgaggcaggagaatcgcttgaacccaggaggcagaggttgtagtgagccaagatcgcaccactacactccagcctgggcaataagagtgaaacttcgtctcaaaaaaaaaaaaaagagaagaacgtattttacttgcagtgtatagtgtatgtatacactatatgtatatgtgttatagattatacatagtaatattagtagtatatagtaaagcatttctaatgtttctgccagcaaatgtaaattccttgcattcttctgtcttattgttgtctgcttaatttctctcactgcttgccagcgttgaattatgattactaatggatgatactgttgatgggattgtgattttctgctgttgattattaaagtcatctttctgtttcatgctgtaatcctaaaagaaggcatgtgattgtgtttttcgctccacagcttcttttgctttcctgttagtgcattttcctttattctggttctttagttttaaattttattgtacacctgtcagtagtgctaattttaattagatcatctaatatgataaagttattttatggacaaagaaactattttaaatgctttgtcttataaggtagttgtttcactcagtaaagtataaactttggaatgttaagctcaaataagtggctaatatctaaggaagtttcagcttttgagacaattgaaaattttttaaaaaggtcagtctgtgagtgaggcaaaggaatttaagcgtcatcactacccgttttgtattcacttgcacttttcctagatgtcctttgctttcttcgttaggtgtggagggcgcagctttccagagccgacttcctcatgaccggatgacttctcaagaagcagcctgttttccagatattatcagtggaccacaacagacccagaaggtttttcttttcatt

SEQ ID NO: 52133 - DNA, 1843 bp, Homo sapiens
ttaaatgttttggacatattgccagattgcttcccagaaaggctgaaccagtcaacccctcccctccgcattgccctgcccatttttattaaaacagtgataatctatgctcctataattggccaaaaccatctcagttctttttcatttcttggattactgactgcttttcacattagtcatttgtatttcttctgtaaatttttctttcatatcttttattcatcaggaattcttatttagccagagagtaaatggatgagggaaaggtgctattcagaacatgctcatgttactctagggtggtacaacgcagaagaaattaaccttgtgattcagctaacttgaatatgaatatagctcagagatgtcattgatatgtctgctttttagccaccaccagcttctttgttttggctattagattgcaaaaccactgcttaatttcgattgttaaagcaattgataggttatcctgggtttttgtaaaacagaaaagaacagtgaagaaaagatggtgagttttttaaaaagtgaacagaaaattcttagtgtgtagtcgctgatttgtcttataattgaatcagtttctgtgtatagcatatcaacatttgctctaagtggatttttttttagacaaaattgtcatttttttgtttgtttgttttatctgaagagagttttcactttttacttagatttgagcgatggatttacagggatctctgtcttttctgattcaccaaaaatccagatttggggaagggtttcccgatgttagatttgtggtctctggctgtgaaacagaatgtaaatcaacctctactgcaagaattttatcagttctctagtcttaaactataatactttaaaactgcaactttaggattattgaactagactgtgacctaagtgttattttgtaggaggaggaggaggaagacttgtgttgggagtgaggaacttgggcccagtgtgtacttgaggaaatccatttaccttacagtggccacagagtagagtatctgtgtggatttggtcataatcccttagtaatttggtttatttacatatagccaaattaatttcttcttggttgaaagttgtcttatagagcagtctttattaatttttagctaagacttaaatatagtagtgtttagtttgtcatgcattttgcaagtatatactcactttgaagagaattcattttagagcccattgattgtaccatatgtttttttatgtctcatctgttttttcagcagtatttgaaataattgactgctcctttcttctgaaacacagtacttccttggatttgataactcagtatctggtttttctcctgcctctctgggtgtcttctctgattgctttgtaagatgatccttaacaattggccattatgtggactatttggagttccttctcctcttgccctattttttcctctaggaacccttctcaatgcatttgacttcagttattacccataagcagatgactccagaccttctctctcttctgagctccagaccctatatccatctattttatatttcttcttgttatcttggagctaaactcattatcttatttcttctttcagtgattccattcagtgtctggcgtaccaactcgcttagttgtaccaaaatggagatgttgtccttgacacctttctccccaacctcgacatatctagttgatcattagatttttgtggattttatccacttagtatctctggagtcatataacccaggtttgaatgctagttgctcccttctagctctatggatttggcaagttactaggtggttttctcttttaggctaaa

SEQ ID NO: 52134 - DNA, 2101 bp, Homo sapiens
aaaagacaggaaaggtaattattataggctctggggtctcaggcttggcagcagctcgacagttacaaagttttggaatggatgtcacacttttggaagccagggtaagaatttcattttgagtttagaggcttgacctattggaaatatggtaagcaaattatctgttgcaaattaaagaattatacaacttgaactaagctaaattgatttgtataatactcagagtattttggatagtgttatttatatttttaaaaagcttttttttttaatgaatgctttgaaaagtactctgtgaagagggttttagagtatttcttttcctgactgatattttcagatcattatttcttgtagttagctctcaaatttggggccttcatggacatatcctttgttaggaggcagttatttttgatggtggaacagagtgaattccctgtttttgataaagaaaaaaagctgcttctcaggcaggaaccatcttttagaagccaagatactggtttttttcctgttagtcctagagagagaaatggaaacaggaggagcaataagggataatggcacacagtaggaaaaagagcatcatattaggatgctactattcaagctattttcatgaataatttttgaaatctaatgatcttctaatggctttgaactgctaattttttaaaagagtatggggaaattgaaattaaatattttcctgatatactattattaaaaattttatatatttagaaaacatctttgtgcactttgtacattttgtattaaaaaatacaataaggaataataggaccattttgattcctacccatgaggagtttgtaatctagtatgtaggtttttgttttgtttgcatttttgtttgtttgtttggagttccagagtactcttacattatttataatcattaaattatcgctacaactcagccatacttgaaaatccctcgtcagcagtgataaacctgggcctatttagggataaaaggtattgtgaacaggctatgttcagtatggactctctgcccctgggcatgggggtgcactggagaaccatttgtcagaaaaattatccatcagatttttccccgctaactttggggatcagggtgtaagagtcagattacagtggtagaaagttggtgtttaaatagtgttgggatttgtgaacaaatattttctatatgggtggccctgtacattaaaaggtattatagacaactggatagagtggtacctgtgactaaatttatcttccagctgtcaagactgttttatatcacatcatttaattctgtgtcgtttagttatatgacatttaattatatgtcatttgttgcctgcttctccttcaaatagtcttcaagttaaacttcatttgttctttgtgcccatagtactgttgattgcattccatgtaaactctacatctttatttttaaattatagaagacagagccgtggtatggtactatgccaggtttgtggttaaaacagaattgatgattttggctacttaatttctgaaacaggatcgtgtgggtggacgagttgccacatttcgcaaaggaaactatgtagctgatcttggagccatggtggtaacaggtcttggtaagtagctattggtttgtgctatatagtacatggtctaagactcataaaagaaatttaaagccagagatgctattttaaaatgtattggtttagaatagtcatcttccgtttagtgagaggtatagcagtatgtggaaaatgtaaattgtacatatcttttgacctagagtacctttttctagttctaggaaattatcatatgaagataagtagataatgttgtgtttgaagctttttttttttttttttttgtgagacagagtctcgctctgtcacccaggctggagtgcagtggcgtgacctccactcactgcagtctcctccctcagcctcccgagtagctaagactacaggcacacaccaccatacccagctaattttttgtattttagtagaggcgaggtttcactatgttggccaggatggtctcgatctcctgatctcatgattaacgtggcattgttttt

SEQ ID NO: 52135 - DNA, 1620 bp, Homo sapiens
tgtaagcttttgagctttttatattttgagtaaaaatattttttactttaaggtttttgttctctcttcataggtctattgaatttaattgcttgagtttttttctaggagggaatcctatggctgtggtcagcaaacaagtaaatatggaactggccaagatcaagcaaaaatgcccactttatgaagccaacggacaagctgtaagtcgaggacaaacagaactttcaacatttctttggttcacttgaaaacaattttaggagaatggtatggatgagcatatacatatatacacatatagaggtgtatatatatataaactgagggtagagatgatgtgatgttattctggttgtttcttaactcttgagctatgtaggaaaggattattgtatatatacacatttacctgtctgtttaacatttatctttagatatttaatgaaggctagctagacagttaatctttttatttggctgtggccacttactccaagggacttatggaattgaaacctgattcttcggttttttttgtattgtgccttccatcacgtgctttagctccatgtgttctttatgacttcagttctgtgttcataggctaacatttttgatgggctaatagccaaatggtggtacttactcacatgcttagataggctaaagtatttattgaccagaggcataggagcttcctatacttagtatgacaatagcatgaaagtgatgaatggtatggggaattgcacagtttaatgactgtaagataagcttagattacataagtcagtcctaattttttacaagtgagtgaaattcaaaagtttgtatttagcaaaattttactgactgcctttatcaaaatgagagcccacacttctcaggatataagtacatattgtctttatatttgggggaaatggtgatttcctatgtatacggtgggtttagctattcttactaaaagtagtaggatcccaactcgtgaattttgtgtgatatgtctcaaggaacatcctcacttactcctatctaccttaaggctttatggggttcatatcagagaaggacagactctcagggaatgctttggtttccatccccaccatcatggtccaaatttcccaccagggcttgggtggggtggataacaggaggcttcttgcagaataaactgagcagaatgagagagaaaggatgaaatagagatgaactcaacaattgagtaaacttctcttactctaccaagatctgtaaaggatatagagatgaataaggtagtccctgctatagtggtgcttgtagagaaataattcttttttcccaactttttattatggaaatttaaaaacacggactgaagtagaaagagtactatagtgaacctctgttttcccaatcttgttttatctgtcccattcctgcacttttgagtccaggggaagtctggagtattttaaagcagatcacaaacatatcatccataaatatattaataccagtaacataaagtgaaagccaaggattagatagaagaacaaattgctatggaagaaccaaggtggcaagagggtgtatgaaggtgtaagggaaaggacactaagagatctggag

SEQ ID NO: 52136 - DNA, 1862 bp, Homo sapiens
ccacattctgcatgggcgagacacacaggcttcccttcccctggacacatttagagacagtccatataatctacaggaccaagacaatcaggattgaacctatttggaatagtgagactcttcaaatcctgttagtcttgaaggaactatttacctggagcctttcatagagaaataaatggcttcaaaaagtcaatcaaaatctgtttaaagtgatgtccattttgtttgcttcttagaacgctcttaacattattggtcctttccccaaaaatgtttcttagtttgctgttacaagttctcactgtgttgcagggtagaaatccacctgccttctaatgtggtacttaaaacccattgtaatcattcgttgagtttctttctcaggatacaagttaaggatctagattagaatagtcaggtaagatttaaattattgtgacctatgtttagcgattgccaatatttcaattccattttgttgttattgttccataataatttgtagaactaatagaatccaaggattctcatcaaggggaaataaatgacttaaagtatgggtagtttggggttgttgggatagtcatttgttagttttattgtctggatatgtcaaatagaatatttctaactagcttgtttttagaaatgatcctgttttaaaggtattaaaaagcacattttggttttctcccagtcagtattgatttcctaagggacaagtattttatgtattattttccaaatattcctttaatttcaaagtgaaatcttaatgttagtggggaaaaaaagccaggtttcaaagctatccctggctgcacttgcaacattcctgtaattgcttaactaggtggaaatggatggggcctggtggctgacaatctcacataatctcatacaactgagcctcgggttagaatggtgtaccggagatgcagtcctgtcatctggtgtcagtcaaatgtggcagcaatcttttggtttggtttttgtttgtttgattttgttgttgttgttgttgttgttgttactgttctgtgtttttcctttcctcttttgagttttgctttattcctcactgctttctgacacttccccctcactcccctgtcttttgttaactgcctttcttttggccatttctgtgccttgactttcccatttggtctctgtacaatctgttccttatttctctggtggttgcagcttctgagctaacagaatgcttctgtcatgctatgtgtttaaagccttgattttattgctgtcatacaaaactaaacttgatgtggctgttgggctgttatttacagtttatttctctctctgctgcactggttaaaaggacactgtcaaggtatttttttcataatttttcaaatcattttcctcactgtttacaataacccattaaaagcttgaaacctaaatcttttcctttcaaagatcctctccatcatacattcacactggtttgttgttgtagagttgcgcctatatgttgggctggtgccatttgagtttttgtcattgaaagcacgtgtaaaacattaggttttttgtgggtggtgtgggtggactaagggggaaagtgtaatgaatccagtgggctgctcagcaaacagagggaagaaacaggtcaaatttggtccctctaaccttgacagtgtccctttaaatatttctctaccacacaccctggaccccagttactgagcctgagtgctgtgtactttttcagtatgaacttccctttgtgattgtcatcctagttgcaaagattaaagcttgtctgaagcaagccatccagttgacactggaagagctttaatctgtaccatttgcacacttgtgtt

SEQ ID NO: 52137 - DNA, 2154 bp, Homo sapiens
gtttcaaatgagaggtagaatcttactgggatggtcttgtcaacagtcagttacctctgattgtaaaaggtcgctcctcctgagtcttagtgtttactagaatttgcttcaatgttttatttttgtgttaccagttttaggttgactgtataatgaaattctgtattttgaatcacatttccctgctgatatcagcccagcttataacaagtaatgcttgccttaaacatattttttctttctctcacttctgccatcaattcaacaataggattgcagatacagtttactttggggctgaattaagcagtagcagaggggtgtttgtaaactaactgatgttatcaataggcagggacacagcatggcttaggatcatggtcttccagcttgatgacctgctttgcaatctgtttgcttcatccacatcaatgaggagccagaccttctggtccttcatttactcatagactctcttaagagctttgtacattcaattctgaacttattggtgccataaaatattattactgtgcaaaagaataaaagtgctagtgtgttcttattagtagccatgaatttcatttctcttttccctcttcccacctgagattcatctttgaggggaagccagataccttgggcttcttattttcccatcctgcccttattcttggaaggtcctcaggtttgttgacatggtttttgttctctgggacttttctagtgtgttgtttgcatgtcagccagctcaacttaatgcatgtcagctcagtgccacttgtgctccatgtgacttcagttagcaccagtgtaaatcttgtggctgttaatagaggtggagtcccagctctgacggcagtagtgggagaagaagaggaaattgtcagggcccaaacatttcatatctcatttaaatggatctgaccacttcatagaaaagaaaatttgaatcattgtgctcaaaggtttcccctttgagatacatattttgacctttataaactatagagcatttgtgttttcatggatggttatgtttagttttataaggaccaactctgctatacttcggattttcaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagtaagtactttgatactgcttattgtatagtgagttccatgtgtaaagatttgctatttatgttttaagtttttctgcaagtcttgtttgaggtagtttttacttaattttgtatgaaaccattgaatccaaagttaaaaattatttaaaataattatatgatcccttaaggcccctttcacttctaaaattcagtgcttttatggtattatactatatttaacatagcctaggaaataatttccaactagccaactttcttgttcctaagtatcagaagtttcagtgggccttgatgcccttaaatgtttttgatgggcacctgtcttattctgcaaagttggctttgagagcagattatacatattgtctctcttaggttacaagagaagcatgtcaaagatgagcagattgaacattggaagaagatagtgaaaactcaggaagaattgaaagaacttcttaataaggtgaaattctgtattttcttcatagctgaagaagctttaataggagaaaaagtctttagaaattttaaaagcatttccgagattttttcctccatggaagagaaagtctgcacagctgggactcattcttaagaaaataatgactaacgaaagagactgttttatctgtcagtctttcagtgtggcattattgataaatggttgccagaggaaatagatctttcctctttgtctggttccctttggctcaggggtgtccagtcttttggcctccctcagtcacattggaagaagaagaattgtcttgggcaacacataaaatacactaacactaatgatagctaatgagcttaaaaaaaatggaaaagaaaattcagtgttttgagaaaatttatgaatttgtgttgggccgcattcaaaactgtcctgggccacgagttggacaagcgtggtttagc

SEQ ID NO: 52138 - DNA, 1090 bp, Homo sapiens
acagaacaagactgtgtctcttagaaaaaaaaaaaaaattctttgaccttttacatatttaaaaaacacattataggaccaggcatggtggctcacgcctgtaatcccagcactttgggaggccgaggagggcagatcacgaggtcaagagatcgagaccattctggctaacatggtgaaaccccatctctactaaaaatacaaaaaattagttgggcatggtggcgggtgcctgtagtcccagctactcaggaagctgaggcaggagaatggcgtgaacccaggaggcagagcttgcagtgagccgagatggtgccactgcactccagcctgggcgacagagtgagactctgtctcaaaaaaaaaaaacaaacacacacattatgacaatttgtttccgaaaataagtttaagttacattagcaacagtttcctttttgtggagattaaatttatttcaatactgggttttttctttgtttgtttaaattaatgggacactcctcatccttctcattcgttttagaaggcagcactgatcttacttatcagatagagttgtggtacctttatgtcaagccctataagatttctttcctatttcccaaatggaatgatgtaggttagaacaagtacttaagaattctcaggaccttgcattgtagccctgttttgttgggatagcagttttgaggagccaaaaaagggtacatgtgatgtagacataaactacattgctatctggaatggtaaatttgtatttttccttcttagatggtaaatttgaaagagaaaattaaagaactccatcagcaatacaaagaagcatctgaagtaaagccacccagagatattactgccgagttcttagtgaaaagcaaacacagggatctgaccgccctatgcaaggtgtggtatacatacatgcctaactggttttacttggaatcctaagaaatagcacagatctggggaattttggaaaagagagccactagccaatcacaagtgccttcagtgcaatgaagacgatttggtacataaggagccatggggatttaatgggttagttcggtttaagacctgcttg

SEQ ID NO: 52139 - DNA, 1163 bp, Homo sapiens
cgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgcctttgagagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactgatttgcgttatcactgtaattttgtttattctacagtttcatataaagtgaatcatacagtacatagctttttgtgtgtgatatatttcacttagtatagtttttgagatgtgcatgaagtttttgagattcatcttttttgcctgtatcagtagtttgttccttttaattatttaatagaattccattgtgtggatataccactggtgccttaatgggcatttgggttgtttcccttttttgactgctaatgaacgaagctgcttaagaatgttcatgtctttctcttgagtaaatatttatgaatggaattgctgggtactatggaaagtggatttttaactttataaatcaacttccaaact

SEQ ID NO: 52140 - DNA, 1029 bp, Homo sapiens
tcatttgatgtttcaatatgtgtctatttgtaatagtattaaattttaaatgagtgatttcagctgaagtagagtgttgctgccagcccagtattttgatctaatttccccaagaatttcatgaaattagaaatccttaccagcttacaaaaaaaatgttacatagaaaaattttcagtaaattcaaagaagtaagatcattttggggatctttaaattcctggtcaattcctgactttttttttactgtatggactgtcttgggccactctttatggtcctagattaccttcatctagtttgactgacttagttttggaaatcttcctcaacttcaaacctgtaaatttaaagaataaaaactgattttgctctcaggtaaaagaaaatgtaatcaggactgtgaccctgatatccttcaagtctgtaatgtattcaaaagccagataaataaacttgaatgatgtttaatcatctgaatttcctgaatcatcattccccctaccacctccctaccctaaccaccatagaagatccggacttagtggtattggactggaatgataaaaactatccagggaaggccgagcgtggtggctcatgcctgtaataccagcactttaggaggctgaggtgggtgggtcaggagtttgagaccagcctagccaacgtggtgaaaccccgtctctactaaaaatacaaaaactagcggggtgtggtggtacatgcctgtaatcccagcagttacttgggaggctgaggcaagagaatcacttgaacccaggagtccgaggttgcaatgagccgagagcacgccactgcactccagcctggatgacaaagcaagactctgtatcaaaaaaaaaaaaaaatccagggacaaaagaaacttccctaatctcactacccgaagatttagggacattttttggtgttttctctttttccttcagtttcctttggtaactgtagctaaatactgagtgatttgttctttagtttgccttaaaatattgactgtttccacaa

SEQ ID NO: 52141 - DNA, 1171 bp, Homo sapiens
aaaataagcccagcaatccttattatttaggatgacatttacgatcccctttttataggcctgagtttgtgaaatgaccccataagactaagtccatatgaacagacacttgatgatagacttaggcactgaagagaatcaactgacacgcctcagccctgatgtcacaattgggagcatagccaaatgcccaaaaatgcaaggccacctcctcaccaagtaaacaacgaagactgctatttgtacatcagatctgtagacaggagtgtctagggcaagctaccttgttaaggttgccaaatcccatcctttggactgcagatgttttccactcagggagaggtggcacaaactgaacggctggtggctgctgcttcagcacacccaggggaagggtacagagaactgcgtcgcatttataaataaaggtttgactcgtggagcgggtattcacagctatcacttcacatcctgcagaggttgggtgggaaaagactagtggtgatgaatatggcactgataaggacactgaacatttagtgtacaacagatggacatccatttctcaattctcatttttctattttcattaccttcatgtttcacataagaaaactgaggtagaggtgaaataactcatctaaggctacacacgtaataagtgccaggattcaaacccttgtagtcaacttcagaatcctcaactgtcatccccacactaccctcctgatacactggtgatctagactaatgaaaggaccttataccacttactcaagttaagtacatttagaccaaaaataaagaataaagtgctcatcccaatagaaccaatgtcttctgactgtggttagctgctcactatcgaccaacagaagaatgctacaagaaggctgtgatgcagatctgggggatgcagcctaaaactgtggagcgtgctatgcttgagaatgcacagtgattctcagcttgtcagagtatgaatgagttcaaagctgacctcagagagggtactgaaattatgttaacatcgttttcctcgtttgttttttaatgaatgtctgtttatatactatatatattttgaaattatatatctcaaaataaatatgaaagctcagtacatgctcattttctatggctgcagaactcgagaaaatggcacaacatc

SEQ ID NO: 52142 - DNA, 1048 bp, Homo sapiens
tttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcagattagaagagactttaaggaagtctgttgaagccagtattatctggcccctgtcactggctcatgtgcttctttcttatggtaggtggtgttgtgttttgatcgggtgttctgggatccaagtgtcaatttgttcgggcatgttggcagtacgactgccagcaggggtgagctcttcctcttctggaacctctataaaggtaaatgccttctaattttaatcttttccatatccttacaggaatatagaatttgaaatattttgggttttctcaatatatatgccttaatttctctctttattaactcaacaaacaattcctgaaataccttctaggtactggggtataaaaatacctgccttcaaggagctcccaacttagtggggatacagtaagcggggaagcaggcttagaacagggcagtaggtggcctgatgggctgaacgcccaggttactggaggtccactcagcctggagggataggcccagggaggcttcctaccaggggaagcttgcgttctcattctcagactgacttgcccctgattctttgattacttctcttactatgtgtttatgaaattcctacctcctgttcagttattttcttttgta

SEQ ID NO: 52143 - DNA, 1101 bp, Homo sapiens
gaagtaagattctcaggcacctcactgcttctaacctggcaaaatacagcagttctgaagatataatttcagatcttgctaataaaagggaattattaagcatcgctttactttggcacagaattcttaaccttgactaccttggatagctccatgacaatgactacatcccttttagccatcccaggcccctccaagcccaggactgtcttcagtcacccatccggtgagtaattatgcaacagacttaggtggtaggcacagtactagaaaagggggataaaaaatatgatataaactattactccaatagagcaacagatgcaaaattacacagacaattattaacttaaaagctatgaagaaaaacgtaggctacacggaaaagaatatggggtatttaatttacatttggggcagtggagatgtgtcctggaagtcgtctttgaaatactttgaaatttatgtcaagacctgaatgctgagtaagacaggttgggaaggaagggggtcgagggggtgggagaagcagcacccccaggcctagaccacagtacacgcagaggctctgaggcagaaagcagcatggtgccttccaggatgtgagaacagccgaatgtgcctggaatctggggatggacaaggaagtagagatgagctagataatgaagaaccttagcatgggccaagataaggagtttgaacattttctttcagcagtagaaagtcactaaaagaagcaggaatagcagtagtagctattggtaaccgtccaggcaacaggtaagaatggcttggactgggaggtaggcaatagaaaaaagtaaataggtttgcaagagattgtaaggctagcactgacaggacttgacagcctggatggggaagggaaaagacacgctgctgctctcagaaagcaatgtgctcagggagccaagttccccctctgtgaagttagaggctctggggtgtgaaagaccattcaccactgggcagtgaggagtaatggaaagaactggggatggggagcaagccaacggttagctgatgtgtctgcactgacaaggccaatgtcttatttttacagccttttcttggaat

SEQ ID NO: 52144 - DNA, 2648 bp, Homo sapiens
gtcagtgcagacacatcagctaaccgttggcttgctccccatccccagttctttccattactcctcactgcccagtggtgaatggtctttcacaccccagagcctctaacttcacagagggggaacttggctccctgagcacattgctttctgagagcagcagcgtgtcttttcccttccccatccaggctgtcaagtcctgtcagtgctagccttacaatctcttgcaaacctatttacttttttctattgcctacctcccagtccaagccattcttacctgttgcctggacggttaccaatagctactactgctattcctgcttcttttagtgactttctactgctgaaagaaaatgttcaaactccttatcttggcccatgctaaggttcttcattatctagctcatctctacttccttgtccatccccagattccaggcacattcggctgttctcacatcctggaaggcaccatgctgctttctgcctcagagcctctgcgtgtactgtggtctaggcctgggggtgctgcttctcccaccccctcgacccccttccttcccaacctgtcttactcagcattcaggtcttgacataaatttcaaagtatttcaaagacgacttccaggacacatctccactgccccaaatgtaaattaaataccccatattcttttccgtgtagcctacgtttttcttcatagcttttaagttaataattgtctgtgtaattttgcatctgttgctctattggagtaatagtttatatcatattttttatcccccttttctagtactgtgcctaccacctaagtctgttgcataattactcaccggatgggtgactgaagacagtcctgggcttggaggggcctgggatggctaaaagggatgtagtcattgtcatggagctatccaaggtagtcaaggttaagaattctgtgccaaagtaaagcgatgcttaataattcccttttattagcaagatctgaaattatatcttcagaactgctgtattttgccaggttagaagcagtgaggtgcctgagaatcttacttcactctagtctgccagctcctactggctggtgtctggcgacaaagagttctgtatgctgtttcagaaacataatctgtctcttcgcatttgaatggtactgcgtgtgtcttgtcatcagatttcagagcaccaggaataaggtggggcctgataaggaagtttttgaggaaagtctgtaggaaaaccctagaattatcctttctgtttccccagctccaatactgttggcactagtggcaggagaagctgctggtatcatggaaaacataagtgacgatgtgattgttggccgatgcctggccattctcaaagggatttttggtagcagtgcagtacctcaggtaagtaggtaggtggggcaaggagggatctagggttcagactcaaccagggtttaatgtatttgcagcatgttcttggtcaggacagtttaagctagaattgaggtctgtgcttttacatgaataattaatgtttggagttcatggcctaagcgtggggttcagaaaaccccccaggacaagagctggggagtctgaaggctgctagctgcatttctcctccggctttagagtcacaccagatccctgacattttagacaaaatggccaaactccagtgagtatctccgggaagttttcagagaacctcttggtactttttcgtgttctttgaaatactttaaccctttaggattcctttgaagggaaggatattgtgaatttataaaagagaataaaggccaagccctgtgtagatctctggattcatagacaggaaggcaacatggaggggcatccttcctgtctgaagtccttttgtccatgtgtgttttaaagcaggcattcatcacttgatcactggctctcacatgttgcccctctttctcttcacttgcatctccacccaccactgcttttccacctttcaaggattgatttgtgcttggtgtctcgtaatgacttttgctcctggtttttcttttagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacaggtgagaagctggcaaactatctgggcttatttgggaagaggccaggatctcatgatgtccctgattttttttttttttttcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagc

SEQ ID NO: 52145 - DNA, 1026 bp, Homo sapiens
ccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggaagcttaaagtctaaaatgggtacac

SEQ ID NO: 52146 - DNA, 1019 bp, Homo sapiens
cttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctg

SEQ ID NO: 52147 - DNA, 1037 bp, Homo sapiens
ctttgcagttaacttatggcctgtctgggctatatctgcctctgctgggttggaaaggacccactatggtagcaggtgagggtgtctcggtcctcactttactgacctccacagctcacttttgttatttattggcacaggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatg

SEQ ID NO: 52148 - DNA, 1053 bp, Homo sapiens
tgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggtgagttccagcctctctcccctctctcttttctccctcccttttccttctttgccttttcctttttcccctctgctctggcctgtgtgacccaggatcttgagaactgagtagaactgggttccttagagaactgttgaaaaatcaggggggtttgacctttctcctaaagaaggtttttggcagcatcactttccaaaatcccttttccaatttgttgtcttcattttgctctcgtatatgaaggtgacata

SEQ ID NO: 52149 - DNA, 1231 bp, Homo sapiens
atccaggcaccaggaacagataggagcacttttctataactgggagctaacgtgcaggttttacatttgctgactgacatgctttctactttccttttgtagattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagc

SEQ ID NO: 52150 - DNA, 1008 bp, Homo sapiens
gtctgttcactcttgccatctgttttctcctttgtaatccatgattaggtcatggacattcttattattttctgttaatggtcattgccaaagggccgacaagctatttgataattaggaggctcactcatcagtcaaattcatcgaattttcagcattccctgtgtgctaggctccctgctgggtactgagaatatagtggtgacacaagttggagagaagaattgagtaaataaagctgcaatagagtgtgataggttctgtgatgggaaatatgtagcagactgtgaaagcaaaaaagagaggcccagatctggcctggggtttgaagaaggcactccagaattttccagaaggatgtattgtctaaagtgggatctgaagaaatgagaaggaatcaaactagtgagggaccagagggaagagggagggcgaggatgtagatgaagaggctggcggggccacatcatgaagggctttgggtgccatcatggggaatttggactttatcctaatagtagccaggacctttagagagttttaagcagtggtgtgtaatacctgctttctctgtatgtttccagtaagtatttgctacatatttactgggtttagctttttcattgcctgtactagttgattcatatcatccagagtcttgataaaacatataaaattggcactaaaagccaaataaataaaacggtggtataattcccagactctctgaattcagaattatgataatttatagatggggctatactaaggtttaacgtttccttcttttgaaaaagagattgtgaaaactatagtataagctagtacaaataagatgtgctgagagaatgctacagtttgaggataagctgggttttctttaacagctttattgagatatgctttatttatcatgaagtttatctctttaaaatacacaatttaatggtttaagcatatttatgaggatatgctgttttaaagcactttatagatgaatcatatatc

SEQ ID NO: 52151 - DNA, 1075 bp, Homo sapiens
tggctcactgcagccttgacttcctgggctcaggtgatcctcccacctcagcctccctagtaactgggactacaggtgtgcaccaccatgcccagctaatttttttgtagagactgggtctctgtattgtccaggctggtctcaaactgctgggctaaagcagtcctcctgccttagtctcccaaagtgctgggattacaggcatgagccaccaccctagtgggttattttcattacactataatgtttcccttttaagaaagttactttttggttgaggctgtgactgatttaaccttggaaaagcaaagcaaaatacaaaaccttttgatcaacaattaggttcttttcctagccatttatggattttatgtgccaatattttattggttggtgttggctaaggcagaggagagcactaatgaaatagaagagatagaagtgagaacttgaacggtcagtggccaagagacctggtggtcttggttgctcctgatagctggatgatagttagagaaagcttccctaggaaagtagagcaatagggtagctcagaatgagtgggaaatgggttctcgtcatagcagtgactgggcataggaaaggaatcttaacaaagcctcttgctctcatgtcaacccctctgaggaaataggtgtagttagggataatacagaactcttctcgaaggagtggaaaaattcaaggcaaactcttgccctgtatttttttattttttgcaaggcgtagtcttgctctgttgccgaggctggagtgcactggtgcgatcttggctcactgcctctgcaaacctcctcctcctgggctcaagcgattctcctgtctcagcctcccgagtagctgggattacaggtgtgtgccaccacgcctgggctaatttttgtattttttgtagagacagggtttcaccatgttggccaggctggtcttgaactcctgacctcaggtgatttgcccaccttggcctcccagagtgctgggattataagtgtgagccactgcacccagcctacacatacctattacacataaaatattttgctatatactgggg

SEQ ID NO: 52152 - DNA, 1045 bp, Homo sapiens
cctgtattttgactgcgacctatcagatgagatcaggtatggaattttccacttgtggagtcatgtgggcactcaaaacatttcagattttggagcattttgaatttgggattttcagatcagggatgctcaacctgtagctgatttctgagatgcttcctagctgtaagatgtcatgtacatttttagactgttgaggaatgttcgggtgttttaatttaagcaaagacagtgggttctaccctaggaccatatcatcttataggaaaggggaagtctcctacagccaaattctttcttgactttcctgagagagacatagccagcttagccaggttcctttagtgtcaggatctagatgcagatcttaccttggccccttgctgacagtgaattgtatgtgaaagtctttgggacagccctctgggtcacctcagtcttggtatgattcatgcattacctatctcttccattctgtttatattctatccaggtcaagagacaactgcctttgaaagagagtgagtgactgtttccaaaacagcaagcatagggagagccgccggaagtattgacggaaagcttgaattacctacatggtaagtatgttgtacagtgaaacctgggtgtaccaatagaattgggtggtttctgaagccactataattttgccactactggaagtggggaggaaagtcagtatttgtgatggcctattatgaaccaaatactatgctgagtacttaaccaaccaacctgatgagggtgaaaaatccttgcatgaagttagcaaccgtaagaattaggccacccttaagaagtagctaccatttattgaatatttactctatgtcgggcgcagtcctgttggacatgttatcgccctaccaaccctgtgaggtaagtactgttgtcatcaccacaaggaaacaagcttaaagaggttaaataactcttccaagttcacacaagtagtagaactaggtttcaaacctgcattattttctttcctttttttctgagactgggtttcgctcccattgcc

SEQ ID NO: 52153 - DNA, 1124 bp, Homo sapiens
ggattataggcacatgtcaccatgcccagctaatttttgtatttttagtagagatggggtttcaccatattggccagggttgtcttgaactcctgacctcaggtgatctgcccgccttggccgcccaaagtgctgggattacaggcgtgagtcaccgtgcctggccgatactatcagtaactcttctctttgggaggccaaggtgtgaagattgcttgaggtcacgagtttcagaccagcctgggtgacatagtgtgaccccatcactacaaaaaaaaattcttttcaaattttattctcttgaggcttgagttactactgttcccctcatcttttaagctgtttttaaaaaactctcattatttgtccattgtaattctagccgccttgctctctgggaagatagaggcagggatgggtgtgtgtgtgtgtgtgtgtgtgtgtgtgtatgtgtgcgcgttcatgcatgcgcgcaggtgcaggtatgtgtgcatgtgtgcatgttttggtggaggtgtggaagttggattaaagggaccaatagtcttggaaggcagtcacaaggtggcttgcagggatgtgtaagggaggcagttgtgatgaaagaagggaggatagtttgtaagatcatgtacaaaagctttaggtttaccactagcttagaagctacctttccattttcctcaagagtaagataacacaagaagtttgacccagatcttccatctgtagtagctcttctctaattttaggggtaagattcaatgggatggtaggcttttcaactctcctgtagaagcctgcttgtttcaaaactggagggtaagtttgcagaaagaaaagctctatttttagttttaattgatattgggtggttcagggctcttttgaggaccgagtctagagggcaacaaaatgagagccagcatggtgaagggactttcaaagtcagacagacttgagtttaaactctgtcatttaataacaagctgtaagaccttggacaagtcacttcttgaaacttaaattctttatctgtaaagtagaggtaacattatcttcttattgtcttatataaaacataaagcatagtgctcagggttggtaaatactccgcagatgtt

SEQ ID NO: 52154 - DNA, 1005 bp, Homo sapiens
taaattagctgtatataactacctacctaagtgccaaggggctgtttggtcagtagggtttacagctccccattggagcaggttttccccttatttttttagctttgtttataaagatataagccagcagcttataaatgtggttgtttgtaatcttggggatttttctccctgggctggtcttattttttgcttaagacataataaaatactctgggtaactgatttttatggagacgagaaaaacttaagaggtagtcagctcagtaaagcaatagcagatagtggtctgatccacctcgtttgtagaggccaggggagtggagatggtggtgttcttgtttctgcctcttttgggcactgaagcaagagaggctaaatatgaaagccctcctttagttgatatcagcttgccttaggttagcaaagtatttaaaatatgagcctcaatttcttcaacatataaaatgaatttgataatatccttatggggtcattattaaggattgagagtatggatgtgaaagtgctttgaactatgaaataatgtataagcattaggtattattgtcaggcgtagtggctcatgcctgtaatcctagcactttgggaggtcgagagaagaggatcgtttgaggccaggagttcaagaccagcctgggcaacatagcaagaccctgtctctacaaaaaaataaaaataaaaaaaattagctgggcattttggtgcacagatacttgggaggctgaggtgggagggtctcttgagcccaggagcttaaggctgcattaagccatgattgcaccattgcactcctgcctgggtgacagagagacctgtctccatatatatatgtttatttatttattaggaggtatattatttagagcgtaggaggcatgcacttctgaggcccttgtcaggatatcttctagggatcctgaatttcagatgattctgggcattcaataattggacttcctaggctggtgccgtgtctcatgt

SEQ ID NO: 52155 - DNA, 1017 bp, Homo sapiens
tgtgttcatagcattaggatgaagagttgggaagatgggggaggtgtggagacttggatccaataagactaagaaggatttgaggaaatggaactttgggttgctggcagggcagaaatacttgaagaacactcccgttttaataagttatttttagtttgcagaaaaagagtagtttcttcagtgtcctggaatcttgtagttgtgtttgtaacctaaactaatcggcttagcctgtgccagaaaagtgtcaggtggcatgctcatttccttctaacttttagtactgcctggcttaactgctgtagttctgtgactaggcttcagggcgttggtaatggggactaactgggggaaggggcaagctgctgctggttgcatgctgctggtctgagcagagagaaccctcgtgctaagtcactgccctaatgcattcactctggctgtacatataatgtggtgcttgaatccagagtgttcacttgtggtaccctaagtatgactttgagtggaactaccttagaatcttatttttccaattaacttgacagtctctagtcatttcttttggctcttgtcctggatattttattctgccttaagtggtttttaatggattttaagctctcagttatcattcattcagcacaactttattgagtgcccactcaaatgtatgcctggcaccattgtaggtgttaagtgtcttttggtgtttctttattagaaactgttgattttataaatgttactcagttgaagaatgtcaattacttaaagtctttttaaaattaattaattaattaattaatttatttatttttaagacagactcttgctctgtcacccaggctggagtgcagtggtatgatctcagctcactgcaacctttgcctcctgggttcaagcaattctcctgcctcagcctcctgagtaactgagattacaggcgtgcgccaccacacccagttaatttttgtatttttagtagagggggggtttcaccatgttggccag

SEQ ID NO: 52156 - DNA, 1052 bp, Homo sapiens
taggatctaaaataggagccaacatagtgtgttttagtcactatttagaagggccctttatatgagttgagagagcactgacttcagaagttgctttaggaggtagaagggaggggagtgggtctggtacagttaaaaattggcctgcatgccatccttggaacacatattttactgtgggttataccattccagaagacgtatatttatgtgtccaggagacctaatgatcgccctcccatacacacttcacagtattttaaaaagtatagtctgtggactatctgtatcagaatgcacagtctgtgggctctgtaacagatccacttaatcagaagatttgaaaatggtaccgaggaatctgtaattttaacaagtacccaggtaattgtatatccatatgaagtgttgaaaattactgtttgtaaccttgtcgatagaaataatcttcaacccagtcttagtaggcaggcaggcaggcaggcaggcaagtacttgcttatttaagattcgttacttttcataattgacattggagcttgcatttccttttgcattgatttaacttctggctttaatctctgatatactgtgtcctccatgttaagatgtgtcgatgagacagcagaaaatgaaacctttgtcctctttccttacattattttgtgttttcactattagccacatccctgggaagaggcagcctctgaatggagaatgctgaattggctgtatagactgatgtgctttagtaaaaagcttgctcacactcaacacttttttccgtgtttattgaaaattctagttatttacctgttactaagagtttatttttcatagatctttaaatgtctaacatgcacttaaaatgaaagagaaaaacaaagagaataggatattgagaaagtatatgatttacttcatagtaagacactaaatacttgatatcaaggtaggggatagaaaaaaaatcagcaatggcaaatttaaaccatctgcagatggtccagctagatccttacaggggtcgcagccatcattttagtgggcat

SEQ ID NO: 52157 - DNA, 1060 bp, Homo sapiens
ggaggcgggcgcttgtagtcccagctacttgggaggctgaggcaggagaatggcgtgaacccgggagtcggagcttgcagtgaactgagattgtgccactgcactccagcctgggccacagagcgagactccgtctcaaaacaaaacaaaacaaaacaaaaaacaaaactaaaattggagctgaagaatttgatcctagacagatccttgagtttgaattaaattatcctttttaactctcatggattcagtaaatatcaaatgttttctgtgtgccaggcttagtgcagagggtggaaggtggtgggagaagccttaagaattaaactaatacagtgaaaaaaaccaagaatttaaagtcaggtagacctgaattcaaatcccagccctgctaattagttattagttgcaaattgctaagtgccttggagcttcaattttgtaatctctaaaatgagaataataactcttatagaattattttgaggaatagggtgatgtatataaagcacttagtaatgtgtgctttataagacattactgcccatagaccaatgaatagacaaaaatgtatggtgagagttactgagtcttgacaggaagcgtttggctgacctaatgcagaatagagcgaagtgattttgactgccaatatacagtgtgctgcttttgttgaaacttgtagctctcacactggtatttgccaacattacatttgacttctcacatagtaaaagacaactcattcctgtggagtttaaggcatgtggaaacatctatctgtaggctagacatttaaacttctgttgtagttcagttgcgggagaaattgcacattaccatagagtagtgaaagtcaggtagcagagagcctctctgggctggtacctatattcactttcctgaattctgtaaacatcaaaagcaagaatggccatccaggatgaaaggtacagctgacagtatggtcaataaactgaacagggtgtaagactaagaacttattttgttttctaaaatggtgccttcttcgtatttaaacttctgtggagcatctgtc

SEQ ID NO: 52158 - DNA, 1840 bp, Homo sapiens
tttgtgtaaactagggaaaggaactctgtttttctgggcctcagtttactcatcttaaaaatgaggttggccagctgcagtggctcacgccggtaatcccccagcactttgggaggctgaggcgggtggatcatctgaggtcaggagttcgagaccagcctgaccaataacgatgaaaccctgtctctactaaaaatacaaaaattagccaggcgtggtggcatgcacgtgtaatcccacctactcaggaggctgagacaggagaaacacttgaactcaggaggcggaggttgcagtgagctgagattgcgccattgcactccagcctgggcaacaagagtaagactccgtctcaaaaaaaaaaaaaaaaaagagattaatagtatctgcctcatagggttgttgtgagataatacgttagttcacgcaaagggctttaaatgacacaaaacaaacacaataaatattacctattattattgtgttatgcttttaagtttttcaagtactttaacatttccttcaaatagcgttcctatgagagaggtagggtctagagtctgttatagtaagtcttgttttacaaagaaatccatgaagaaacttatttaagcacaccagaacaaaattaaaagaaataggctgggcatagtggctcacctgtaagcccagcactttgggaggctgaggcaggaggatcccttgagcccagaaatttgagaccagcctgggcaacatggtgaaaccctgtctttacaaacacacaaaatacaaaaaattagctgggcgtggtgacatgtgcctgtggtcgcagttacttgggaggctgaggtgggaagatcacttgagtctgggaggttgaggctgcagtgagctgtgatcatgccaccactgcattgcagcctgggcaacagagcaagacagagcaaagaaaaaacaaccaaaaaatccccccaaaacccccaccaaaatgaaaagaaatacaatttaaaacattccttaaccccaacctgaaagagaaaaataaaaaggcttgggatgtgttctaatagttacctctcttatataagcaggactaacctgtggtatttggaatgagagaagagatcattgctggctactcctttcttcttttggttttttattctcttcctgctgttagatgggaggtggggagcatgttactgcatatttcttatgtcctagtctagcctagccatctgggaagctgagaaaccatatttgaaggatatcacatctgccaggaactgggaagacagcttacctttttatgtgaaaaaaggtaaaatgagaggagacctgagctaccagtatgatctgttggtgttatgtgagttgtttcaccaatttaactcttaaatggatttaatagaatcccactcttttgttgtgtgtcagtttcttgcagtcgtttagagacatttttggaatctaagtatttctagggcttttttcccttcttacagccttatgccacttgatatctctcagctgtcagcacctgattttgctgcagtatgtactgcaagatctctgcattgctgtaaccagatcttggtcagatgtactctttccatctcttcgatgaaaagatatagcattggagactcttccatatcctttggaaaaacctgaaaagaagagtctttgagaagtcaccttgtgttggggcttctcttggctagcatttctctggctgtagccttcccttatatttaatacgtaaaagcactgtcttcagcaaatgtgtattgtacctgtccttgcaagaggctactaccatattagttactggaaatgcagagagtataacaatcaa

SEQ ID NO: 52159 - DNA, 1104 bp, Homo sapiens
acaacaaatcgttattaaaaacaaatgtccaattcgaaaaacaaacacaaacaaactgttgacacagttcagcaacttgctagtcttggcaaatgaaattaaaggatatttcaggtccagcttctgggaaagtgggttttggagatgattccacttgaaaattagggctagttagtgctgaagacttgttgtctgtggtatccagcagttttttgatatgtttgtcttcattcccctcatcctctgcagccataaagttctttagattactcttcttcatcttcactgttggtaaaaagttatctcaaagttccgtctgccttattgcctcagtattttaaaagctcagtcccattcttttctacctcattcttgatgtccctttactacctgtttctgctgggtctggtagaacctgtgcacaaatgtgagcaaagtcctaagttcttaattttttttcttccaatatttcttccatctcctaacccataagtgaaaacacggctttttctgtaatgaatgctattatttctgttttcattggttgaatactctgcaactccttggacgaggggagcaatcattgtagttctagtcattcactgtccctctagaccattgttttgccatttttgcacagcttctgatttttcaaaaagtccttaccatctgttctctccccatttttattgctttttgtcttttgtcccattgctttatttgcttttgtctgatgacttccaggatccacatggatcagttttcttcttcattgcattctctagtatccagtacctcactctcatcagttatctttctctcttccatcttcaccttcgctattgagtctttcttttcagactacaaatacagaggtcttgtctatcctaaaacaaataaaaattttctgccttttcagctttttgaattattgccatctttttcttcttttacttctaaacttttttttttttttttttttttttgagacggagtctggctccgtcaccaggctggagtgcagtggcgcaatcttggctcactgcaacctccgcttcccgggttcaagcaattctcctgcctcagcctcccgagtagctggga

SEQ ID NO: 52160 - DNA, 1164 bp, Homo sapiens
tagtagagtcgaggtctcactatgtcactcaggctggtctcgaactcccaaagtgccatgactggctgcgactctgtcttaaaaacaaaacaaaacaaaacaaaacaaaaacaggtaagagaaagggcatcatctcagattaaaggggtttttcatgttgaataatttagccttatgaaaaatttactattcttgggtgaaaataccattgactaaaatgactgccctaggaggtctgttgttatgctaatagtgtatgttgaaatgacaggttacagtttactgggattagtttaggctgaagtggtctgtgagggcttcatgcaggcagttagactagagtttttcagtggtggatggatagaggttgaagaggcagaaaggaaagagaaggttttgtttttcttttactttttaaatttttttcttttgtatttgagaaagttaaggatgagggaatggttttctaggcaagagcaaatcaagggcaaagatagagattagacgtattattgatgggaactgggaatacttgtctggtctagtaatagagtttagattatggactaggaaggagataagatagtgaagtaatgctcattgagattatgaacagtcttaacagtcatactgaggaatttggacctgatcttgctaacatttgggaatcattgaaggtttacaagttgagcagtgacttgatgaacttggaattatgacattaatcaagaagtgttgtatagattatctgaaaggaagccagttaaggaatttttttaaagaaataaaattatgctgcaggcatgaatttagcaagtggaatgggaagaaaaaggaatatattggagagattttggagaaggaagagatgggacttaataacgtagagaaagaagaaaagaaagtgaagatagctcttaagcttatgaaactggtagaattggccgggaacggtggcccacacttgtaatcctagcactttgggaggtcgaggctggtggatcacctgaggctaggagttcgagaccagcctggccaacgtggcaaaaccctgtctctactaaaaatacaaaaagtagccgggcatggtggtgggcgcctgtaatcccagctactcggtaggctgaagcaggagaatcgcttgaacccagggggcagaggttg

SEQ ID NO: 52161 - DNA, 2265 bp, Homo sapiens
ggcctcccaaagtgctgggattacaggtgtgagccaccgctcccagtcagcatccctgttttatagatgagcaagccaaaggtcagaaagtaaagtggctgtcccaagttcacacacacaactagtaagaagtggcactggaattcatacccaggtctgtttctcaggtctgtggttgtctctctactttgcccactgccttgggaatcatgagacctagttttttggcctttgactcagccactgggtgactgtgggccctagaataagtcatttaagtctattctccaatagtattgccttttctttcagcagtgttgtaaatatgcacttgaagtgtgctgtttttcttttctttttttttttttttttggtaaaaagacaaacatataaggctgtagtagtgtagtagtggtatgtactatatgcctctaggtgcttacttatttcttatgatgaaagcatttctgttaaaatggggagtacctaagtgatcatatatttcatttatgtaatggaagttgatggatagctaatggcccttccagtgtaaagcggccatcattaaggtaacattatcagaaacagaatcatttttcatgtaatacagcttttagggacagtgtcaacttatgagtaaagcatgctgttacaggtaggacccggatagtccaggctgaaagatgtggtataaactttgatgcatataatagatgcatagcaaatatttgatgagtgaatgaatgaatgtaatgaatgtattccctttttttttggagtgcagtgctgtgatgatgtctcactgcatcctctactgcctgggctcaagtgattttcccacgtcagccttctgagaagctgggaccacaggtgtgtgccaccatgcctggctaacttttttttttatttatagagatgaggtttccctgtgtttcccaggctggtctcctggaactcctgggttcaggggatcctcccatgtcagcctcccaaagtgttgagattacaggcatgagccatcatgccctgcccggaatgcattctttaaaaaaaaaaaaaaagctttattgaggtataatttacatacaataaaattcaccaattttaagtgtacagtttgacaaattttgacacatgtatacagttgtataattaccaccactgtgtttatttttttaaactgtgtgttatcttttaggaattgggtagcagatttatccctgggaatgttatgaggtttctatgctcagattcaatactgtgagatcagaatgaatattagagtgttaatgtgccaacttgggaggaaataggaaaaccttcggtatttaatggtgaggtaaataggaagaataaggagagacatttattggattaggggaaagataaataaattcaggaggaagtagattttagttacttttaagacagaggatacattttggggaaaaagttaccaaaagatttaaggagttgaactttttattttttttcttttgaaatggtagctcctgaaatataaaacttaacatctttggctgtgcttaagaagcgcttaacaaattatggttgttcaaataatacttaagggtggggatggtgtaaagtggttgaaggccttgcccttccacctatgacagaatatccttagtgttgatctctaacttgttttaagtaatattccacaaagggaagaatacattaggtagcaattgtggcttgcggggaagattgtttcttccttttcataatttctcaagtcactgaacttctcccagtatgctttagctcaagtctctgtctcttagaaaatgcctggaacctgtgctagtgagcttctagaagaagccccatttctaccttctctttattttttgattttatctttattcattctgtttctgtatggtgactgtgttttttttttttgagacggtgtctcactgtgtcacccaggctgaagtgcagtggtgtgatcttggctcactgcaagctccgcctcccgggttcacgccattctgcctcagcctcccgagtagctgggactacaggcacccgccaccatgcccggctaattttttgtatttttagtagagatggcatttcaccgcgttagccaggatggtctcgatctcctgacctcgtgatccgcccgcttcggcctcccaaagtgctgggattagaggcgtgagccaccgcgcccagccggtgactattttataagcccttctctcacccatggatttgtctgagaatggaaacttt

SEQ ID NO: 52162 - DNA, 3345 bp, Homo sapiens
tggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgagtgagttttttttgtcttatttcccattagattctctaccttctttgttcactttacgtatgttattgccactcccttcaaaactggtggtttaattaaagtgacagcatcttctatatacccagtactgttgaggattaaaaaatacatgtgtgccggatgtggtggcacacacctataatcctagcactttgggaggcctcaggcaggaggattgcttgagctaaggagttcgagaccagcctggtcaacgtggcaaaaccccatctctactaaaaagacagaaagttaactgggcctgatgttgtgcacctctcaccccagctacttgggaggctgagaggtgggagggtcacttgatcctgggaggtcaacgctgcagtgagctgagaacaagccactgcactccagcctgggcgacaaagcgagaccctgtctcaatagaaaaaagaaaaagtgccaaggctttgctcctagttcggtgcaggttccaaccagtactaaaactttgcaaattttt

SEQ ID NO: 52163 - DNA, 1054 bp, Homo sapiens
ttcttgggagattattctgtacttcagttaggaatcctttaagtctgtaaacttcagtttcagcctaggtttttaagtagattaagcaaagttaatacttttcttttcttttcttttctttttgagacagagtctccctgtgtcgcccaggctggagtgcagtggcgcgatcttggctcagtgcaagctccgcctcccgggttcacgccattctcctgcctcagcctcccgagtagctgggactacaggcgcccgccaccacacctggctaattttgtttttgtatttttagtagagacagggtttcactgtgttagccaggatggtcttgatctcctgacctcgtgatctgcctgcctcagcctcccaaagtgctgggattacaggcgtgagccgccacacccagccattaatacgttttaaaaggccactatttttatcagctaaatcacttttgaaaattttgtgtgttatgtgttatactcaaaatattatcaaaacattctgttttcatttgaacctattgattagaatggtgcttatttatttggctgttgttcaagtacctgaattggcttggtcagaaggacttgggtgttctagctagctgtcgtataactaaatatttttggttaagtggtacatgtttagcattggcttgtcattttgaaatttttccatgcttcctgttaagaaatagaaccttaccaaattagtcatatttaaatataatctgtatagagttggtatggaaaacgatttgatctaaatacaaccaacaataaatatttttattgaaacttccttttaattgatgagtagtaatatggatgtcttcattagttgtaatgtcatttctattttactttcctaaatgtgaaagaaaagatgaaagaccatttcttggacatatcaaatgatttttaaggaatttctggtgattatttaaattttctagttaagctgtctaggtcagaattcatcattcaaaaatgctgctcaaacttgaagtgggtaggaatttctggggattttgattaagatgcagattctg

SEQ ID NO: 52164 - DNA, 1595 bp, Homo sapiens
atttagtactagatactgtacctgttctaaggaaggtagtgaaggagtaggatagtaaaaatgaaaaggctgaactccccagagatttattaaattgccaggaagcttgactgaggttagaactagatctacaggtggcagataggaatattggctgtggcataacaggctgccaatagcgtttttgtgaggaaattgtggcattttggaaatgatcctagagaatctacagaggtgggcaaacgtaaacacttgtacagtgctttcagtaggctttttattgccccagtgcccttgtgccctcgatgtgacatgccacaagtgaaggagaagtggtgaggggattatttgaggaaagctttgttggacagtttggatgcatcatcgggagatactgccaatttacaggaagtactgtataaagagttctctctttgtgtcttaattttataagatttcctcttctcttgcaggtagccctaatacagtggtttttcttatgacttatttttcttgagggtgtacttcgtttctcaccagtcaaaaacatagaagttctgcaactcagaatggaaattcacttgaagtaatgtgtgattcctctgtaatcagtgccattaatagcaaaaaatatttaaaaggaagatgattgggacctaatagtctataaacaaattgagtaagaaagcattaagaaggactagtaatgtattctgccttgtttctttcaaatgaagactgttaaactgagttacggggaagaaaaagtgaataccctattgtttcaaggtaataaagagtaaacagtatacttccttttggttagtgttttccagaatttactgttcttgttgtgttatgttctttttgttccaagatcaaaagatcactcactgaaacaggaaggaatgttctaacagcagaaatatctaaacttgggcatctttagatgtttgcagaatgggaggtggaatgaaaggtggggcagctcactgatttgcgatgtatttcttccaaaaataaagggttgcttaagctttagctgtaccaaaagccccgaatttatttagtttagttttagaaataacaagattttgttaggtattttcctgtggagtatattatattcacctagggagatatcttctgtctatagctatgaaaagaaattaaatttctatttccttgtaattgaaagttgtgaccaaaatcaagaccatgtgtagacatttcctctagctcataagcaagagtagtgttttattcagctgtttacttaaaattccaaatggtgacttttaggcctagatgtctatttgttaagaggcaggaggggctctgtgtggtggtggttcttgctggtaatcctagcactttgggaggcccaggtgggaggattgcttgagccccggagttcaagatcagcctgggcaacatagggagaccccatctctacaaaaaatcagaaacttagctgagcatggtggcacacacctgtagtcccagccaccgtggaggctgaggtgggagtattgtttgggcctgggaggtagatgctgtagtgagctgtgatcctgccactgcactctagcctg

SEQ ID NO: 52165 - DNA, 2747 bp, Homo sapiens
ccaaacattctttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaatttggtttcctgctctcctgtctttccatcttttttgttccccaagctaattgatttggctttatttatgagcctgttacagtaaagtgtgtgttgggaaatatattgaggtatagagctattctttgtaggtaccctggtgagaccgatacaaatatgcccctccccataatggaatactaatttttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaacgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttttatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctcttggagagacaataaatttgctttaactgtcatttcagtctagtattatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtg

SEQ ID NO: 52166 - DNA, 1054 bp, Homo sapiens
gggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaatttattttgacccacattctttataagggataatttgtgactgaagaccttatttgctggataagtgaatgtacatacagggaaaattgttagtactgtggcgtcaattgcactgcggactttagttttagtgaaaatgatcgtgactaccatttcagttactggtttaggaatataatttcctattactatgtaaatttgctttgagaaacattcatgccttgtaagagaggctt

SEQ ID NO: 52167 - DNA, 2152 bp, Homo sapiens
ctcgactggtttcaaataactggttgtcctgattgaaaatatttataggatggtttgccaaagaagcctatgaaattataaaatatctagtccaggaactgggagtcaccaggatggtcagggcagagggtagatgtttcattttttaatttatgccaggaagcttttgtaaacttgtttagttgctttaactgaagcaacgcaaagctgaggtggtaaaagggaaaattgcagtcttgaggactagtttcgtttttgtctagatacttataaatcactgatagctccaatagaacatttttttatgtgtgcccagagtggggaaaggtatagggaaacaaaaaataaaatatcatgaggaggtgacattttgttactgagtacctgaaccttttgatgtatggcagaggttgttaggtggaacaacgtgaacaaagggctagaacatggaatgtttgattactgctttctacataattgcttgagtcttcattagtccaggccttttctggctctgtacttttaactgttcaagcaaagtacattttgggttaagcattgtgagggaaacctaggcttttttgtgttagtatcttcttgaattttacagataatctcactcagtaacctcatttgtgcttcaaatccttgaaattgtcgtataagaacagtggaagacctgtatgttgtatgctacatgtttattttaaaattctaatcctgagaagttaatctttgtctggctcgtattaatactggcatttttccccggtatggatttgcttctttggtatggcttatcttttaaggagttatttggaattaaggagcagcaataggtggcagcccttttaccttttaaaatataatatcaggtggtcggttttgttctaaatgtaatttatgtataaaaagataaggtcaagggaaacgtattttctttgtgtgtttgtgtttaactttctggctagattcaccttttgccatttaaaataattgtgaagtaaattgttaagtgtattaaattacacaagtataatagcttacatactatataaaacaaaatacagttttatatcgttgtaaaataatttttctaattttttataggctatggatgaaatgaatggcaaagaaatagaaggggaagaaattgaaatagtcttagccaagccaccagacaagaaaaggaaagagcgccaagctgctagacaggcctccagaagcactgcgtgagtctacattttagtagatatatctttggacaaggaataacgtgataatggagatcagattaataaaacaaaatcagagtcttgaagcaaactgatttgttttttcttttctcccttctctactttgctaggtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctc

SEQ ID NO: 52168 - DNA, 1681 bp, Homo sapiens
tcctaccagcaaaatacaagagaattattttcctcattcttgacaaaatagtgtataatcaaacttttgaattttgccagcctgataacaaatgtctcagtgccattaatgattaatgatttgcttctcttactatgaatggtttgaactttaaatatattttaagagccatatgtgtttctgtgtatgaaccatgtattcaggaattttgcctatttttctattcagttgttgagctttttgttattttctggtgctctgatataaaagagagattagctgtttgtgatacatgttgcaaatttttcatccatatttattgtctttgcttatagtatttttttgccatatagaagtcatttatttttagtagttgagtataacattcttatggctcctagattttaagtcataaggtcatccccactccagtgttatataaaggaatcattcttgttctaaaatttcacagtcctccctccacccttttattatttaaattttcaatctatttggagtttatccttgtgtatagtgtaaggcatggaccagcttttctcctttttttctaatttaacactacctgatttaatgatttaagcattatagtttgtttatatttggtagggccagcctctaaatttcactcttttttttcctggttattcttgcttatttattttttcatatgaacttttgaaagttactcagttttagaggaaagaaacagaaaaacttgttttgaaagggactttttgttgattaacttggtaataataattatgtgttggttccttgaaggttctactcagtgttaggtgctttaatgacaacataggagaaggcaggaaccaataatttttgtaaattggtgactgatatcagtgtcattttcctagcaatttctcttactacctgtaacaacacttttagcacttaatgttttagaggagaaaagctatgctatgaagacaggaagaaacacttttcaggtaaaattaagtagccaatgacggttttgtttatttgttgcttactaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggtaggaattttgaaattttggttcttgatatttgaattttgtttttgaaacttgccaaacacaaagtaactttaaaaactgaaacaatattggttgtcagcttttgctgaactctttctatttaatctctgtaaagtggtaatagtatgtaacagataagactccatatttcaaagccaggttattactgagtttgtgatcttaggcaagttatttttaatctctgtattgttttgtaagattcgatagcatgatgccttggaagtattacaaggtataaaaattagctgctgtaaacactgaataggtaatgaatgcattataactacttagttgacctcagtttgtgtacctatgaaggaaactgagtggtgtacatgactcatacagtataccatgtttaattgagtagatagattttgagggtatgattagttttacctttatttaatcattttagagttaaaatagcattcactatgttttactga

SEQ ID NO: 52169 - DNA, 1060 bp, Homo sapiens
tgttgaacattttaaacacaatttcagtaagtaattttcacatagtatgttatcgtttcatcatagaaaagtccatgttgaattttttttaaaaagcaactaaaccagtgggagtctgtgtaacatagaggctggaccttagtatgacaaattgagaataataaaggggatggagcgtttgtggaaaatgttagtttttttcctccttaaattagtatcttcttattagatagccctttatctgaagcaacaatttgttcaatatgttagttttttatttggataggtactatgttttcttagttcaaaagttatatagaaaagtatagacaaagaaatttcctttctacccctatccctgtgtctaccaaatcccctttgtctcctataaggcatccagttttaatagttgctggtttccttttagtatttccttcggcaaatatggatatacttccttaattcttagatgagtggtagtaatgttggtagcctaccatatccactgatctaccttttgtttattcaccatcctgtttcatcagctctgaggaaatacatcattactatatgtactactaaatagttaaaaaacactgccaactaaactatggcacagtacttgcttatcacattgactgtaagttgtcctatcctacaactcatagagctcctcttcattttttgggtttttgttttttttttttttttttttttttttgagacggagccttgctctgtcacccaggctggagtgcagtggtgtaatcttggctcactgcagcctctgcctcccgggttcaagtgattctcctgcctcagcttcccgagtagctggggttataggtgcctcctaccacgcccggctaatttttgtatttttagtagagacagggtttcaccatgctggccaggctggtcttgaactcccaacctcaggtgatctgcccacctcggcctcccaaagtgctgggattacaggcgtgagccaccgcgcccagccctcttcttcattttttatgactacatagtagtctattctgtggaggtactatagtgt

SEQ ID NO: 52170 - DNA, 1963 bp, Homo sapiens
aaagtcctgagtaaagagagaagtaatgttttggagattataagttataatcttcattgactatattatgactttattacttggccatgaattatgttttatttagatttatagctaatttttctttttttaagctttttttgtagtttttatttttaaaaatattttatttattattattattttttgagacagagtcttgctgtgttgcccaggctggagtgcagtggtacgatctcggctcactgcaacctccacctcccaggttcaagcgattctccttcctcagcctcccaagtagctgggactacaggcgcctgccaccatgcccggctaaattttgtatttttagtagagacagcatttcaccatattgcaggctggtctcgaactcctaagctcatgatctacccgccttggcctcccaaagtgctgggattaaggcatgagccaccgtgccccgcctcttgtttttaaatgatcagattcccttagtgtattgtccccatgaagaaaggcaaaagattgtcatgtttgctcttatttgttagtggcaaaatatgcatggcaagtcctgtaaagggccctcaattccctcctgattcctgtacttgcgttgccaggatcttaatagtggtgccttgagtactggttcttaagttttcctttgggcgactcctgggacacatcagagttgcatttctttttttttgagatggagtcttgctttgtcccaggctggagtgcagtggcgcgatctccactcacggcaagctctgcctcctgggttcacgccattctcctgcctcagcctcccaagtagctgggactacaggtgcccgccaccacagctggctaattttttgtatttttagtagagacggggtttcaccatgttagccagggtggtgtccatctcctgaccctgtgaaccgcccgcctcggcctcccaaagtgctggggttacaggtgtgagccactgcgcccggcctcagagttgcatttctgctgcttgcaatgagctcttgagcattttagttgtctcttcccttcacagggaggcagcaactctgaatggccatgagttaatggttggattcttcttgataagtcagaagtcaaggtttttattccagaatttgaggaggcaaaccctcgttctaagtagtttggaggagaactctggtttatacttgtataaagtctgggttggcagtgacatctttgggttaatcagataagttctattcagaatgaaccagagaggctctcagaagtgctactcagtatcttttatctcatattccttgagtagatgggtgtctaggaaagggatagagaatttaaatagctctgagtttttattttgattttttactagcttgattttaattcctattgtttcttctcctaatacaactatgactttgggtaaactactgaacatgaatgtcatctattttattgagcctggatcaatctctaagatccaccacaactttgaatctacctgtagtaactaagtatagcctgtattactttttctgtaaaaatattttaaaatagtattatagatgtattataatagaggaataaaatattataaaagaggaataaaatcccatgaaaaccaaaagtatagcttgtaatttgcttaccagccacttctcacataacctttagtaactgctcagatggaagttcatcctaatctttttttagggttagaaaacttcaagatttcattctggtaactcctttttcctagatctaaaacaggtttcagaatgaaaaggaggtctctataaacttaggattaaatattatggagccctttattgtttcttttttttaaaagatggggtctcatgttgcccaggctggagtgcagtagctgcccacatgtgcagtcatagcacactgcagccttgaactcctgggcttaagcgtccctcctgcttca

SEQ ID NO: 52171 - DNA, 1714 bp, Homo sapiens
aagacactgaagcaggaaatacaggatatttagctagagaatagctactatccctgtttccatggttttggaagacttttctgataagatgacatgtcaaccagcacctgaaggatgaagaggttgtagcatacaaagagcaaaaggaagtgcattccaagacagcaacacgtgccaaggttccaaggcaagaaagaagtcagtatattacagtaactgaggaggccagtattattaaaaggtagaattaggagtagagttgtatgaaatgaagtaggcagggcttctgtaggccatgtaaggagttgggtttttattgtatatataatgagaaggtatttaaaggttttaagcaggaaataacacctatttcttgtttatgggatattattcctagcgctctgtggataggggcttggagagaaggggtgtgagtggaagctgataaattagttgaagctgtcatactagtacagatacaggattagactagggtaatagcagtggagatagaaagaagtaaatgagtttggaattggataggagagatgaaggaagaaatcaagaatggctaaccaatttctggcttcagaaccaggtggatggcactgtttattagataggaagtctagggaaggcagattttggccatggtggttcagttttggaaaagttaaatttgcaatgtctaagacatcaaagaggatacatcgggtaagaacgtaggcacatctagagcttagagaagtctggggtaggaaaaaaatctaagtatttataagggtataggtaacatttaaaagtagggctagctgacattatttagaaagaacacatacggagagataagggcaaaggactaagaccagaggaacactaatatttagtgatcacttccattcttggtaaaaatagtaacttttaagttagcttcaaggaagatttttggccatgattagttgtcaaaagttagttctcttgggtttatattactaattttgtttttaagatccttgttagtgctttaataaagtcatgttatatcaaacgctctaaaacattgtagcatgttaaatgtcagaatatagtagatttgttgtatatggctgtaccttcagaacccctaaaattaaaaaggaacatcaaatactgtcccaaaccccatatctaattatgttgatctaattgtctacaaaattagtgactcatgttgaggctgcttcacttatattttgctcatcgtcaagtggatttaggtctgcctaatcgctagatgtgtggtggatgcttttggcttatatatctggctgttggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaatacagttgcttggaatgggcatagggtcatcatttaaattttgtactcagaataaagctcaaatattttgagttttatgataaatagaaattgtagctttagacttcaactgtttggcaaggagcggctttaacactaaagttaacagcctgtcttggtatccaggaatttccattaacaa

SEQ ID NO: 52172 - DNA, 2978 bp, Homo sapiens
ttacactcttattagtttccatttttcaagagacttgttctttgataaccctaaggtcattataataaaaattaggattagctctgcaagtcaactgtaagtttcagattgtttccattctttcttaaccatcttcttctgcccccatctttaaaaaaaaaaggcagtaggctttatggctctaaaatcaaatgcttatgttggattctaataagggggttttatttcaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactggtatgtgataattatccactgtcttagcaagtcactatttgaggaaataaactttaattcaaaaatgtttgtagttaacattattttgatttcttcagttgttgcttggaatgtttttatactgaccaagttggtatgtgacgtttatttttctctgactataaaagtaaaaaagaactgaaaatacccaaaaagtaatgttttatagaaagtctcccattgatttaagaagttatctattagattgatatcagaagtttcatatgagtatttggcttatgcatttctgtcttttggttttaggcaaaaggatgtcaattcttgatgttaaactttaggattcttaaagtataatgaagactggaatgggctgtggggaacataatagtggatgacagtgacttaggattcaattcagaaaatagttgtgaatctgttttattttggttacagcctactcatacgatttatttcatattttctaagtgtatttttgttcttcctgtatgtttcttggcccttgagtcttctctgtctttaatctttctctcctctcctactatttatagccagtctcatattaatttcctttctctagggcctttaaccacttggtgctcatttcagaccagtagtagtagcaacaaagttctgcaaatcaaatgtatcttcactcctgctgtatttaagacacagctatctcagtatcttaaaataacaatgtaattattttttggcatacccttgcctgacttctgaggacctcactaagtctagttctagcctttgtagaatggtcaacttctttcatcaaggctttggtttcattactggtgtctgaattagttccactcctagcttgacccagattttagtttttattatggattttttcttcaaacttgtttatttaatattaagttttcatttttggcagcatatggatgattttatttttaataatcatatctcttagtaaactaatggttaaataatattaaagtataagaagctaaaattggccaggtgtggtggctcacgcctgtaatcccagcactttgggaggctgaggcaggcagatcacctgaggtcaggagttcaagatcagcctggccaacgtggtgaaaccctgtctttactaaaaatacaaaaattagctgggcgtggtggcgcacgcctgtagtcccagctacttgggaggctgaggcaggagaatcacttcaacccaggaggtggaggttgcagtgagcaaagatcatgctactgccctccagcttggatgacagagcgagactccatcttaagaaaaaaaaaaaagggctacaatttatcaagaaaatccactatagtgatttaaataaaacatttttcaaaattttataaaattttgaaagtattgtgtttggtagacaatttaaaactatatatttagaattctgtgacttctgtagaatttgaaatttttctaatatctttgcattgattaaacatagttgttaccctttacatattgttattttgagtatggcttacctatatgcaattacatttccaaggaccctgaatgatcagtctcaggtatttttttctgaaaaatctgtggaaaaacattttcagatagataaaattaaaatatgaaataagatattttaaacaataaagtgagtcctttttatatggaagagtagtgaaggttaacaaaaccaaactaaaacaagagactgtaacaatgaagtttaaaatatacattcatattatggaaagcatgagggaacttggtgagttgatgaagcagggagcgtttggccttaaattgttgaattttttagattaagatcaattgtcctgagtttggggtggttttggggtctctggttcttttcttattgcagtgtgacagctatgaaattcgccctggtaaacaccttggagtgtgcatttctgtggcaaacaacagactttttgttggatccattccgaagaataagactaaagaaaacattttggaagaattcagtaaagtcacaggtaaaacaaaaatgtatttagaaattacttttgcgaaatatgttgtactacttacaagtgctcaaaaaaactgaggggttgtatgtattaaattaagaattcaggtctgaagtatctaaattgcttcctttctgctttatagtggtttgggtttaagcaagttcccttatatccttcatttcttggaatgtccccttcacttctttgtcttaattgaaccttggcttttgctggagcttttgctctatagccctcaagtgaatgctttttttccccttgacaattagtgtattttaggaccaagaggatgaaagtttttactctctccctgctgccttgtctagatcagattttttttttttttgagacggagtttcgctcttgttgcctaggctggagtgcaatggtacgatctcggctcactgcaacctccgcctccttggttcaagcaattctcctgcctcagcctcccgagtagctgggactagcatgtgccaccacgcctggctaattttgtatttttagtagagacggggtttctct

SEQ ID NO: 52173 - DNA, 1029 bp, Homo sapiens
gtaatatgtaatgaaataattatacaactcaccataatgtagaatcagtgggatccctgagcttgttttcctgcaactagatggtgccatctgggcatactggtagatggtgacagatcttcaagcattagattctcataaggagcatgcaacctagatcccttgtatgcacacttcacaataggattcaccctcctgtgagaacctaatgcggctgctgatctgacaggaggtggagctcacagctcaggcagtaatgccaatgatagggaggatgaggagcggctgtaaatacagatgaagctttgttctcacttgcccgctatttacctcctgctatgcagcccggttcctaacaggccatggaccagtacgggtctgtggcccaggggtgtggggacccctgttttatattacatttatggctctgtttcagtcaaaggtagaagaatggaaggccgaaggcatgcatccctgtgaaatcctagtgttcactgaacttgatgatatctaaagtctcttattgttctgacattgtgtaattttaaaaacctggctgggctctgtggctcacgcctgtaatcccagcactttgggaggctgaggcgggtggatcacgaggtcaggagatcgagaccatcctggctaacaacggtgaggccacctgtctactaaaaatacaaaaaattagccgggtgtggtggcaggcgcctgtagtcccagctacttgggaggctgaggcaggagaatggcgtgaacccgggaggcggagcttgcagtgagccaagatcgcgccactgcactccagcctgagcgacagagcgagactccgtctcaaaaaaaaaaaaccaaaaaaactgaagtgtaaatttctcttttctaggtagattgtgtttctttgtttaccattgtatcttttcttctctaagctctttatatagatgttgcctcaattataacataaattcctgagagcaaggagattatcttcttttctatgattgctcttaatacctaatagaatgtaag

SEQ ID NO: 52174 - DNA, 1634 bp, Homo sapiens
gagagtggaaagaattacttagtaaaatttgttttcagattttcctccacctcttaggtggttagcatcaactgtaaccgtctgtaatttgaaggtttatccttggaaaacgcaatgtattcttatcactctaatataaaccaaaatttgttgtattaatgcataatctgtaatacagtatgtacatcagatttaactttcaagacttatacctttgggggagtgggaaatggatgttaggatttggcgggggaggtttgtggatatggagattgaaattcatgtttttggttgttgacattttatctttattttcatatttgtcctggacctttctatgtagtatttggatagctgcgtatatgcatatagttaaatgaaaatacagtttgttagtgatcatattgaatgtaacaattcttgattaaacgtcagtagagcttagattaccccttttgttgcaataacgttacccctttcaatttaatttttaggattggtagcttatgtcgatcttgatgaaagagcaattgatgctctcagggaatttaatgaagaaggagctctgtctgtactacagcagttcaaggaaagtgacttatcacatgttcaggtaaggtcgttactcagaaatgtctttgaacaattagtaatctgaaattattttactattactttttttcctatggagaagtggtattttttgtttgtgactacctcttcttttaaaaaattagtttaaaggaaaaaaactgcttgtggcagagtttcagaagcccaagtataaagcaaaagttttctcccacccccttgtgcagtaagttattttaaaaacttaaaattaaagccaagttttgatggttgttactataggtttttacatgttactcagctttttaacatttgggggttatttgatcctgttttattatcttggaggaaaatgtaggtgggaggaatagtttccgacatctggcaaagacagtctagatacagtcacatatcaacaagtggaagactgtgttttcccagggtagaaggtaagctccctgaggtctatactgccttactgctgtctgctccaatctctggcacatagtaaccactcggcaaatacttgttgaatgaatcagtaaatcttttgttaaaatcctggttttctgaaatttaaatttaattatgtatctgacccttcagatatttttggtgattctttttattgaattacttgtctgttctagaacaaaagtgcatttttatgtggagttatgaagacctacaggcagagagagaaacaggggagcaaggtgcaagagtccacaaagggacctgatgaagcgaagatcaaggtaaaacttgacttgggtagttgtaatgaaattgcatttaatgatgaggtcaaatgcctctttccatgtttcctagaaagtttcactttttttttttttgagacggagtcttgctctgtcgcccaggctggagtagcggcgcagtcttggatcactgcaagctccacctcccaagttcatgccattctcctgcctcagcctcccaagtagctgggattacagccatgcaccaccacacccagctaattatttgtatttttaggaaagatagggtttcactgtgtt

SEQ ID NO: 52175 - DNA, 2978 bp, Homo sapiens
tcttaatatgaagaatttgcacagagaggttcagaaaaagtcagggaggagttagtgctgacatcccgaatctcccagcagcccttttaaatctttaaatgtctcctttttttttgcaaaaatgtttagatcaaatgactccagtcacgttagtatatttgctgcatccagaaatatggtttggctgtgtggcattgtgttgaatgccacatttgaatgagtttcaaatggtctcatatgacataaaaagtcttttcaaaatgagcattttgtatttggcttgaagagagagggctttccttgatccgaaggttttattttctggaatctaattattttacggtttttttgttaaaatttacaaactttttttgaaaattttaaccaatttcagtatcaacttgtagagcctttgcaatgaaatggtaggcataaatatttctgtcttgtacttaatacacaacttgtctttttgctttacacatacttaaaaaccccaccttaacagatgttcattgaacttttctgttaaaaatttgcctcttttctgtgactgatagtattcctaggtacaatgctgtaagggtcttgtgatactgagaacttttgagttctgatgatcttaaggtagtatgtggggatgggggagcatgggaaaacagaaccttatgttcgcaaggagattttgtgttttaggatgcatctttatagaaataggtcgtgttaatcagtaaacgtattcatctcacacaatacagtttcttgatcaaaagtgtgacatttcgaatgtttccgtttttgctagttcatcagaatttgaagcttgtcttgagaaacatccacccagaatttaaccacagtctgcgtctattaagggctatcgagtcttaatagtgttttgtaattgtgaggagtcatgtttatctcattttcagagtaatcctttgcattttcttcttcttcctactctctattacctccttcccctcttggtcttcctccctctttcgttaacttcaactaagtatcagtggactttgaaatgaaaagaagttgttttaagccagaaaactgcacctggtgcatttgcacaatgttcgataagctgtcgggaagtgtggttatcttatgtgtcttagtactttgtaggagacttgtattttctttatagatgactaggtatcttgagtttcatcaagaaaagtaggctttttcttgagatccacctttatgtcttttatttagtatgtgttgcaatgtcttgttctgctgcctattatcttcatcacattgtaatttcaccacagacaaatgcactttaattccctgtcttttgaggcagtacacagactggccttgtatggtttattgtttactctctctcttcagggagtcagtccatttcagcattacctacaggctgaatgtacaaaattatttttgataggttaatctgagaaatctggctgaagtttagcctaattaggtaacggtttttgaaatatttggaagaagttgtccattcttcagtatgtttttacatctttattttactgatatgaaaatttcaacatgtactctttttttttaagaagcaacctaaactatagctcacttagtattttatttggactgaaaacaattgtttcgcttttaaacttggtcattttttcttttaaatctgtgggaatagcgaattaatcttagaacaaaaattaatgtcaagttggtttttttttgttttcgttttgtattgttaggtggagaaaacccaaaccaccagcatgttgaactagagaaaacagggcacttatttcacaccgatactgtatttgaagcagagccaggaaaatttgaaagtccttaaatcttgattaagtggtctgtgggtgttcattctgtttttaaaacaaaactttttaaaactgtgtaagacccgagagctgaggggctttttagtaaaggattttgtagtgattttgatcttttcaccaggacagaacagctgcttttgttaatcagcaattctaccttcagtaaattaaagcctttatcttacccggtgtacatgaagttccttaaagatctaatgcttccatgtacattttctatggttttacaggattattattgccaatttaggtcagatacatcacaggaggaataaattattattttgatagaggttattagcagcatgtatacaaattagtttagataaatcatgcattgtcctacaaactagttatttctggcttaatgtaatatagctcctgaattttttccagcagcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggtataatatgcatttcttgtttctgactggttatgaaagtgagggcaaaccactttgaattttatagttttttaaggttaaataatacttattgtttctgatctgtagagctgaatgtttgttactttcccttcattgaaggcatattgggtttgactttgatactcttatttcattattttgaagccttcttagtgttgaatatgcagtcttagttgtttcagaacagcacatcgatttgtcttagatttaccacccataaaaatgtatgtttctgcataccaaattttacatttttttcttaatcaaaatcagtcatcattttgcttttgcttttctacttttaccttcttaaagtgattgttaaatcagcttaggtctgattaggtggcataacaagaggatagctgtatcgtctgaaaccataataaatgtcagactccttgagagtttgtggcttgtctagtttctaatagaaatccacatctctccgtaatttggaagtgtttggttgtaacagc

SEQ ID NO: 52176 - DNA, 1050 bp, Homo sapiens
cagctggactcacaacctccaggggcccttccaaactagaagttatccgcatccttgtcatcatcttagcagcccatacatgttgagcatttgatatatcccagacaccacactagtgcatcacgtggcttagctcacagaatccttgtattttataaataaggaaactcaggcgtgtagaggttgtgtgactcacctgaggtcacacaagaggctcagacaaacccagggtcctggtgtccctgacactatagtgcttgctatgatctgatcttaccccagaagctattttctttctctgctacttggctgaccacaaatgcccaagagacatcaccacttggagagtcagaggtcacaaaagaggggcccaactcctgtagaagtccgaggagaggaagaaagggttctggagctctcaggcgtcagggccaggcctgcacccttctgtgcccctccatgaatggctggccggcccttgactgtgtcacatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggtgagagcagggcatctgcatggtgaggcaggaagccaggtccccctagccctgcctagtgcagagggtcagtggctcgtgactcatcagcagtgagccagggagcttttcaaaccagcctcatctcagcctcccccctgggctctggactagcaggatactgaacacagctaataggttctaagtgctgtgctaagtgtgttcagcgaattggccaagtttatgttcacaccaactgagatagaaaggtgtattatccccattctacagatgaggatcctgaggctcagaggagtaaacgaatttgcccatgcacacagctagaaagagtcggagccaggaggcaagctgtctggccccagcgctaggttgtgtggcatgtgtgggggctgtacgtgtggagt

SEQ ID NO: 52177 - DNA, 1066 bp, Homo sapiens
atgatccatgtcaagtgcctaaaatagtacctacctcatgaggttgttatgaggattataggagatcatccatcaagacatctagaatgctgctcaataaatgctttactctcttaatgtcaaatgtctgttacttattgtcatcctcagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacggtgagagagcctgggctagggatgagggagggaaggagtcccttttcccaatctcactgagggcagatgaaattcagtctttctcagcaccccaagggatggtacaggaacactctagtcccaggtacaagcaggcttcactgcctacgttgtgtctggctgatacctgtatttctcgaatctcttttagatgattacaaggactatggagtcaactgtgacaagatggcatcagaaatcgaagatcatatccttgaactgtgccggggctgtgggtgtctgcaccgtctagcagcacccatccaaggtgcaagcgagctgggagagtgaggaaggagaggaagggctccgggaacagcccctgctctgcccctgaaccagagttcttaattctatctaacattcattattattttacacctgccagcaaaacttgaaaatgagcagtacctcattcagtgttgataacaaccccacagtaggttccctgatttatccagtttcatgggtgaagtcactaagactcagagaggtcaaatcatttcccaaagcccatacagctaacagtagtagcagagatgggatctgaatccagaaattgtgaccctggaacctggaggctcagcggctgtgccagctaggctgtgtaatagcgtgcctcagttggccaagtcgttacttccaggaacagactagattgagaggtcagcatttcccatgctcagccttttcccttctcccatcctctgatg

SEQ ID NO: 52178 - DNA, 1048 bp, Homo sapiens
taggcatggtggcacacgcctgtaagtcccagctacccaggaggctgaggcaggagagtcacttgaacccaggaggtggaggtcgcagtgagccgccgagatagcaccactgcactccagcctgggtgacagagtgagactctgtctcaaagaaaaaaagtcaattatgtagtatgctagaaggtgacacgtgctatggaattaaaaggaaggcagggtaagtgagatggggagtggggtttgcaattaacaaacagattgattttttaaaaccagtaaaaggaataactatattatatatcataaaaataatgtagctgaatgcattttggaaaaattgggaaaaaatcacctttaatcccatcaccctagctgtaacagtggttagcatttgagtatattttctttagatctgcttttcctcctatgcattggttttcttgcgtgactttaggcacagtccgcatctaattttgtctcctgcttttttgattgctattttaactcagctcttctatccccaaggcccatgtgtttctcctctcctcctcctaaagtgcctgccggggaggctgaagctgatttctctgtttctctggttccagatgagtacagacaactccaggaatccagtctctgtggactccagttagctaaggcctgcctgacagccaggaggacagggacctgctgagaatagttgtaaataatgagcaacacaacccatgtcacatacatggcatgtgttaggcccttggcagatatcgacttccttcccttgtattggttcacttgatggagggtaggtgaaggtcatgaccagccggcaccgcctggagctccctctcccaagtagctgtggcccgggtgggcttccttagcctcaagccagctggccttttcccaggatgctttctccccaccttcctgtcagtactgatgctagtctacaaagcagtctccttgccaattttcttctttcaggagagactctgtggactccaagtcttctgcctcctcctctccaaaaagaccatcggtggaaagg

SEQ ID NO: 52179 - DNA, 1050 bp, Homo sapiens
gtttctactaaagatacaaaaattagctgggcacgatgatgcacacctataatcccagctactcaggaggctgaggcacgagaatcgcttgaacctgggaggtggaggttgcagtgagctgagattgcaccactgcactccagcctgggcaacatagcgagactccatctcaaaaaaatagacactagagggttgggaatgggaggggtcctgacagtcagccaagtgccacccccaaccctaggttcaggtttcaccaaagctacagatatcctccatgtcaggcttagccctgggccctcggcctcgtgcagagcagggccttagttacagtagtggggttctgacctcagccaggagtcagggctaggactctgggggtccaggttggaaggggaggtggtggtagagctggggcaggatctgccaatgatggcagccattcctgtgtatccattcccagattatgccttaaccctctcactttgcagacaaccaggattggagttgctgttaatggggtccgcaagcactgctcagacaaggaggtggtgtccttggccaaagtccttatcaaaaactggaagcggctgctaggtgagagaggacaaggttgtcttgagccctgtttttctcctagcacttgggacaggactgggcctggctcatagccagcactcagtgtatgtctgttgagtgacttaatcagtgacagatggcctctggatccgggaggtagctagtgggggactgccaatgtttgtgtacacaagtgcaagatttgtagacttgtgagttttgtgtacatgtgccacttacgtgtttgtgctctcatgcatttgtctatatagtacatgtctacatgcacacatttgtcttaatatgtgcagagatgtgtttgccaatgtattaatgtccccatgtgagactgtgtatttgtacacacgttcctgttgtttgtgcatttgtgtgtaaatgtgtttgtgtgtgtgttgggagtgtgtgtgcagctgtcctcgtccctgccctttgctctctccccactaagtc

SEQ ID NO: 52180 - DNA, 1074 bp, Homo sapiens
ttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcaggttggtgagggcccagctgtgcaaccagggcaaatcccctgacttctctgagcatccattgatttccacacctctaaatagtacctgcctaaagactgggtcacacgccatctctgggcccatcacttatgcagaaatgctgaaccctgggaccccttcccccttcacacacttgctcccaaatcctgcatggagagctgaggaggagccagggatcctccctgctgatgttggagtaaagtaggcttagccccctgtgtggcttattctagaggctctcagtggggtcttcactctgtccccacctccaacccaggatccagtcttctcccttccatacaaacccattcagtctggagtttggggagaagtagacctgcagatatccacagagtcttctggaggtcagttccagccttcttgggcctgtgatggacctggcctgggggccttgtggactctacccacccatcctaagcccccagactggctctgttcctgagccctttctccccactctgaggggctctctggacatgagggtcatgttggcctttccctgccttccagctccgagagcactcgctcctatcggcggggggcgcggagccctgaagatggtccctcagccaggcagcctctgcccagaaggaacgtgccggtaggaactctgggaccatggtttgaggggcggtggcagggtgcctgggaggcagagttagtcaagagtaggcgtattggggtgggagacctccccatggttggggtacagatgggcccaggcagccacagtttggacagtccctgtcctggtgcccaggtgggcacggtttggccagtccctgtcctggtgcccaggtggccacggtttggcca

SEQ ID NO: 52181 - DNA, 1050 bp, Homo sapiens
ctgggatggggactgcagcccctcgttcccaggattctgcttcagctcacatcacgtatcttgccctgccctcctcctagtatctgctcaaagccggggagagccagatgaagcaaggtcctgacttccttcagagcctcatcaagttcttccacgcccagcacaagtaggtatcttcccgcgtccctgccactaacccttccagtgtcacagaacaaggcccctctcaaggtgtgatagacctgagagtctctttggaggcctgcatctttttggcagaactttcatagttcctcattgagtgctcaccgggtgtcaggcatgagtactttacaaacatcaattcgctcaattccccaacacttctgggagcaggtactctattatccccattttatagatgagaaaactgaggcttattttccaagattacatagctagtaagtgggatttgaacctagtcaagagagactcttgtctatggagtgtctgttcttgaccgtcagactacaattccctgaggtgccctgtgatccttacggcagcttctcccacacttctggcttcatctctcatttccatctttatctggacccttgtttggcctctgacacctcttagctttttccaagatggctggaaggctgcccagagcctgttccccttcatcgagaagctggcggcctcagtacatgcagtaagttgggtctcacccttgggcacgtgatcaagccccctgtccttccaggaaaatctgtgggtgtggaagagctggcttctgcccacagagtgaggctactgctctgctcttctgggtctgggctctgtgcctgacatatttgttggctggtgatgggatcccatcctctgtcccatagctccatcaggcccaggaggacgagctacagaagctgacccagctccgggactccctccgagggacactgcagcttgagagcagagaggtcagcccctgaactatcccaaaaggaatgccctcccccaaggcccaccgtggagggagggagagaaggaagacccacagggtcc

SEQ ID NO: 52182 - DNA, 1044 bp, Homo sapiens
tgtttagggccagccagggtaggctgcccaaaggactccagtgggctttccaagctcagacgtgtctcttacactaagatgtgtttcagccacctttgcccagtgcctgccaggctcttgcatggatccattgactcttagctttgaatgaaatctaaatagctgtccattctaatccaaaatccagtgtctgaatcactctctagcacctaaagtatttgaatacttcaagtgacagggagctcactgccttcaggggtggcctgttcttccttagaaatgtcccctgtttgagctgaagtctgtttctgcctccctaacttccacctctcagtcctgggaatcctctctgaggccagcctgaacaaatccgttttcttttcagtaggacatcctttacagtgtttgtattcggggcctcaccattgctgtcaaccttgttttccttggacagatctccctctgtgccctgccttctccctttcctaagcctgaggggatggtgagggaatatggtagaggtggtagaattgggatttaggtttggaggcagatccagtcccaagatcaaataagctgtgccccctaactttgtggggcagcttagagatggggaaagaacattggccctggatttggctagtcctggatttaaattgtaactctgggccaggtgcagtggctcatgtctgtaatcccagcactttgggaggccgaggtgggcagatcatctgaggtcgggagttcgagaccagcctggtcaagatggcgaaaccctgtctctactaaaaatacaaaaattagctgggcatggtggcacacgcctgtaaacccagctactcaggaggctgaggcaggaggatcgcttgaacccaggaggcagaggtggcagtgagctgagattgtgtgtctgcactctagcctgggcgagagtgagagtctatcccccccccaaaaaaaaagaaagaaaaaaaagaaaaaaagttacagctctgccactgttcatcactgtgtgacttggacatgttcctcctcctgacagct

SEQ ID NO: 52183 - DNA, 1043 bp, Homo sapiens
caccaccacgcccggataattttttgtatttctagtagagacagggtttcaccgtgttagccaggatggtcttgttctcctgacctcgtgatccacccgcctcgtcctctcaaagtgctggcattacaggcatgagccactgcacctggctggagtttttttttaagatagagtttcactcttgtcacccaggctggagtgcaacggcacgatctgggctcactgcaacctccacttcccaggttcaagcgattctcctgcctcagcctcccgagtagctgggattacaggcgcccgccaccatgcctggctaatttttgtattttcagtagagatggggttttgccatgttggccaggcttgtctcaaactcctgacctcaggtgatccacccacctcggcttcccaaagtgctgggattacaggcgtgagccactgtgcccagcagtttaaaagatttaaaagatgagattagaatgctaagggggtgcagcaagacttggagggttttgaatgccaattgagcattctgactttttgttgggcggtgtggaccagtggacccaatcatgttgctcaaggaatggatggggttggccctgccagcatagtgcctgggggactgctccatgccaggccctgtatgaggcactgggcagatgcatcgctcagttagagatgcagtccctgccctgtggaccttacagtcttctggcaaagcccaacagtaagcaggtaaacaaataagtcacagccgggtgcagtggcttatgcctgaatgccagcactttgggaggccgaggtgagaggatcacttgagcccaggagattgaggctgcagtgaactccgatggtgccactgcatgctagcctaggtgatagagcaagaccctgtctccaaaacaaaacaaaacaaacagaaagaacaaataagtcagaagttgctcattgtactaagtggcacgaagactcatcctcctcgtcaaggccttctttgaggtttgttctgggtcctcatctcttcagggaatcttgtccacacg

SEQ ID NO: 52184 - DNA, 1083 bp, Homo sapiens
gctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtgtgagtgcctgggcggccagtggtaccctccaatgggtacttgtgctgtgggcggagccagaggcaatagccagtgggtgtgagtggcaggggcggggctgagagcaacatccaatgggcacaagggctgaggcggaccaagagcaacatccaataggcttattgctgggggtagagccaatgtatggtgaggaagagcgccgtgtacctgctgaagtaatcggagaacgtgatgcggggcagagtggagaatgacatctgggaggtgtaaaggccaaagggaacctcagattcttcctcttgagtcagagatcccaatatccacttcttctagcttagggcagtcccctgggagctaagtagggggatcccggactccttccagatctgagataggagtactccagcctcctctctccatttctacagggtttaaagagctgacctatagcccttggcataaatcctaagagaaaccaggcaggggagggagtcaggactgaggctactccagttggaggaggctggggcatagggatgaacagagtcgagagcccctcagaaatggggttcaggtcttgacttgttttttctcccaagcccaacccccaaacctctggttccaatccctggtagctccctgagagacaggcatgaccactgatttccacaacccagggaagcaccctcatagactattttttgaatgaccttgttctggagtttcacccacagactgacactggggggctgctctgttcccagaggcaggggaatgtttgaagaccccaccagacctgggaagcagcaacagctggggcaggagctgaaggagctgatgaacacggagcaggccttggaccagctcatccagagctgctctctgagcttcaagcacctgactgagga

SEQ ID NO: 52185 - DNA, 2213 bp, Homo sapiens
caaactccacctcccaggttcaaatgattctcctgtctcagcctcccaagtagctgggattactttttgtatttttagtagagatggggtttcaccatgttggccaggctagcttcgaactcctgacctcaggtgatccacccgccttggcctcccaaagtgctgggattacaagcgtgagccaccacgcccggtcctccttttctttcaatttgtctacattttccagatttcctcttgtgaggcatgaaagaaaataaacattttaacacacaactctacaaggcaggtcaggtgaggaggtgtaggctcagagaggcaagacagtgaatcccaggctgttcagctacgaagtggcagagctgggatctgaaagcaaggttcgaccccttacatttgctcctacccccaccatctgacttagggcttaggagagaccaggctccactctgcgtgaccttgggcaagtcaattcctcttccccaagtcccagtttcctcaccgtggtgcccgtaagggggttgtgcctggtgatctctgaccctctgcacttctgcagctgcctgaggaaggagctgtactcttctccataggggttggcagggtgggcttgcgtcctgaccaggccttgaagatccagccaaaggggctgcctaagagcgtccaggatagggctaagctggcctctggctgtggccatagcctttgctctcctcccctcatcgcagtctcttttcagctcacccttgaactttccccttttcccactggtgctccccatacatcagtgctagcagctccctggtgggggcactccctatgggcaaagcgctttgctgcactatctcactgaatcctcagcataggtggagacaatgatgcccattttataggtgacttgacgtcaactgatttcccagctaagaaggggaaggcctagatgcaaagccaggccagtctgactccaagacctgtgctcagcctcaccttgatgctgatcctcctgggcttgtcctctgccacctgtgttctgcaggttcagcccaagccataggctgactttcctctgggcactgtccaaaggtgtcagggaggtatccttagggggacacttgccgcattgggaccctgggagtgcagaataagggtgaaggagagtgagaaaagagagaaggctgtgtgtgtgtgtgtgtgtgtgtgtgtgtgcaagtacatgcagtgatgggggcaggtgggcgtagcccaggccttggcccaaattctagcaaatcctggggcagcgtgtgtgggatgcagctgaggcagcctggtacatggctttgcagtcagacaggcctgggttcaaaccctggctccggcctttgtgtgaccttgggcatgtgcttactctctgtaagtctccattttttggcttccgagagccagtgccaatactgatgtggtaggactgttacgagcatgtaacaggctcagcatagatattctgttcaaggtcttcctgggattctttctggtttgttctggcgggggagacaggtgtggctggggaggctctgggctgccccacctctgcctcaggtagaactccacctgagcttcccttcctctccctgcccttggtgctcctgctgggggatatatgaagaatactaggatgtgcagccttggtcaggattgatggaggcctcggagctccccaagcctcaattacttcagctgtacaatggggattagtggtatgggaagattcagtgaagtgatgaatgttggggcgtggttcagggcatgtggaaggtctcagccagtgactggccctttctctagtgacagcatggggctaaatctctagaatataggatttcaccagttaggaaggtagaaaaggaatattcaagagactcattcaagaatgagcagtaaagtgtttggatggtttccaggtctcggtagtggtggaaagcaagagtgttatatccaggctcctcaaaccaaggagcagggctcctcacatcagcccaggaagacttcctggagggggcaggagtgggggaaggggaactgacagcaggaagagctgtcaccacctccaacacctgtcagcccagctgtgctcagcagcagttagaagtctcagccctgctgagcatgacctcaccactaaatgttaaaataggcctctctgtccaagccagggtaggggtgtctgggggatc

SEQ ID NO: 52186 - DNA, 1020 bp, Homo sapiens
tgagatccagtttgagtggagcaggtagagttttgggaagagggaagatgagctttcagtttccaggacccagtgcccccaatatctgagtagaagaccccttcattttcagactttggatgaaataatctcatccattctagtggagtggaatgagcactggattgcgagtctggagggagacccaactcactactcccagtgcactgtgtgaccttggggaagtccatgcagccagcgttgccgccattcattcattacttcattgtttggccagaaaccagtactgggtgcctgctattgtccaggcaaagagtatggcctggggacactgtgggactttggtaagacagagggataggtctagtgggtctctcacatccaatctgccatggacagactccaaattgtccagccagctcctgagatagccccaagtatctgccctaggtcctcccccaggcccagtcttccctcccagacagccatgtagcagatacaaatgtgggcagcccccttgggttctgttcagattggctgctctctcctcaagctcccaggctcgttgccagagagggcccaaagtgtagtggcaccaggctgcctgctgacctgggctcagggtgtgttttgtgggagtggaattcctggagcccgtgtgaatcaaaacaactttagggtggggggtggagtgggaaaagcctgggggagtggaggtggtggtggttgaggagcctggtttctggtgtgactctgccactaattctctgtgtgtccttggacaagtcttggacccagtctgggcttcagtgttctctccttcacaatgcgtgtgtgcacagggtggctgtggggctagctcttctcagccacattcagctccaggtcctgggttttggaagcaggctccagggagaggaagggggtgttgtaggtttgcttagttgtgagtttggtgaataagttcgggtacagggataagaccaccccccactgccccagaggcatctggtcagacct

SEQ ID NO: 52187 - DNA, 1057 bp, Homo sapiens
atcgttttaggagcggctccgggcacttgcccggagtgctcagaagcacggtcaggaggctgcagcgggggcagatggggtgaatggagggttctgaggcaggggggtccgggccttttcctggtcccggggacttgagacttgctcggtgctaggaaaccttagtcggttgctccgcttagggaaggtgccagcctttagacagcttccgaataggatgctggacgtcgcataaccacgtgtttcctgttaactgagcaattaagttctgtttcttcgctcactccccttagttggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgactgctgctcttccctgttgcagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaaggtgagtagtcacaaggacatacagggtttgcctgcttgggtcgcttggttgtttcttgatttacctgctgtcgagtctgtttagaaagtgacagtcggcatcacttaaagcattaaattcatgagccggccaagaggtgtcttttttttttttttttattcaagatggcgtgtgggattggaacactagattttatttgagcagatcttaagctaagactagcccaagtaaagattttcctaagtaactaggatatgagatagagtggaaatgtcaggaacgaagtaaagatcattagatctgattag

SEQ ID NO: 52188 - DNA, 2437 bp, Homo sapiens
cctggccaacatggtgaaacaccatctctactaaaaaaagataaaaattagccgggcttggtggcgggctcctgtagtcccagctactcgggaagctgaggcacgacaattgctagaacctgggaggtagaggttgcagtgagctgatattgtgccactgcactccagcttaggccacagagtgagactcttgtctcaaaaaaaaaaaagaaaaaggatgcttgggagtcatttcatgcctctgctttctctgggtttttctctgctctttggaagctgggagaggtcatactgggtagttggggtgtgaatctatagtcgaggtatagtgaggaagtcaggttgtgttctcagccaagtttcattgacttctgtttgctctggggtgcatgttgcaggctgagctattaatagttacttgggggtgggagggagttgaagatgacaaggaatgttattgctgcatttttctccacaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagacttggatactcacaggatgttggaggaacagcacacctttgggaagcatttttgagctgaagcagaaggaagaaaatatatatatttgtgcttctcagagttgtatgttttctacactgctggtgtggcaatagatttttaaatgttacttttaaaaagaaaaatggagatttgggagcagtaatggaggatcctcagcaccactggaaaataggctgggttaggggggtgctgaaagttccagcctccaaagcaaacttacagtatggctgtgtgttgcgtgggatgctggtggcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttcatgtatcaatcagatgtgaattctcaaaagttagccattgctgcaatctctgctgttgcctcctgttctgaaaaaattaaatctcttctctttcagtatgatgggatcatccttcctggcaaataaattcccgtttctatccaaaagagcaataaaaagttttcagtgaaatgtgcaattctgttgtgtgttctgtgaaaggatcctggccatattcaagtccttggacctcaagccacttaaagcttcgatgggagtagctggtaacaaccccgtcatcctctgattggatgccagtatttcctggcagatccaagtccaagcttcatagcattcattgcctgtgcttgccacaccttggttgatgtgct

SEQ ID NO: 52189 - DNA, 2089 bp, Homo sapiens
aggaattggctgaggaatatctggttgaagatcaagggcagaacgctgaaagctgtcagtcgatgaatgaaatgataagtatttagtgagctttcatagtgttctagacactatgactaaggactgcacatggtttgtctctgaatcctcatagtttgtgaagtagagacaggaccaagttcctattttgcagatgaagtaactgaagtttggggaggtttttgacttattcaagatcactcatcgagtgacaaagccagattgtcaagcctgtctctgactccagaactccatcttaacagctctgctgtactgattttgacctagttttaggaactataggaaggaaatgtgatcaaacccagatcacttttctaatctacccaggcattttgtgtccaccgttaacatccaagctctgattctggcaacttgaaattactcttggctttacacttatgtagaagaaaacaattctgttaaacactgtggcccttctggaaacatgatggtcttttcctgtagaggccttttcttccttttacttcctctgtgccaggtccatgggtaattcccctaaaattggtacctttctcataaattctatcaaaactagggcaaaaatgatagttgttgatggcttttatcagagttggtaagttttgattctcttctctacatcttatttccccttggtgtagcacagtggttgaaagcagggaatctaaagccacagacctgagtgaatcttgccccacttgcatcttgggacaagaaacataacttttatgagcctattttcatacttgtaaaatagggatattacttactactgtaaataggcataatacttatactcattactgtaaatggttagcactaagcacttaataatcagatattcttgttaaagtgaatttgactattgaaattaatgttttcttctctgcagctattgaaatatttgaagaaactctccaccctgcctattacagtagacattcttgcggtaagaactgtgtgactttaaatattatataatgatatcccattcccttctcactggagagtgtgtagaataaggttacaagtatgggctttggaagtgaaagaaaccagacacaaaaggccatatattgtctgattccatttatatgaaatgtccagaataggcaaatccatagacagaaagtagattagtggttgccaggggctaggagaattgggaggaacaggatttctttttagggtaatgtaaatgttctggaattagatggttataatggttatataatattgtgaatgttctggaaaccactgaattatgtactttagttaaagtggtgaatattgttaaatgactttatttcaaaattagaattaaaagaacattgactttggcatcaattagtcccagattcaaatctgagttctatgactttaggctgttcctatgtaaaatgggtctgattcctgcttcacagggttattgtaaagactgattcagaactgtatgcaaagctcttatcttagtgcctaacacctgccctaatcactcttgttattaaagttctgaacttggtacgctttgctactgtgtgtcattagagatttggggcatagacacaaagtaatttagtgttaagatttgcagggtatgttgtaggaaggaagtattgcttgttgagtttctcaaagtagaaagccttatttctttagaaaaacgttagcctagttccagacccctctaacaattactttgtcaaattttaggagactggggttgggaaaacagtaaatagcttgcgaaaacacgagcatgttggaagctttgccagggacctagtggcccagtggaagaagctggttcctgtggaacggtaagaacatttctctttaggtttgttcaatttcatggttaaatttacagatagaaaaggttttctttattatttctcttttgccttctgaaattgttttgcctcaattataaaaaataatccatgatcattgtagaatattagaaaatattaaaaatagaaatcaaaatttcctatttctatcacgcaaagacaaacgttatgaacat

SEQ ID NO: 52190 - DNA, 1031 bp, Homo sapiens
tcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtaaccccttcagccccttggtggcttcccacccagagcacctggccctgcagagctcagaggattgccctgccactgttttccttagcttgcttttggggggcatgttgaatttcagtgtgcagtaatttcctctgggcttcactggt

SEQ ID NO: 52191 - DNA, 1033 bp, Homo sapiens
aggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactccatatactgtgtcttccttacttatagcatcagtggaaagaagttagaaaatgcctgattcttggactg

SEQ ID NO: 52192 - DNA, 1050 bp, Homo sapiens
tgttgctttctcctcccccctccccatcccctccagtttgttgaaagtgatgcagatgaagagcttctgtttaatattccgtaagtatctccttggtgcctacctcaggctaaataggctgtacccagttgcctcagatggattcattcactggtgtcaagagcacacatttgcttctagaaatgggataaattactttggtgggtttgaggaggaaagcatcatagctttcttggtgcagactggaaacagatgtatttgtagaacaataactgagaaattgaggtagatttcttagaattgtagaatgctagaggtagacaggatcttagaaattatctagtacaagttgacagatgagtaaactgaagcccatacaggggaagggtcttgcccagggtcacacaactaaacaggtattcaaactcaggtttgacaaccttctcttttgcattctggcagatttacgggcaatgtcaagctcaaaggcatcattataatgggagaggatgatgactcacacccctctgagatgagactgtaagtggcaaaggcttaggccctcaaaggagctcctaattctctttttctggtaacattttattccagaatagtatcattttcttcttaccgggtttaatatttccccttttaaaatatcttggtcctgttctcattctgcattggaatacatatatttcttcctgaattaatgacttttttagattaagcatctttaggcccaacagcgtgtctcatatttcaaagtgcttactatgacatgattcattcagagagcattgtgtaaatgtcacttgttgatgactctgcagttttcttaataactagctgcagatctcatatgatctttatggattctaggggttagcttcaacatttttccttgctatttcatacagtaatgatcttatgtgttttgttgacatggaattgctccacctgactttgcgtggcatttagttagcaaagttgtgtatacctcttgcaacactgaatcttttgccaccagagctagtaccctttttgaca

SEQ ID NO: 52193 - DNA, 1001 bp, Homo sapiens
gccaggatcgtgccactgcactccagtctgggtgacagagcaagactccatctcaaaagaaaaaaataattcaaatcccagcactttgggaggccgaggcgggcggatcacttgaggccaggagttcaagatcatcctggtcaacatggcgaaaccctgtctctactaaaaatacaaaaattagctgggtgcggtggcacaggcctgtaatcctagctactggagaagctgaagcatgagaatcacttgaaccgcggaggtgcaggttgcagtgagccaagattgcaccactgcattccagcctgggcaacagagtgagactctgtctcaaaaaaaaaaaaaaaaattcatctgaaaaattgattaaaggacttccagagatttaagatatattatagttgagtattagaaacatgaatttgaaagcaaatccatgtatttaatcattttaaggaaataatacctttgatgcttttggagactcatttacttggaagttgatggactgacctgagaatattaggcatccatgctgcattgtgatttagagtgtgggatctggagtaaactgggttcaaataatggctgtaccacttgttagcttcatgactttgagaccttatcttctctatgcctggattttctatatctaacatgggaatggtaacagtgcatacatacctcataagattgtggagaggcttaaatgagataaaacatgtaaagagcttagattaggtctggaacacagtaagtgtccaattttgggtgaacagatacgaatacatagccctcagttctaagcacactacatatattatactttatcaaatgtaagatgtcattgattgtaaaatgtaccattatattcaattaatacagaaaaaatgctattgaactatgacatgtcattgacacatccagaaaaattagattgagagtattaaatcagggaagtttgaacacagatgaggtgttacatgttactaaagaattaccat

SEQ ID NO: 52194 - DNA, 1120 bp, Homo sapiens
ttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaatgtttgtattttcttttgagttcttgatagccactgatgcaactttcatttcatggggaactgtactgaactttgaaattttttgttgttgttttggactaggtagattataggaagtgccacaattaaatcaagactggagccgggcgcggtggctcacgcctgtaatcccagcactttgggaggccgaggtgggcggatcacgaggtcaggagatcgagaccacggtgaaaccgtctctaccaaaaatacaaaaaattagccgggtgcggtggcgggagcctgtagtcccagctactcaggaggctgaggcaggagaatggcatgaacccgggaagcggagcttgcagtgacctgagattgcaccactgcactccagcctgggtgacagagtgagactccgtctcaaaaaaaaaaaaaaaaaaaatcaagactggatcagtttctccaggaatggtcaagcttaattttgtacagtaggccaaaaacactcctacacccatatatagtaaagaagaaggtggggttgaaaacctgtatttcacagaaattaactgggcatggtggcgtgcacctgtagtcccagccacttgggaggctgaggtgggaggatcactg

SEQ ID NO: 52195 - DNA, 1033 bp, Homo sapiens
cagccaggtgcctctcgtgatcccctcttaatcccctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaacgctcaggcctggctgattctattccaggggtggatagtgaccatctgtgagaacctgccccagtgtaagaaaacttgtttttatttttaaatactttggaaagctctttcagagcaatataaatgagtgcctgg

SEQ ID NO: 52196 - DNA, 1050 bp, Homo sapiens
gcattggtgaggatccccagggcatacccaacaacctcatgccttatgtctcccaggtaaggcaaaagggaagggacagaggagtggccctggggttaaagctggtgcctgggatctgggacgaactgacctgatctccacctccaggtggcgatcgggcgacgggaggccctgaatgtctttggcaatgactatgacacagaggatggcacaggtgagcctaggaccagggggacctaggagtgggagccaggaaggagagtcagggggaacagactccccatccaacacactcccttctctgcaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccgccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgt

SEQ ID NO: 52197 - DNA, 1008 bp, Homo sapiens
gggatagtgggaggtgactgacctgggaagatgggatgtggccctcgtgtggcaaggccctgactgagtgagagtagcctggaggtggtggggggtaagtggggggggggtaataaatgaatcacagtaaacaacaggggtctgaaatctcagcagtgggagggggttaggctggtgatcagaaaaggtctccctgagcaggtggctttcagactggaacctaaagaatgagagttcaccatgaaaggaaagatactgctggcagaggaaacagtttaacagaaactaaaaggagaagcactgtctctttctgtgggattgtcatgtcaacagaatcataagccaaagcaaagaatgactctagaatttcaggcaacagacgattgggaggtttgcaaggctcatctctgtggcctcttgtccccagcaacaactgtgtttcaccatccttatgtttctagatgggagtgagtgtcgtggactcttctgtggcaggacttggaggctgtccctacgcacagggggcatcaggaaacttggccacagaagacctggtctacatgctagagggcttgggcattcacacggtaagcccacccaccccctggtggcgacagccccgaactgaccagggggcctgaagctgagaacaaaagtggatgggggtatttggggttgttaaggtgctgaggagtaaagagggaaagggttagccaggcgcagtggctcatgcctgtaatctcagcactttgggaggctgaggcaggagggtcacttgagcccaggagtttgaggctgcagtgagctatgatcctgccagtgtactccagcctgggtgaaacagcaagaccctatctcttcaaaacaaaacaaaagaggggaagggtgttggggattatggatatttgatctaatattttaatgtttgtgagagtagggttgagtgaggccacacgcatgggcataagaaggctggagtgtcagggtgactttgacagttcagtccta

SEQ ID NO: 52198 - DNA, 1409 bp, Homo sapiens
tctctactaaaaatagaatgatattagctggatgtggtggcgcatgcctgtaattccagctactcaggagactgaggcaggagaatcgcttgaacagggaggtggaggttgcagtgagccgagatgcagttgagccaagatcacgccattgcactctagcctgggcgacaagagtgaaactccagctcaaaaagaaaaaaaaaaaaattaaaacagcagaggatatttaaaaaacagagtgtgccctagattctttttcttctctgtctattttaagcatgatgccaggcttggcattcatagctagactttcattgtttctgttctctccaggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtgagtcttgtcttctgttgtgtgtaagaacagaacagtgccccatccggaactggtatctccttgggtccacaatgtcacaagccaggctggaagttgccttgagaaaatccagaaggttattttcctataaaatttgtaccccatttgagttatgtctcaggctacttggttatctttgactagtgaagggagagagtgggtttggtgaaaagggaaggagcaacaaagcatcagtcaatttattgagattattaccctgccccctaaaaatagtaataatgaatgcttggattgtacggagccccatccaaaattctttccattcatacttggacttctggatctagttatttgatcttgggccccattttttccactgcagaatggagtgatgatgctttatagtgttgtgaggattaaatgagatgagtgccaggcacaaactcagtgttcaattaaagggaactgcttttattataccagagagcttaggtctctggatctaatccctctattaatccctctgttttggatgagtttctgtttagtggttgtcttagtccattttctgttgctataactgaatcccacaggctggatttttattttattttattattattttttagacagtctcactctgtcacccaggttggagtacagtggcagaatctcagctcactgcaacctctgcctccaaggttcaagcaattctcctgcctcagcctcccaagcagctgggattataggcacccgccaccacgcccagctaatttttgcatttttagtagagatggggtttcaccatgttggccaggctggtctcaaactcctggcctcaagtgatccacctgcctctgcctctcaaagtgctgggattac

SEQ ID NO: 52199 - DNA, 1049 bp, Homo sapiens
gttagccaggttggtctctatctcctgacctcatgatctgcctgccttggcctcccaaatggtttcagtttttatcttgtattggccactctgttataaaatatgctgcatttaacatttacattaagatattccatgtatgatttatcattcttcagctaaaccttgaagtaagaaaaagaatttgctattttttttttttttgagtgggattgtcttaagactttttttttacgtaagtaaggctgggattatatagttggaaaacagcctgccatgggttcagatacctgatttgtagttccagcttttgaaactgcctaggggcatggccccaggcaggtcctctcctgttcatttctcctcttatagaaaaagtgatttaccagatgatctttaaagcaagctctcccagccctgacatgtatctctgcagcagggtttctctacctcagtactgttgacatttagggctgaatatttctttgctgtgggggctgtcctgtgcattgtaggacgtttagtaacatccctggtctctacccactagatggcataccacccccgttgtgacaatcaaaaatgtctctagactttaccaaatgtcccctccagagcaaaattgcccccagttgacagccactgctctagactaagtttcttgcttccaaatagagccttaccaaagtgtattacataaagaagtcaagtggttttactcctcatgaccaaatattctttccctccttaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggtaagagcacctttgagttttttgtttttgtttttttttttttaacatgcagtatgatttattttatataatgttcaaaagcttgcaaaaacagcat

SEQ ID NO: 52200 - DNA, 1050 bp, Homo sapiens
tcgtgatccgcccatctcggcctcccaaagtgctaggattacaggtgtgagccactgtgcccagcctgctgtgtttgttttaaatggtggttttattagcaaactggttttattagcaaatgttttcagttttccacatcctctgcactgtgataatttttatgccacatactttcaaaatgaaggaaaattaattttaaaatatttgttgcaaaaatcagtccacaagtcaaatgcagtgatgtgcacctgtagtcccaactactcaggaggcttaggcaagaggatcgcttgagcccaggaattcgagactatagtgcattgtgatcatacatgttgatagctgctggactcaagcttaggcaacatagcgaaaccccatctctaaaaaaaaaaatggtccataagattttactgtgaacatgttcagataataagctctgtcctgatcacatgtcttccagctataaacctgatctgatctggtctgatggggagtgggaatgtcctgatacttactggaactccacaaattttctttcatggctctacaatgacagccctgtcaaggtatgtgattatatgacttcttatttatctcctatgaagaaagaaagtgcaaggagccaaactctggagtagacaaccacagcagcagcaataataaacaggaatatcaacatgggggcagtagggactgggacacttaatggatgttaaaggtttctcctttaatcttccctggctcccttagagtataagttttcttctcctttagtgttgtttttttttttttttaattgagacagaggctcactctgtcacccaggctggagtacagtggtgcgatctccgctcactgcaacctctgtctcccgagttcaagtgattctcctgcctcagccttccgagtagctgagattacaggggcccgccacctggccggctgatttttgtgtttttagtagagacagggtttcgccatgttgggcaggctgctctcgaacccctgacctctggtgatccgctcaccttggcctcccaaagttc

SEQ ID NO: 52201 - DNA, 1050 bp, Homo sapiens
acaaggtctcactatgttgcccaggctggtctcaaactcatggactcaagggatcctcccacctcagcctcccaaagtgctgggattacaggcatgagccactgcgcccagcaggactatactctgttgggataattgacttaaaagataaaagatggtttaaataatattttggtgttaagatatttatgtataaaaggtagttatgtgtttaatcaaaaacacagtaaacctcattttgcttaagtgaatagtgaataatttaaggaaatggttttggatcccattcctctctatatgctcttatgagtgagtgccactgaaatgaaaaaatgctagaactgattttccttaaaataaattatttgttctatgcttaatgacagttgctgttctgtttttctgtttaaggaacatccgctatggactataccactcactcttagagtggttccatccactctatctacttgataagaaaaatggcttcaaaacacagcattttgtcagtgcaaaaacaatgccagagctgtacgaccttgttaacaggtaagacactgaaatattttggccctatgacttttatcaatgaaatcagagcttcctatagggtaccattaaagtggaggagggataggtatgaaaaaaacctaaaagacatcaaaataataaaaagtggtggttgtattaagacaaaatatgttctttcctcctgcctttcagaacttctgtcatgtggccatattgccttctacattgaaacaatcacacaaaacccaggatggcagaaagtcaaaattttagttcccttcttacatgccgttttccctatgtcaggaccctggagagggggtggtttggcatcgggcagatttgtgtttgaattctggctcctgttacttacatgccttaaacagaacactctcctgagcttgattctcactctgtaaagtggggataataatgccttctttgtagggctcagaatagtatgtgaaatgtatctgtcacggtgcctggtacaaagtaaggctgttgttattaccatta

SEQ ID NO: 52202 - DNA, 1767 bp, Homo sapiens
tgaaagttaagctgttccctctagggagacatttttatatatttaagatgggcttagactgttagggcttgtgagaacttattttaagacggggaggaggcgagagcgttcataaccaaaggaaacactgcgtgatgtctacatgttccaagagactgaaaatggatgtgacatgtgtggaaagattggaaaattctggtgggagtttaaaaacacggtctctttagaaaatccgcctgaagccaattttttgatatgactcaacatttaacacttccttgattttatacgcgagagaatctgaaggtctttcccaggaaaaagataaagataaaacttattgcgggacttggagacacttacaaaaattccccaggagtgactggatctcaagggtgaagagtttttttaaatggtcgtggttataaggtcaaagaaagccatcttacgagaaattttctaccttttagttcaggaagtagccttctttacagtcaacgattttcgtagtaaatctaaatgatcactttctcaacgtgtttttgaaataatgaagtaatctttacttttctagctaggacttctctcaaacttgtgtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtaatcatcataatgggcaaacattttatgatggaaccatcctaaaccaattgtttttattttaaaatagattatgtagatttgtgggtaagctcatttttcttagggaaggtataacaataaaggttgtgcatatattgaagtctgaacggcttgcttttttgagtttaaagcagctgaatagcctgttattgagtcttgtccaaaatatctggagttataagttggagccatagaagcttcttaaagattttgaacttttcttaatggaattttactcaatatttgtttccattcacttgtaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacggatagttgtcaattggtctgaaacaaattcgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggt

SEQ ID NO: 52203 - DNA, 1512 bp, Homo sapiens
aatttttaagctgacccacatacttgctactggtttcgcttatgtttaagcatttaaagttggcaaaacatgttatcaatgtattatgcaagagtttacatcttttgcataagtggtccattgggttgcacctaccccttgaccaaacaaaaacaaaacatcactggcaccatactcgaaactacctgtatcctaggttataagattgtgaaagccaacaatctataaggttggagggactctagttaatctttgggcttagaggaggaaaaaaagatagtcccatactgcatttcacatctcttaaaaatagttttagcagcttaaacctttttagttataaaacttattacactagggtttactttgaaatatagtttacaaccaaatcaagtataacatacatacactggcactttagcacaagggcaaactttaaaaacaagttattttggacctttaaaattaggccatattataaaaaacagtccacggtcttacattcagcaaattcatactaaaatactccatttttgtaagataaaggccaagaaaactttacatatgctacaagtttattacagatatttacatggctctttctcccctaggtacttaaaattttcacattatccaactccccaaagcaagctttgcaggaatgatgaggccagagcactattagaatagcttgtgcagtgctgtaatacaaaaatgtattttgaaagctattgagtgaccattaaatactgtttctataaaaaatggttttggtgtatttgttgacagacacttaatccactacatttaataaacagggccattggggtgtactatgtctcattctaatgagctccaaatgccctttccacccactgtacaattcactaaaatgcaattattacgaaaaattcacattttctttcagcagtgcatcaggttagcatattactggtttgggtgtttctaatatactaaaccttcagatgtttacctaattctgaatccttgtgttagctagaagcttataatccgattcaccaactttcaacaatctactggtccatgaatgataaattactgtcttcccctaacaatagaaaaagctgattcctttaccactccccaaatctaaacttggtttccacttaaaagttactcagttgagaacacttaatatcaagtacaatcattagtttaagttgcactgatactaccattatatcacagtgcacacaacacgagatggtctattttttttacattaattagttctacacaaatagattccctagcgaatttgtttcagaccaattgacaactatccgtgaacataactaaatttaaacatttgtcttattttatacctgtactttaagtaaggttttaagttgaaatgtcattatttccttatctgaaggattaaaggaaacagggacccagtggcttggtggtttgggaagaacacttggtgatggcggctcactaaatttggcaccagcatagttctga

SEQ ID NO: 52204 - DNA, 6061 bp, Homo sapiens
aaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataatgattaactggaattattacagtattgaatatgattctaaaataacaatggaaacagtcctttatagatttaggaatattttaaatcattgttgcactaggcacaactaacttttactttggaaatgatagaacttgccagaaaggtacatcttttacacagtagttaaaaattcattgtgtaatatcaaagttgtttcatgattgctcattaagcctcttgggttaactaacttaagaggttatttggtagtgttaagatgaaatttggatcagctaattccaagtttatattttcattattggatggatcagtaattctgctctccctcttataaacaagacgcattagggcttaacgtttatgacatgattttaaatcattttaaattgaatgttgatgagcaactaatattaagtgataacctctttggggaagtaggttaggtattttgtggtttgaattctatctactttatgacaattatagctaatttattaagtattcatgatgtgccagacacttgaaaaggctatgtgttaactcactcttcacaaaaccttatgagaaagatacttttattttccccatatcacagataaggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacgtagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcattttttttttttttttgaagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgatttttgtcatcttttttgccacatacttaaaattttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctctatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaatcttgggtttttttaagattttgctcttagatttgtaaccacctgggtacaactttttcctaatttgtgtaagaggttttagagatgcactctgtccctcttgctttacaaattgcctacaagaatgcaaccaaaatactagaaactgaaacttacacaaaacctttcaggttttttcctgtgttgtagttctagggaagaggatagtttattagtatttattttaagcttaaggataggttttggacctggattccatcatagtataactgccatcgaaaagaagacaaattgaaattacagcatttacctaaggttcacagtatggctgacttcagcagccttacatggtaagttctctgtaccagctatttttggttctcgcaattgcatcgacttgggaaattcctatcaccattctctatataggctaaccaaaacttttatcagtacctttcctaaagtatgaagttaggtaatcttccactccc

SEQ ID NO: 52205 - DNA, 1562 bp, Homo sapiens
ttgagattgcgccactgcattccagcctgggtaacagagcaagaccctggtctcaaaaattaaaataattaaaaaaaaaagacaccaaaacacatacacactttttttttttggagacagggtctctgacccccaggctggcgtgcggtggtgtgatcacaatttactgcagccaccaactcatgagctcaagtgatttccccccttagcctcctgggtagctggaatacatgtgcaagccactaggcccagctaattattttttgtagaaatggcatattgctatgttgccccaggctggtctcaaactcctgggctcaagtgatcctcccacctcaacctcccaaagtagtgggatcacaggtgtgagccaccacccgggtcatacatactctctttgggatataagaggggatgcagggatttttttccctatttattgagggctttaatactgtttttaatatttttaaatatttctgttctttgtatttcctagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaagtaagtgtgctgtgtagcacagtgatctgtttaaaaaatgtatttgttagcatttaatttttttttactattttgtatacttttaattatatacattgaatgtttcattgagacaaaaaatactgtagcattttattttaaaagttttatggtttgcttttaattagaaactttgcctctatgaatagatatttgtcactgctttttctgatatgctttttagcagtagaccgactggaagaccacggcgtagcagaagccattccgacaatgataggtaaataactttgctttgaaaaagactcatgtattttttaatttcagagtgaacttttgctctaaaaataacaaatttgattaatatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaat

SEQ ID NO: 52206 - DNA, 5587 bp, Homo sapiens
gcgtccccccaacacgtctctgttcgtcaggaacgtggccgacgacaccaggtaggtacaaggcaggtactccgggcctaggcggggaggccgcaggcgcctggagaggaccctggtggtggcggcactgggccgggggaggggacggagtgaagatggcgggtcccgcgcccgctttggcgccgaactaggccgcgcagcgggcctcagccgccgcgtgggagcgagggcggcgcctctgccttcgccgggccgcgtggcggggtttttcggtccccctccccctccgcagtttgcagcccctttctccctgcttcctgccggcgcgagcagccccccgccgcggcctttccgcgacccgacggccgccccccattgatttgaagttcacattcttcgaggttcacgcccccttggcccagagatttttttttttccccagccaaaaaatagtgagatgaaataacgggatcgagggagaggaatgttgctaccatttatctttgttgttgttgccgttgttaatatttgggggttttaatcagttggaggtgtttggagaaagggagcgttgagatttggggagttagatttttccagttaaatgttgcgagtagtttttcttatttcctggaaattctggtcaccctttgaaaagggaggtttgggaagcgtcagtcattaggacgttgacagctaagttagattaattcagacgtaccttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataaataattctttccataatttctaatagttacgttagcatctagagaaattttctctttacgtcatcttgacacttaactatttaagaagttcgatatttgtgactttttcagaccatatttatctactgttaagtgtgtaaatctgtcgctaaaattggggagtaaaaataagtgcttggtatttttcagagtgctagagtcgatttgatgctgtaaaagtaaaaaaaaaaaaaaaaacaaggcttatatacaacctaatgctgctgtaccttttatgaaaaatgacggctgtagataaaaataagttgtggtcattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatgtaagtggtaacatctaaaaagtagttctttttgtcctctaataaatgtctgtcttcaaatttttgaaaattaattctgactcacacattgctctcgttattaaagttaatccaaaaatggtaaaatatataaattcccattcatgcttctgaaactcatatcgatgattatatatgtgatttaaatttgaatgcactctggttgctactacctttaatgtaagtcctttaaaagttaatatgttcttgtgcttagcaattaaaatttggtattcttgtttgttaatttgaatcacttgatcaaaaacaaattgtataacaatgaggtaaacttctttaatattgtcccctaatttgctgtcctctgttgttacctcagagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatgtatcctacagaataactatttttcttttttttttttttaatgttttgtaagcagttaattttcaaaattattctggtttggtctagtgacaaaacctgtaacttgatttatgtgggcctttgatgttgtgattgtggtcttgtgtaaatgcactctctcttatgaagttaaagtgtaacaggatgtatattcttaagattaaattcagcatattttggttttggaccaggtggtcagatgccacggagtagcaggcagtgctctttggagtagcgtggggttctggggttaagccacagagccctgcttaaaggagagacaggtgcatgcactggggactacttagaaacagctctggtggtcttgtagggtcagaaccactagaaattttgtttatatatagattttaaagtggttgctggggacacatataaacccttaacttctttaacttagccctgtgaagactgctggccctgcgctgctttagcacaatgatcagttggccctgaatgagttgcagaaggccttctccctggtataggtacctaactgggacctatgggagactggtccctgacccagagtttcaggtgaccttacttccgttcctttcagtgagatcatctccctgcaacaagggtttgggttgtggacctcagactaggaaaagttcttcctgcttaaattcagtgagcctcaaacttttaagttagtggagtcctagtgagacttagggaaaagccaaaaactactcctgcagggccagtgatcaaggacagttgtgagaattggttgcaaagctccattacagagaaaataatagctatatctggcttagtaaataaaggtagcagtgcgttctggcttacaacatagacctcattttacctagtgttgggtggccgaggaatcaaggtcagtagtagtttgattcaagagtgtgtgatatttgaggcaaaaaaggctagtaattcaaagcaatctaaaggagaatgataattttaaaatacatattcagtaagtctatggttttaaaatagttgaaaagaaataagtaacaggcttatgaatttcatttttgaaaagaccataaagtacaaatttctccatgactgacatcagagtgatactcggctgcctctgctgctgctgtctcttctgtctgactccattcgcaatagccttttcttcctatccctggcttaccgagtaaagtagaaacttgccatcagcccaggattctgttttcgagggtagccccagagaggatgctctgttctcattaataatttttacagctctcaatataaatcctttttatacttattatattctgtctcttggggtaacaaagtagtgtacccattaagtgaacgtattccttctaattagtttagagcccagctgcattaaccttgagggatgttcagttacagtattcaaggttctgaactccccatcagcctttcccttttcatgttgaaagcccagttatttagaatttgtccttccatttaatctgttcataatggcctcgggaagacagagctggaaacctgcagtccttaattcctttcagaacaaaaagtgggaagtctagtaaggcagaccttttagtctctataataaaaaaataccagtatcggtctcaaaaaaggagtgtgtcacttcagggatattttaaatcacctctctaaatctgcagtcttgtgttgtctctcaaatttaggaaaaagaaatgtgcaaactagaatggggatttttgggatagaatgaaaacctatacctgtacctaacctagctctctttccaaaccatttatatcaaacactgtcttgaatgtgtacttggcctctgttaaaatgatggttttaggaaaggagctaggtttggacagaatagctatataaagccagcagttctcgtagtattattgctgacatgaccagggaggacaagcagcttagcttctcagatcaaaaacaagtaccagtagttcctgcttaaggctggtaaataatatcttgaaattctcaagttggaaaccagtctcaaacccatttctttgcaagaagttgtatatttagggtcatggttagggctttccagtctaggagtccttccagtggtctgtttcttgatagcatgcttttacagtctgcatggatgtaataacgcttttggtatagtgattgtcttgagtactgcttgactctggtcttgatgcccacaaatggctagcgtgcttgtcttcccatgcagtggaaggaagacagttaaatgaaatagtagtattagatatatatgaaaaagaaaacagcaaaataaatttgaagttaatgctttcctctcttgtaaggtaaggcatatactgcttgcttacacaagaactattggcattttctttttttcgtttgaaacaaatatgaaaaatagtattttggttttaagaaatttttattttagcatacaacatataactgacatttgttttttcttttttgtcttgtaaacttaattcttaaaacttaggaaaatttttggataggacaacttggtgattcagctataacagatcttatttcaataataactttactgcaatatgtattcatacattttcaaatgtgtgccttaggaaatcacaagtgcttttatagtgtgaagtgttaatgactgaatccaactgaatcaccaactagtaagtgggggtctggttgatgttctggaataatattgggagattgtgaattgttccagacataccaactgaactttcattcattatcaaagtttgcaaaacttcccaagccccttaacatttagcacatttgaggatgttcgtgatgctgaagacgctttacataatttggacagaaagtggatttgtggacggcagattgaaatacagtttgcccagggggatcgaaagagtaagtacccttatgcctgatatgtatgaaacattattttttagtgttttgagatttttttttaagaatttaagcaatttgtgtttctgttcaaaacccaaagggatcttttttttctttctttctttcttttttttttttgagacggagtctcactctgttgcccaggctggaatgtgtgcagtggtgtgatcttggctcactgcaaccaccacctcccgggttcaaatgattcttatgcctcaaccttccgagtagctgggattacaggtgcatgccaccacatctggctgatttttgtatttttagtagagacgga

SEQ ID NO: 52207 - DNA, 1053 bp, Homo sapiens
agctaagggaaaaacaaattgcatagcctgtgaggaatatgcctcttttcacctgggcctccagaagtccacgtgccctgggacgatttttacatcatcgcttcctgtacttgcagatctaaagaaagaaaaacgcagggccacacaaaatcccttttattccaattataaatattggaataaaataaatattggaataaatatcaaatgtttcatggtgaaattagtctttgggtttgctttaaagtactttagtctaataaaaaaaagtgggagcggggagacaaatggaaaagttagcaaaatagtgatgcttcttgaagctgggtgatgcgtaccttggagttcatactaccattctctctctgtttgaatatatttggaattttttcataataaaaaacttcagagacctcatgagaaacaaatcttcggctgtcttttcatacaggagtcatactcattatttacatccggcaattaggcaaggattttagatacaggaaagtgtgcacagagttcctctcctgcaggcaatttactacagcctgttatttttcaattgcgcaagttaaaatgaatgggtgctctacaagaaataattatcacggaaccgctgcagttttctttaaaaaacttacacatccaagggattcattgactccacattcattcaacacacactttattgagattactatgtctcaggaacctacaaaattaaagcctggtgctgagatccagcttcctttcacccaatgtatgacctgattaagttttttagcctgtcttcctcttgtctgtaaaaggaaggctgctatgagaattagatgagacgatgcttgcttgccaagtaactaacacagtacctgacaggagctaaacaaatcatagatttccccacccacccattccctggggatgtcatagtctactgggaaagagagaggtgtcaatccaacccccacagaattcaacagttccttccttctccacaaatttgactgatgatagtatgaacgcttccagaaatgaaagcccacaacctcacaa

SEQ ID NO: 52208 - DNA, 1049 bp, Homo sapiens
gcaaacccaccttcccagcgcccatggggtaggattcgtgtgaggtggaccagccttgaacgagatcctagtggctccagaaggggttctgaggggtcagggggtctaggagcccacgagggtttatatgttgaggggtatccctgtgtttatgattaccctgtgctcagagactcacagtattatttcatccgcctcacaatcatctgtgacacaggcattactatcctcacttcatagatgagaaaacaaatggagaaatagctcaaggccacacggtaagagggagagcccaggtttgaacaagtctatctgattccaaagcctaaggtccttcttagcactcttcagcctgtttagataactggggaaggggagggtgggtgctctcccagaagcatattcattcagtaaactcagagcatctattttgtgccactctgcacggtactgaacgtacaaagatgatgaagtggtctctgtgggccttgggagcccatgttcaaggcaggaccattggaaaacagcatccctcatgcttgacccggatggggcaggacattgatgaatcgtgatggagggggtgactatgggatgcttcaaaaaaaaggcttcctggaggagatgacatttaactgaagcacatggacatttccaagaaaaatagagtaaggcagggatcaagaggcagagggaaaaccattagcaagaattcagagtccagaggccagcagaggagacacatggtatgtgaaaggactccactgagatgcctgaaagtgtgcacaggtgtgtttttactcaaaaagaaacaagcctgacagagtctcctcattccccaccttccccaggtgaccaacaccaagaaggagactcgctttcagtggttcttccagagggcagagatgccagatggtcagtatgacccagagacgggaacgggacttctctgcattgaagaggcaagtgtggctccagcttcagggctcactttctcctttggctgcaagccagggagggccaagagctctgggctgggagtcagggca

SEQ ID NO: 52209 - DNA, 1047 bp, Homo sapiens
tggagattccttttctgtagggaattgtatgtgcctctaactaagtaccttcaaggagaccttcaaagaggacttggattctagcctggctgccagggacttgctcttgcaagttctctgtactcaggttcttcatctatagtatgcagagttggaccagatgaccacaagggcccctgtcacatgcccccatgtctcatcctcccccagcggctcacggcctcagctctgtccagaaggcataaagcctatgcctcaagccctggaggaagtcagggtggtgtggccagtgcagacccagtgccagagagcccagataatggcaccattgaaggtgtcaggccagaggggaccctaaggaggtagcaggaggcagctgcctgtgcttcctgacttggccagggtctgcttggggtacaggctcaccagaagcaacctggactccctggctcccaggcctctagtgcacaggaccaaggagctcctcccagagcctctgctctcctctctctgccaggtccaaggtcatcctgaaagaacccggcctcgaggatttgggcacctactcagtcatagtcactgatgccgatgaagacatctccgcaagccacacgctaaccgaggaaggtaatgcacctaccccgctccctgccacctccccagagagagagtcccaaacacaaatgcccacacaggtcagcaaaaagcaaccaaaatgagtaaagtggcaatttccacagagaagtaggccctcacccacccattctttccatcaatagatatctgttgagcacctgccacaggccaggtaggccctggatattacatcagtgaactcaacagacataaatccctacccagtgaaatttacatttttctggtctctcttttattttcccacctttttttttttttttttttttttagacggagtctcgctctgtcgcccaggctggaatgcagtggcacgatctcggctcactgcaacctccgcctcccgggttcaagcaattctcctgcctgagcctcccaagtagctggatctac

SEQ ID NO: 52210 - DNA, 1032 bp, Homo sapiens
ataaaaagagaactaggaagatcatgcacctgccatccatcagtccatccatgcatctgcccatcagtccatctatccatctattcatccatctatccatccatctatccatttattcatccatgtatccacctgtccatccatccatccatccatccatccatccatccatccatctatccatccatccatgcatccatttattcatccatgaatccacctgtccatccatccatccattcatccatccatctatccatccatccatccatccatttattcatccatgtatccacctgtccatgcatccatctgtccatccatccatccatccatccatccatccattcatccaaccaaccatccatccatccattcattcaaccaaccatccatccatccatttaacaagttacagcagcccctatctcaaaaagcttagtttcagggagccatgaaaatcagtagagaaatttcaaggaaagaaaactgagattaaagataaggactgaggaaacctatcagatttggtgacttttgagtgagagagagtgtgtgtgtgtaaggatgaatgagtgagtatgcttttgtgctttagtgaggaagcagagatgctcagaggtaaggggagagaggacttttaggatacacttctgggcctagggaagaggtcccaaagcccccagcaggtcaggaattcatgcaccttgattgctgtgggagctccttctggcctctccccatgctcctccccttccccagcctgtcagacccatgtaactcagccttctcattcagcccatgtttctattttttagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtacgtctgcccacccgtatcagtctgttctcacactgctat

SEQ ID NO: 52211 - DNA, 1078 bp, Homo sapiens
gtttcccctgttgcacattattattattattttattttattttattattttgagacagagttttgctgtcattgcccaggctgcagtccagtggcatgatcttggctcactgcaacctccacctcccaggttcaagcgattctcctgcctcagcctcccgagtagctgggattacaggcacatgccaccacgcccagctaatttttgtatttttagtaaagatggggtttcaccacgttggccagtctggtcttgaacttctgaccttaggagatccacccacctcagcctcccaaactgttgggattacaggcgtaagccaccgtgcccagccacattattttttaaacattattcttggggacaacagaagactgtaaaatcccagctatggaggggagcatgacagtggagttatactttcgaaagaaacactgaggtcttctaactatgagtcatatgccaagttcaagtcagtaaacacttagtgagtggctaaggcgtggcagataagaaccaggagaggggctgagttgtttagggcatatgaaattgtgtttgactgagccccattcagcaaaggtttgcttactcacagttcattgagcacctactatgtgccaggccctgagcgagtcattagagttgtatccaagaagtaagatattcagtgcacaaaaatgatgatattgtgattaattcatatcaaagagactgctatggtttgaatgtggccttcaaaattcatgtgctggaaactcaatccccaatgcgacagtgttgggaagtagggcctgatggaaggtgtgtaggtcgtgagggctctgccatcatcaatggattaatgagtccataaaaagggcttgtgagaatgggttctctctctctctctctctctctcctcttctgtcatgtgaggacacggtgtcctccccttcagacgacaaaacattcagggtgccatcttggaagcagagagactgggtcataacctgaaggcatcttgaacttgaacttcccagcctccagagctgtgagaaataaatttctgttctttgtaaataactcactctgtggt

SEQ ID NO: 52212 - DNA, 1903 bp, Homo sapiens
tcctctgaaggggccttggaaatcagacgaccccaatcccatcgaggctttctatcttcttgccaaaaggaacttctttaaggtagttctaagagctgtcttaggcagagagttgggtttctctaaagggacttgtttgctgggttggaacagtcccaagtgggaaggttacagtgtggtggttaagcatgtgtactctttgtagtgggcttgacctaagttcaaatccaggctctgtccctgggtgatctcagacaagacattcaatttttctgggcttcattttcctcatctggaaaatgggtacaagaatgctttgtagaattctggaaagagttaagtgtgataaatgctgtaaaatgcttagcataaagctatggtctgaagatgcgttcagtaaaatgtggttcctctcattcagaggcagttctaaggctggggaagatgagaagtgatttttggtaggtcacctcttttggctgggaggatgcatgtgccttcctgcccacatctgagatttaagatcctgactgactgatgctgatcttcaccatgatgtccttcttggggtccagaccttagagaaggtagggtgaggctgggatctgggctgctttagattgggttcagggagctggcaggagaagccagaatcctttaaacacaggctctccttttcctgccaccctcagaggtgagtgggcagaggcaaggattgtaccatcttttttctaactgctcctcaacagacttttaagaacttgaagatctgtgggcagacagcagtgctaggtcctgactgcagaccggattctatgttctagctagcccttcagctcttcatgttcacagcacaatcacttgggttaacaggcacatttcttttgaatgaatttcccggggttgacaatgtattgacaattggaccgcaatgagaataagagcaggagcattggtactgacacctgggttcaagtcccagctctagcacttatagctgtgtgatgttgagcaagtcccttaatcctcatctgtaaatagtggccaacagtagtatccacctcatggggttgttagaggatttgacaattttagaatagtgattgcttttaaggctggtggagaacacaccagtaacaccattgtcatttcatgtagaactaaccaatcaatgagcattcccaaacctcttgctatttttccatactttgaacgcgcaaaaaaatcttgacatgtgtctccatcccacttaaatttgctggctaaaactgcggaggctacagacagaatctattcattactgcacgttagggggtatgtgttctgaagctgggttacttgaacagaaaggtttcttgcttttctcctccctaatggtttggatttgaagtcagatccgctgacagttgaggcttctcagtttggggtggggtgagggaagccagttgcctgctgagtaattgcaggcggactccaagccaccatttgagattacagtggcagagcctgggggctcagctgcccctactggtaaggggagggcacccggcgcttggcttgcaagttctgagctgctgttgcttctgcggcctcgacattctcctaaaaagtgccaagttaagaggactggccatagcttacagcttgggccctcatggaatggccaactctggccaggccttgatatagtggcaaaagtgggacttgcctgtcactctaaattctgccacttaccaacagcaggatcctggtgaatttgtttgtcctccctgaccctcagtctgctcatctgtctgtaacacctacctggcaggaacaactgtgagctcccaaatgtggaccagagctccatccgcgcccgcccggtggccaggccccgggtgtaaggcggcacttcgaaggc

SEQ ID NO: 52213 - DNA, 1043 bp, Homo sapiens
gacaacttcttcagtagaactcatgatgggttatctggaaattttattcgtatcacattgcagcttatcattggcatttcccattcattacacgaattctctttgaataagtacgcactatgaaagtattttattgaatccactctgtagtcttgaagatcaggatgatggccttcatgctgtggaagagggaactaaggcccaggtcaacagcttctacatggcaacatttggaatcgatccagctccagagtttgtgtccattctgctgccccacactgcctaatggtggcagaagaggcagtttcatgttttcaaagctaataactctgaattcctgggcgttggcctgcggctgcccattcacggaccttcctctgggatagcctaaatttgactctccttacttgcattcagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatggtacgtctaccccctctggacatgccccgttttgactgaatgggtgtcttcacttcaggcctcatggctcagcagcccaccatgaccaccccagcccctcatctctgggcctttgcacaatgctgttccctctgcctggcaccctccctttcccatggctaacccctactctcaacttggggtctcagcttaaatgtcacttcattcattcactggagaggaggctttcttgtctgggtgccctcagcaaccaccatcgtcgtccttgatgccatcaagaatgcttagaggcttgctgtttacacatttatttcttccatcttctgcacgagactaagctcctagaggatcattactgagtcttcagcacaccatacagcctgccacacagtctgtgacacgtgttgaccaagtggacagtgcctgacccactcgttgc

SEQ ID NO: 52214 - DNA, 1028 bp, Homo sapiens
ctgggggtaaaggggggtctttggctagagtgcaaggcaactgacacactggcctttgatccagtgtaatgtttaggtccatccagcatgcacgaaataagacactgtagcagcccaattggccacagggatgagcagggaggtgctgagaatggaaccaagcacaggctcagggttaagggagcaacatctgttttatccattacagtacttattaaaaaaaaaaaaaaccctgaaagtttaatcgtttatttttagccaaagtcaaatgtctctgtgtcaaaacgtccctacttcaaaacaactgtattgagtcaaccctagcggggtgtgtacaaagtggggagggtggaagaaacgtgtatctctgagtacaattaacacatgtttaggaaaagatctggaaggatgtaccccaaactgttaagcgggagaggggtacaggattataggaattttttttttactttatacatttctgaagagtttgaatcttttgcaagagactggtgttgcttttgtaatcagaagagctaatgatatttttaaaaattagttttgagtggcagggcgcggtggctcacgcctgtaatcccagctcttagggaggccgaggcgggcggatcacgaggtcaggagatcgagaccatcctggctaatatggtgaaaccccatctctactaaaaatacaaaatattagccgggcgaggtggcgggagcctgtagtcccagctgctcgggaggctgaggcagaagaatggcttgaacccgggagacggagcttgcagtgagccaagaccgcgccactgcactccagcctgggcaacagagcgagactccgtctcaaaaaaaaaaaaaaaattagttttgagaaaggtccccatgtacccaaacccactgttcctggcagtggaggggactggccctgagccagctgcaggcccaggctgggttatgagatgagctgcaatgcctgtttgaatttttcaaaaggcttcccagcagaggccctacagggtcatttgtga

SEQ ID NO: 52215 - DNA, 1046 bp, Homo sapiens
cgattaaactttcagggttttttttttttttaataagtactgtaatggataaaacagatgttgctcccttaaccctgagcctgtgcttggttccattctcagcacctccctgctcatccctgtggccaattgggctgctacagtgtcttatttcgtgcatgctggatggacctaaacattacactggatcaaaggccagtgtgtcagttgccttgcactctagccaaagacccccctttacccccagagagaagtacactcagccccttttctttctccccaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggaggtgagggcgcatccccgctcccctatagcatagatatgtgtgtgcatatacagaatgagagaagatagtgaacagatcagagctttggaatccatgggggaaagcatcctagagctgagacgggattgccatgtactattgtccaagttgtacactgtacaacctgcatagctgtaatgcacagccctgggctgaggcttcccagagtgaatgtgagcatttattctcttggggctgtgtttctctgcagtcgatgctcttcccagatatcctgaaaacctccccggaacccccatgtccagaggactaccccagcctcaaaaggtaacttggtctccctggaccctcagacacctgggcagtgggcaggaggctgcagacagagccccacactgtccccagagcatagcaggcaca

SEQ ID NO: 52216 - DNA, 1045 bp, Homo sapiens
atagcttcagtgacctattgtattgaagagaagaatgttatgaagaaacagatttcgtaaccattaaaacgttcatgcttagggcacacaaagaggaggcttctgatatctgaccccaaatttgattgcagccccatggaattctcacggcagcacttgtggtgctcactgtgtgccaggtgcggctctgagcgcttcccaggcatcaccgtccttacccttctctacagccctgggaagtcaataataatgtctccctggatctgtggggtagaaatggaggcacagagaagttaagaaacctcctgagattgcacagctagtaagtggcagagccaggatctggactgaggcacctgttcagaatccacacctttccccactagctgctccgcctctcaagcagccgggactgagcgcctggcagccaggagtgggctgggttccctgttacagctgtcctccgagagactgcacctacccccttttccaggcacggtcccacaacaattcaatggcagggtcaagaccccagagcctgtctcctagtgcgcttccatactggagagtctgagcatttccttcctttaagggtacagctccgcactgtttcttcaggaatatttatacaaatggaccttggtgtacaaggcatgtttagtgtattgacttaggacaatgaggtgtagacagtggcgctgagaagagcggccagtgctgacagagcttggcacaggcgcagagcactgtctgtgtccctcctctctttgccatcttgggagctgcgctgtggccccgcagcacaggcggctgtgtgaacctgttctctcttggctctcctcactctctcaccaactagaggccctcagtaaggagatgaccactcagggtgaaggcccctgtggctaggttgacagtcaacctgtgggggttgagggtgggccagtctccacacctgtgagcctgggagaggggaagcccagggcaatagccaacagagagcctgagtttgaaccctgactctgcctcctgccgggcgtgtcat

SEQ ID NO: 52217 - DNA, 1049 bp, Homo sapiens
ccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtct

SEQ ID NO: 52218 - DNA, 1021 bp, Homo sapiens
gccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagagccaaggctacagtgagccatgatcatgctactgcactccagcctgggtgacaatgagaccatggctcaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggcaggagggagaaacagaaggtgagcagggaggctatttagatgtgtcaaacccgggtgatcattaataatttgggcatatatatgctcccaaacttactctgcccccttccttcccttttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagg

SEQ ID NO: 52219 - DNA, 1810 bp, Homo sapiens
gagccgagatcgtgccactgcactccagcctgccgacagagcgagactccatctcaaataaataaattaattaattaaacagattaactcatattattcataaaacaataattagcatttgcattttaactcccaagacttcagtactgaaacaacattttatacaagccttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggc

SEQ ID NO: 52220 - DNA, 1035 bp, Homo sapiens
attaacattttcccctgattcacaatgaaacaacggcattctgacgaagatgatccatacaccgaggggagtttaaaagacaaataagtattcagcgaattgtaggacaaggttcataaatcttttaaaactttttaaatagtgagtttctgtaacatggacttacagctccagctaggaagcaactattgccccatcttttgttcctttatattgtcaccccaattataaataatttgtttcttttagtacaggaagatataaatgcaaatgtgcaaaaaaaggaagaaggaaagatggaccaagttcacctgtttggtacgtacagggtccacagctctgcagaaaggggagaaacctggtagacagagggcctgacgcaccatagcattgagcacattttccactgcttaattatgtgtgagattttcccttttaaaataaatctatggtctgtgaaatagtctgtataaaaatatgaagccttgaataggccagtcatagcagttccgtcttgaatagaactcaattttacaagcacggagtgagagtatcattccactgcaaactcttttatttccacaacatattagatctcattctgctttagtagagttacctcttaagtacgactattagtcatttcattaatatgaaaatctgggaaggcccacataaaataccaacataattgctggctaccaagataaaattatttaggcagattccagccccaatggttcaatgataacaaaactacaaaacatgggacatcaaattcattaataaaattattaagtcacctcttccatcgaatgatgagatttttcttattcactgtttcccatcagggaaaaaagaatcctcccacctcatgcctttttttttttctgatgccaggaattagtattcattgcctctttaagaggccaatgcaaaaaaaggtagaaaaagccctagcccaggagttgggattgccagttgtagtccctgggttgccttgctgggggtgcctaagtcagtgccataacctca

SEQ ID NO: 52221 - DNA, 1101 bp, Homo sapiens
ctggggctgagtcagcgtctctacccacttaaataacagcgtaaagatctttcactaaattcgttatgtggtctgtctggatgtaaacctatatatttccttttgaaacagaatcatatcctgcagactcttggcactcctgcatagctttgaccgaatgttcactctcatcgtaatggaagatttctatctatgcagataatacatgtttttaaatactgttttctgtttagtcctcaatcttcctaactcaaattggggactgaggagagagaaaggtggttacccctgttaccgtgccatattcttcttgctgcttttcaaccccacgtgattgttgattgacggttctgctataatgtgcgtgcccttcaagtttcagaaaactttcccaatcatttcacttcaatcttaattgaacccaagagtcaaagttattattttctccgaacgtgtttgtgatcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaatttttttttggaagcttcgtgattacctgtaacaagttctgtttttaaaacgaatacaaataaagttagtaactatttttaaatcagtccattgagttgagtttttttgtgtgtagtattttcaatacgcatcacttacatttagctaataagacagagaagtgcaatattgtgtttgttcctttcacaagagtcctgttgaacattaatgccgtgcagtgccagagttcaaggtggtgagtcactgctcactctgtaaataaccactgcactttcagctcttccccaagaaaccttttaccctggtttcccctttggttaaaaatgatttattccgggtaaagacttactttttgtctcggttaaaaaaaaaaaatctccaaaatgtggaactataaatgacagtaga

SEQ ID NO: 52222 - DNA, 1006 bp, Homo sapiens
acatataaaatttattttttgtatgatcaaattatattcttttatttccccttatacgtctccagaaagcagagtcagggtacatgcttccagtatttgtcatctcaaatacttatgtggccagctcatacaacctagaagagagatctctgagagaagaggtctgaacattcctctattatctgtaaattacaaacaaatgtttaccacagtgctcaagaccattatcattgtcattatcattactacgtttaaaaaatatttctccaagtacaaaaatagtcactttgaaattccttcaacagaacagactgcaaaaaggatccccaagggttagagcatttactaaaggctgagggatactgccaggcacacgacggacacccatatatcacctcccatttattctgatgtcactgaagggaccgtccaggcagttccaaagcccagggcatccgtacctgttgtacatcttcagcaggatcagaaccacggtgaagatgatgatgacaaccaccacaacggcagcaacaatggctccagaacctacagaaaggagagaagcagagaccgtgaatgtgcaaactgaacgcagaccaggagggcgccctgctgtggcacctgacatcctcactaggtcaagggaggcaggagagaaggcaacatcctgggacactcccagttgaccccaggacagtcacatctggagtggctgtgcacccctgccccgagctgcgcttgaaggaccctgtccttagcacatcatctgccaaaactctgccttaggcaaagtcctggttcttatcagctccagcatgcctcaaacttctgggaaacaaacaaacaacataccctcccctccttttgataatgcaaaagtagcatgtgatttttgtagaaaataattttgaaaatataaatatgtgcaaaaaagagggggtcgttgaagaactcactggcccaacaactgctgatcgtctgcatatctacattcaccaatgtgatc

SEQ ID NO: 52223 - DNA, 3207 bp, Homo sapiens
gtggcacagccatataagaattagcagattgtggctgggcgaggtggctcacgcctgtaatcccagcactttgggaggccgaggcgggcaaatcacaatgtcaggagattgagaccatcctggctaacacggtgaaaccctgtctctactaaaaatacaaaaaattagccgggcgtggtggcgggtgcctgtaatcccagctaattgggaggctgaggcaggagaatggcacgaacctgggaggcggagcttgcagtgagctgagcaccactgcactccagcctgggcaagagtgcaagactctgtctcaaaaaaaaaaaaaaaaaattagcagattctactatgccaaacaaaaaaactaagctaaaaggaactttggtagacagaactctaacttgagcatttttttttaggattgtgaagttgtacttaattgtttctatgtttcatcaggtggacatgagcaaagtaaatttggaggttataaagccttggataacaaaaagagtaacggaaatccttgggtttgaagatgatgttgtgattgagtttatattcaaccagctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaaggcctgaaccaaaatggaagttattccttgcgtctgaagtatagcaccatcaccttattaggtcacagcagagtgagtgtcccaatgtcgctctgacccaactcccttgatgatgcagtgtgtgtttggaggtgagttgtgtaaagtggccaaacatcaacaacaacaacaaaaaacacaaacaggaaagagcaattgggtaaagctgtacactgctcttttaaaatactattatgagatggacatttatgtgaagcatgaggggcaattctgatttgattggatattgtttttaaaggaactaaggtctttgtagctgcatgtcagctagtcatcagttacattttagagacaggatttttgtttatacttaaacttcagacaaattggcagcatataattgttcctttatacatgagataatatgatgatataactgatgtttaagaacattcttattgtaagacagtttctgttttgccacagcaacccaaaggacagttaagatatgtaccatatgacctttttgcatatataccaatgtgaatttacttttacattaatcatttcccccaaagagttcaccctatgttttgacagaacagttggcatttcaactgataaggtatttctagttttaaaataatttggtgtttgtattttgttttgaatatttttaaagactaattttaagaatgcactttctataaagtatatgcatcttagaaaaccaggaacaggggagaaagttttttaaatgatgattgaagatagattttattggagaaatgctttactgatgtgtattttagtgcattttaaaaacctaagtatctggtagtattccccttgtagtgagcatgagattaaagtttagaactttttaagacaattctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagaaactgaagacacctggaatctgtacttgctttgtgctattgagctgtgcttgttatacagaccttgttgcttgaccaacggatttagcatttaaaaacccaattatttttgagaaatcttgacctcttagcactttgtggacagttgagaatttgaggcattgttataatagattttccttatataaaactcaggcctttagcttagccctcagaagttacagactgcatgcataacttgttagttttcataactggacaatagatattttatgcaaagctatctgtagtgttagggagcagtttatgtactttttccgtttctcattgggggaaaatttccaggcaagcaaatacttttcttgttagtaaatactagaatttgtggatgtttcatgatggtttttaaagttaataaatgtaaggcccactaacagccacagagtctaaaaatacttacgaaatccacaaaggattaacaggctgctctgatgcttttggtagagtgagagagaatttggtaatctgttagagattatattgctgagaagctactagggaagactatttgtaaaatagtaaggactatatatatgtctaagcccctatggtagacttaaaaaatactaatttaaatgagttttaggttggttgatttgttggttggttggttttgaagtaacctgtttttcttcctgtcgtgtctttttgcagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacaggtaataaccttttcttttctgtaatgtcgatttgagagtattggccaggctgccgagacaccttaggtagtatatgactcagctaggatcttcatgtagttttgctttgctgtactgtatttaaacattcagttttggttcactgctcctccctccaaccaaacattgagtttagaatgtcattttcccagtctagtgatttgctagatttttacaaattcttaatatgtgagtgcatgtagcttaaaagaaatttgaatttaacactgaaaggtaagcataaggatttttggtttgttgtttttttgagacacagtttcagtctgtcacccaggctagagtgcagtggtgtggtctctgctcactgcagctttcacctcctgagttcaag

SEQ ID NO: 52224 - DNA, 2143 bp, Homo sapiens
ccacatccaactcatttttgtatttttagtacagacgggattttgccatgttggccagacttgtctcgaactcctgacctcaagtgatctgcccgcccttggcgggattatagacgtgagccaccgtgcccagccagcataaactcttaatatgggcaatacagatgaactcccagaaagaataaggtcaatgtgaaagtgattttcttttttattttattttttatttttatttttatttttttgaagtaagcttgaaaacatctctttagttcaggtcttagagattaactttcagtgaatatttatttgtaaatgagtggcgataataccagtcttaatgcgtatctgtagtgtaggtgaagaaagaacaggtctggttcaaaagaagaggccgatgaaatgataatagcattggtgtttaacacacgtagaaagtagtcttcagtttgttctcaaatgttcaactatgtgtattttgaaaacctggtctttgcagattgaacaagaaaaactggcatctatgaaaaagcaagatgaagacaaagataaaagagataaggaagaaaaagaaagcagcagagaaaaaagggagcggtctcgtagcccaagaaggtatcatacaatagatgcataactgatgttttacaggtactttaggtcttaagaaacttccttagttaaaaaggaatctaacagcgctattcaaggaatttgttccatcatgcagttttcatggtgacctgtgccttgcctctggactaaagaaatctgtcatattttgtttgagacagataatttagccatgagtgtctcgcagatgttcataaattatccaactctaaattcctaaatcaaaactttaaactttttcttccatattgctttagttcataacagttaatttgggtttttaaaaatgtactctgactcactttttctttccatttcctttcttctaaaaagaaatctgtactcgaaatctgtactcattagccgttcatgtaatacttacctaattccctgttctgcttttcttagatggttgtactgaacccaaacttcagatcatttatttgttttcttcttccagtgagactattgttaggttcacatttttaaatccacggctcagcttctatatttgtggtgaaaggtgagaactccattaggctttttatttttagggttctgcttatttctttcataaatgtctgctggaattagtaaagagaagaggtaatttctttgtccctttcatttatatatttgatactaaaatctccttatggaagtaatatttatagagctaagcacaaattgtcatggtggtaactacttgactattgatgaagtatgtctgccattttccttctgtgtgaataagagaaaaacccttcgagttaggcaggctactgttaagaaagagggcttctcctctcgcaaaaaagctatcttctggatgtttgatgtatatttctcttttctgaagaacatgttgctttaatggtattagtcatttttctggcatactgaggctcttcctgatgaactccattgtaatctgtccgcatctaaatgttttatgtttgggagtttgatttgttgtcaaggattatcattgtttgctttaaagcatcctctttgcctctgaaaagttggtcttttgatctctgggaatgattaagaacctaagtctagagtcccaagttagtgcttttctcccttataactgatatactcgagaatgttatctttcatttgcttgtctttctcttccctgtcaagtagattaggttagcatgtcttatttccatagggaaacatctcagatataaacagtagtgtaactaaagattaatcctcacttctccctttgactcctctcttccaatccatgttatttaaaaacctgaaaaaaattactttcatcctagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactaggc

SEQ ID NO: 52225 - DNA, 1058 bp, Homo sapiens
ggtgaaactccatctgtactaaaaatatatatatatatatatatatatatatatatatgtacacacacacacacaaattagccgggcatggttggcacatgcctatagtcccagctactcaggaggatcacttgagcctgggaggttgaagctgcagtgagccaaaatcatgccagtacactccagcctgagtgacaagagtgagaccctgtctcagaagaagaaaagaaaatgtacatggttggaattattagttgctctctgggtttcagtgataggtacatacatacttatgtgtcttttggagatagagacaagtctgtgaattttgaaaagttttagaaatactttattacatcattgtgtaatgatttagaaggctgagtacaagaaggcaaaaaaaaaaaaaaaagcttttgtttccacagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaaggtgagttgtggctttaagatcaacaaagatcttaggttttatatactactctactgggtacaattagataaataatttcaaagtggtagaagatgtttagtacaaatattttttgaatgtacacagagaatttgaggacacttttctgtgtaccataaaaatctacataaatggaaaattttgatctttgaaatttattttttagatgtggccattgagaaaactaagccaagaaattcctcactcctggtttattcaggacctaattctctttgttatggcagatcgtattcacctagaaggcggccaagcccaagaaggcggccatctcctcgaagaagaactccgccaagaagaatgcctcctccaccaaggcatagaaggagtagatctccagtaagacggtaagattttttaaatttggaagtgtcaagt

SEQ ID NO: 52226 - DNA, 1030 bp, Homo sapiens
ctagacttcaccaagaaatcatactaagtaagagaattggccaccttctctttggcttttaactggcttctgaaaagtagctgattatagggccagtaagctccttttaccagtattaaagtaattcatttgctgttatactttgagaaaagtatttttatgaattttttataaaattctcagaaaattctcattatagaagtaatgaagcttataagtaattcagacagaaatagcataacttggaagttttccataatccgtgggggaatatatctatattccatagatataattgctattactagtttagtgtctggttatttttcaaaaccccaactgtaccagtgttcttttttttacatcattctaaaatgagcataagataaaatatttgaatcttggatatatcactttaaacaaaaattagtggctaagtctacccaaagtagagtcctagtgcactggtagcagtttttgtgccttcttgcaatacgtttcacctggcttgggaagaaatgccgatgattaagcttccagttattttggacagaattttttgtttgagtcttttaaagttcttttcagggaaccaaatcaatttggaaataaagaggggaaaaatcaagtaagctctgtaaagttactttgtttctgcagtcaggtttttcagagtcccatattttgaaaattttctttggggaggggttgttaagatatattgaactattactactgttgcaaagaattgatgtgttgtgctcatagaggaaattagtgaggtaaatggtcagtcaattttcaggcatcacacttttctaattcccttttaggagaaaagtaatgctggtgcttcctagtacaagattagtggaaacagctatttcttatactggagttttgcaaacagcatgtttaaattgtgcttactcagccatttagcagtcaatattttacagattgtttaagattccctttcagccagtttttatctcacacttaaggtagggtttctttttttcaggttctc

SEQ ID NO: 52227 - DNA, 1029 bp, Homo sapiens
atagcattcaacctgacaagttttataactggagagagaacacagacagaagtatttatcagattaagttgtttatattaatctcagaactagctgtttcctggcctaggttatggttttttcccccattcttttggactcatttatgtgcttagctacataaactcaaaagtcggattaaaatagctgtatttttgtgtaaactgttcatacctgtaaggccgttctttataagtgtgcaattagtgaatatgaatactttattccacagaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaaggtaaaaatcaaacacatatgaaacatggtctctctttctttggctacaaagcgtagtcagttattgccccctgctcactctcaaagtatgaaatagctagataatatttgtatctaatactctctgtaggtttacttataagcctacctctttcctgctttaaaatcttggggcttttttatgtgtaaaagggttttgtttttagcaatgccctgtggcattgcgcaggtggagaaatcttttaccagccgtgggctgtttgagttggggtaacatatcaaagtttgcgttggcatgataagggatcattttattactatgagaccagttaacttttttttctcctgaagatttttggtttgatatcttaaataagaggacttcatattctcttttagttctttcttggtcgcattgcgctcccaagcaaaggacatggtgtcctcttaaaagctgatttgtttttttaatttaggttctagg

SEQ ID NO: 52228 - DNA, 1106 bp, Homo sapiens
gcacagatgctaatttcttgtgttttggcatatactttttgcaaacaagacaagagtggatatgtacataggaaagaagtaagccatggtgaaaataagtatttctgtgggttttgggacagggcttccgtgttcaaacaacctacccaaagagaggcactacaggcagtgtagtcagtctcccctgtgaccactggagctgaatattggtttgacctacttggaaataacctctccccaccaccccgctaaatagagccagcatctcactctgtcactcgggctggagtgcagtggcccagtcatagctcactgcagcctccaacccctgggattacaagtgtgagccaccacacccggcccagacaaccttttatattaaactgatcccagccctctgtgatgaaatttcagagctagaaaagaccttaacagttgtcatcaagaaacagattttcaggttagttgacttggtcaaggtcaaccaactaggaataaaacttgagttgtcattcccagttaaatagtgaatacttttcacaactttcctaccccagaactcttctttgattgctaaaggtgagaaatggagggcagggttgaaattctttagcttctctatctggtagtatgatttcagaaattactttgcagtttctgctgcttagaacagtaacatcattgaaatgtaatagatattacagttaatattttccctagtggccactaatcagggctttagggctctgctcttgatagtgggcaaatggagtgggagggaggcaggaaaagtgttttggggaacttacaggttaattatttggaatacagtatacagtcatctgaagggatcttaggggaaacatttgtaattactgacatttcataaattggcattatcttagtacataaaatagtgcttgaaatcagtggcacagtcagcgaagtatgttaacatgatcaatactggtggtgacggtgtggtaattttgatttatttagattagcttggccacatacattgtgctatctggacacttaaatggttattttactattgttggtcacagagtaacttatctttataagtgatcttttgggcaggt

SEQ ID NO: 52229 - DNA, 1044 bp, Homo sapiens
tgggcacagtggcttgtgcctgtaatcccaacactttgggaggctcaggcaggaggattgcttgaggtcaggagttcaagactagcctgactaatatagtgagaccccatctttatttaaaaataataataaatttttaaaaattaaaagaaaagcatcttgtatagacctttttttgtacgtaagcttttttccactcttattcttttttagtgacaaaacataaaggtactgagaaaagagaatccccttcaccagcaccgaagcctagaaaagtagagttatctgaatcgggtaagtttgttgtttttttttgtgattttggtttgtttgtttttgtttttcttaaagctgattttgattttttgcacatttggtcatccccttctgcttgaagattaagtatagggtaagagctaagactctgaaggcagacagacttgggtggaatcccccattccagaatttaactgtttctgttttaattaacttatctgagcctttcttctttcatctccgaaatagggacagtagaggtttttgacagttaactgtatctgcttgtaaaatgcttggcaccagcctgacctgtagtaaatgcctaaataaattttattatatttggtgaagatagtctaaatcagcctgtgaattggcattttaaactctttttaaaaaaaatatatagtagttgtatttttgatccaaccaaatgaaggtttgagagactattttcctattcaaattgcaaattttctatatgcttaactaaagaaacactttctaaatgcatccatctttcagaagaagataaaggtggcaaaatggctgcagcagattctgtgcagcagagacgccaatacagacgacaaaaccagcagtcttcatctggtatggatggtgatgaaagttttttttctacctgtatttcctattaaaaaatacttggtatataaacatctgtgtgtgcagcatgagtacttacttgcctacatagaaatctgtctgaggaggcaggattgtttctttttttggttttaagtc

SEQ ID NO: 52230 - DNA, 1826 bp, Homo sapiens
atttgcattttttattgtaagaatataccaggctgggtatggtggcttaacctgtaaccccaacactttgggaggctgaggtagatggatcacttgaggtcaggagttcgagaccagcctggccaacatggcaaaaccttgtctcaactaaaaatacaaagattagttaggcatgatggtgcagacctgtaatcccagctactcaggaggcacaagcggtctttctgccttggcctcccaaatgctggggttaaaggggtgagccaccgtgcccagctcaaacttcttagagtatgccatcttgattggattacactgtggaaattatttctatgtcttatttaaataatatgcttggctttgaaatcattgatcatatattgataatgattctgttcagaactgatggcctgtatacatgcttgcttaccctagtgaacactccatccacctagatttcagaaaacttggacagattcaagcacaaacctaatgtaatatttttttaattttgtaattatagactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggtaacatctttgcttcagtgatgttcactgatgttctgtaattgtgatgaaatttgataacttgggattatttgagaatttggttaactccttcaagtatttggatgtggttggatttttgtttgctttttagggtttctgttttgttttgtttttgctttattggtggttattaataattaatttagaattggtaaattttaaaccaccatgtcatatatgtgtgcatgattagaaaaataaaccaaactattatagcagtaactcctgaacatctttgaatatttaaaaatgtctccattaatggtacttaatccacccaagtaaataatttagtgaatggaattcttgacatttgtttttctccactgctctcaggatgcagatgggaaagcgatggcaatcgccagtgactaaaaggttggttagacactactttgtaaattagggttacatgtcaaaaattgtagtgacttaatttcctatttaggtgacctcatctcattcttaaatatatggtggctgtggctgtgaatgtgcagatcctaagttgttttggtttgagtattttttttaacacattagattaatgatagggagaattatacatgagctatttggtttagacccttatttgaacttagatttttaatatctggttgtgctcttttgtgataatttgcatcaacttacatcaagcagcacgcagatttttaacagtatctggatacttttccagagataggattattgctccttagatttggggggagggactttgtatttgtggtgacattagggagggcaaggaaaaactagggagaaactttagaaatattaaaagtgagaggatcacgaggtcaggagatcaagaccatcctggccaacatggtgaaaccccatttctactaaaaatacaaaaattagctgggagtgttggcgcgtgcctgtaatcccagctactcggaaggctgaggcaggagaatcgcttgaacccaggaggcggaggttgcaatgagctgagatcacgccactgtactccagcctggcaacagagctaaattccctctcaaaaataataataataataataataataataataataataaataaaagcgaatggaaggctttggccctgttcagtctttccagtac

SEQ ID NO: 52231 - DNA, 1044 bp, Homo sapiens
cagtgtccaaatgctcattcagagaggataccacataggagacctctttaaagtgcagacttcctaaggtgaccataatagagttttgctaatacagttacttggttattatataataactgatgttcagttaatacagtgcaagattctgttttcaaaaaacgttaattttgtatagatgttaaaagattgacaaattcacatcttctgaaaattgcaaatttttgttaatcaaaatgtctttttttcttttttgtacttagtcctgcagacagtgtcctgtgttgcagtcagctgagataaacaagttttattgatatttaagtgagaatataaagatagcatgttcacttataaatatattccctttgcctagtgctaactacagtatagccaaacctactgattacttttcatcctgtttctgtattttgttgagcctttcagcttaattatgtatctttttcctaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaagtaaaaatattttatgcttttccattaggaatacttacatagctgtttatatttggaagcttccccccacccccatataaaaggaataagttatgaatatgagctttt

SEQ ID NO: 52232 - DNA, 2735 bp, Homo sapiens
tgtgtgtcatgaggaagaaccagtcatccccactctaaagataggagagctcagatggtagctagagacatggcattcatacaggcatgtgtttagactaatggctggtaccatttattaaaagtctgctacatgttaggcaagtattatgggtgatttacagatattctcatttaattttcacaagagctttatcaggtagggattattacacttattttaggtaaaaaggtctcagaaagagttcaacaatttgtctaaggtcaaatagttcaggagctggaattgagctcatcctggagatagcccctgacttttgaatacttttcttggtgataattggccttgggccttccccactcacaccctccaaagcctttcggaaatcttgagatttgtccattggggatttgaggaaataaaatgttcagttggacagaatattaatcagattgattataaatgctgggtgttgtttttttttcttcctagaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggtatttatgaactctgtatatggctgtcttgcagtttacgtacagatagcaaagtcattttgttttgagaagtagcaaaattgttttttctactaattagccagttactctgagataaaagtcacgtaccatacagttcacccatttaaagtttgtggttccctgggttttagtatatcagttgtgcagcgatccccacactttttttttttataaaggtgacttatttatttaaaatattaactatccacagtggccattatatttgcatacagttcagtactcaaaagatttgtgaggttggtttttttttttgtttgttttttaattttattattattatactttaagttttagggtacatgtgcacaatgtgcaggtttgttacatatgtatacatgtgccatgttggtgtgctgcacccattaactcgtcgtttagcattaggtatatccctccctgctccccctaccccacaacagtccccggtgtgtgatgttcccctcccacactttgattctgctctttactcggcatttcccaccagggtctcaagacttaaccgtgtaaattctgttttttttaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaattttgccactcttacttagtagtgcttatgtaaaccttttggtgtgttgggagttgggcaggggaaagaaaaggtgatgaaattaaggttttaccatctttatttcaataattactgtggtgagtgctataaagggaatcagcatgtgattggaacatttagaatactggtgggagaagtccaccaggcaaagagaacaggattgcagtcagacaaacagtgtctgtgtcttccctgaggcagaaggagcctgctggcatgttaggaagtgaacaaaggctaaggaatgactggaacaccctctgtcaggggcggggtgggggggggggggttgtgtgtgtgtatgtgcgtgtgtgtgtgc

SEQ ID NO: 52233 - DNA, 1790 bp, Homo sapiens
gttactttgagtggcagatatagtactttgagatgcgtagaatgtaggaaggaacctgaaatacaagaaaggaaggaggccgggcgcggtggctcacgcctgtaatcccagcactttgggaggctgaggtgggcagatcacgaggtcaggagatcgagaccatcctggccaacatggtgaaaccccatctctactaaaaatacaaaaattagctgggcgtggtggcgcgtgcctgtagtcccagctactcgggaggctgaggcaggagaattgcttgaacccgggaggcagaggttgtggtgtgcggagattgcgccactgtactccagcctgggcaacagagtaagactccatctcaaaaaaaaaaaaaaaaaagaaagaaaggaagggtggtgggtggaaaacagcatggagaagggaaacaagtgggccagagatgagttaaaaaaaatttttactgagtgaggaataggaaggaatttccataaactcaaaaaaagtgcatccatgaataatctgtaaaacatgatacttaacggtgaaactttagaacagtattaaacttagaataagctactatcgggccgggtgaggtgactcacacctgtagcattttgggatgccgagatggggagatcacttgaggccaggagttcgagaccagcctggccaacatggtgaaaccctgtctctactaaaaatagaaaaattagccaggcatggtggtgggcccagctattcgggaggctgaggcatgagaatcgcttgaaccggggaggcaaaggttggagtgagccaagatcaagtcactgcactccagcctgggcgacagagtgagacttcgtctcaaaaaaaaaaaaaaaaagataaagctattatcagttatggctctattcagtattctattattctattggaggagctaatcaaagaagacaagaaaaattaagtatctgaattaggaagagatcagtgattaatgccctgcttactattaatttcatctttcagttagaatagcagaggggcgtgtgcagttttccaaacttgagtcacttgcatcccctttctgtttttcatatttgtgttgagaaccactgaaaatcatccttcctaccactagttgtaagcctttctcattgggcttggtggcagagaatcagggttcaagtcacagttctttactccttggttgggtgaccctaggcagtttgttttcactctttaagccttgtttgtctcatttgtgaaataagaaatgttttctgctacccagtgattcaacataggcaaactttgcactgatacagatcaggttttttgtttttttttttttttttttttttaatgagatggtgtctcgctctgtcaccctggctgctggagtgcagtggcgcgatctcggctcactgcaccctctgcctcccaggttgaagtgattcttctgcctttgccttccgaggagcgcatgcaccactacgcctggctgatttttgtattttagaagagactgggttttaccatgttggccaggctggtctcaaactcctgaccttaagtgatctgcctgccttggcctcccaaagtgctgggattacaggcttgagcctctgtgcttggcccctagaccagtttgtttgaaaggggaaaaaaggacaggtaaaatgtggtaaagggcattcttgatctcttctcaaaacctacgtgtgggaaatgcaaatgggggaaatacccttgtaaatatagttattttgaaagcagtggaccaggtgtggtggcacactcctgta

SEQ ID NO: 52234 - DNA, 2156 bp, Homo sapiens
ccttggcctcccgaagtgctgggattacaggcgtgagccaccgcgcccagcctaatagtatattatttttaaatgtgggctctattagtaggatcagggagttctgtaaatccttgaaattacagtaaaaaattctaatgtgaggctttttttctggaaattcctaaaccaaggctaagaaccactgttctaaaagaagtaaatagtggaattcttagagtcaagaatactttatataagcaaggtataaaagaagggcttgggctagatgatcacaaaggtctcttctagttattattaactatgacttaaagaatgtaccggcatgaactaagtgctaatactgagttaagtactatggaagatataagaaattattaaacagttaatttctttaggtttacaaattttattggaaagaaaacaatacaagatggtccatgcttaaagagtcaagtggggctcacattaagtagggctaggagacatggggaaagatggaaggaggcttaaacttgaccttgaaaaaggaggtgaataggtgggttcggaatagccaagaatgggaatgtgagttttgacattatgtggaaactccttatgcaggaaacaattggtagattgatacctaagaaggaaccaggagtgattcagatctatagtgccagggagacaagttatttaaaagttgaggatgagacttttaaaacctaacttgggtttttgttaatgtatacattttcctaacttttttcattctccccacactttcctgtgtttttggattgctgtctgtttaataacttttcagtggcacttgggaaggtgcaaatggattgtacagatggactgttttgacagtttaaagtgggaattctttatattgtttcaaggacaggcttcaaacttccccccgtctttgttttttctaacagaaaaaaatgaaataaattttctataggaaatgatgctgaaaactgttctggtaattaacaaaagctaactcaatattcagacaatattaccttgaatctaattgatttgccattcatttgaggtttccggggggaaaattcaggagacagaaatgaatgtaaagtatgaagttaatgaaaacctattattttaactttttgcctgagctgttcctgaagacctaataatgctacttttggcaaaggccaaatttgatgattttggtttaatgtaaaaacctgtgagaaaggagcctagaatggggaagaggcaggaggctttgagcctaggagactgagcacacgaaaagcttaacagagtatgaataatgataggaaagaggcaattgggagaagaacctggctgtcaggaaatgtcacagttggtttgggaagatgcctgcagaggtgcctagaagccagtaagtaaggatggtgagccatccttttccgcttcctgtttcgttagagctgtggagcctccgtgttctgatgtcccctgagtagggaattgtgagtccataaaaggaaaatgtgttaggcaggatgggaagtgtgattaaggcatgagttaagattttggtcaagtagaggagtaagctaggatgggtttgcctgttttagacgcttgcatagagaatggaaagggactttctgaaggaaaatgacattaggtcatggttacctattgtccaaggatgatttaagacatgtaaatgtaatttagggcatcagctagtgaattttctcatggcttttaattatattgtctatttcgagacttgcctcttatctctcagtggtcagttccagatattggtataagaaataagaaataacaatgataggcccactgccatggctcacacctgtaatcccagcactttgggagaccgaggtgggtggatcgcctgaggtcaggagttcaaggccagcctggccaacatggtgaatccctgtctctactaaaaatacaaaaattagctgggcgtggtggtgggcgcctgtaatcccagctactcgggaggctgaggcaggagaattgctttaacctgggaggcggaggttgcagtgagctgagattgtgttactacactccagcctggacgacagagtaagactccgtctcaaaaaaaaaaaaaaaattataggctgggcaaaatagtgagtcctcatctctat

SEQ ID NO: 52235 - DNA, 1076 bp, Homo sapiens
aggctggagtgcagtgacgcgatctctgctcactgcaagctccgcctcctgggttcacgccattctcctgcctcagcctcccgagtagctgggactacaggcgcccgccaccacgcctggctgattttttctatttctagtagagacggggtttcaccgtgttagctaggatggtcttgatctcctgacctcgtgatccgcccgcctcggcctcccaaagtgctgggattacaggcgtgagccaccgcgccctgctaacattagtgttttgaaaaagtaactattagaaccagggccaggaacggacctgagttcaacatgcatatattttgtacctttaagcatcctttcataggtttctttgcttttcttgaagttgaaatacaagctgtttcttgaagctgaaataaactaggagtatgacaggttttctttctctttttttggtaacaaaattattacttccaacttacatgtgaataactcattcttatgaaaagatttagttctcattataatatagttgtaaaaatgtcaatcacttgtaataacttaagtattgaattttaccactgtgcagcatagctatttatttgtgtatgtgggagaagaaaaaagagaatctgaacaaatattgaagaatacaaaaccaaacaatcagatgaaagctgaggtaattaagaactttttttttttgaaatggagtctcactctgtcgcctaggctggagtgcagtggcgtgatcttggctcactgcaacctccgcctcccgggttcaagcgattcttctgcctcagcctcctgagtagctgggattacagacacccaccaccatgcctggctagttttttttttaatgtttttttttttgagacggagtttcgctcttgttgccgaggctggagtgcaatggcacgatctctgctcaccgcaacctccgcctcctaggttcaagcaattctcctgcctcagcctcccaagtagctgagattacaggcatgcaccaccacacccagctaattttgtatttttagtagagatggggtttctccatgttggtcaagctagtctgtacc

SEQ ID NO: 52236 - DNA, 1266 bp, Homo sapiens
gtgatctgcccgccttggccttccaaaagttctgggattacaggcatgagccatcatgcccggcccttagtctttttcttaataagtttgcatgaattattatttatttatttttatttttatttttttatttttgcttgcatgaattattgagaatttatatataatattttaatgctgttcatgacagaagacttgaatgagtgaaggatgagcactgatctgatatgtaacatgtattgaattaagtgagttggtttaaagaaaatttatttaggttttataaaagaaactcagattttgcctatatcttctttagaacatttgatctttggtggaagaaagcaggtcatgaaagtatgacatgaaatgtgccatcacctagaatggatattgattaaatggtttgaaggtagatcctcctcttgtgctctttaggagaaatctattctaaaaatgaaagttatttttcagtattaatttcttccttcaatatctatgtaataggtaagatatgtccattttatagttcaagtataataagaaaccagtctttgcctaggaacagttgagcacagtataggggatcataatagaagcaaacatcaattgaatactttccatgcactaagtgctggagaggtaaaggagtaagaatgagccccttgtgttcaaggagctctattataaccaagtagacagtcagatggtgagtaaatgagccatggttgttggtggtaggttcttagcaccatctttttcctatacaatacgtgacttttttttttttgtctcatgcacttttttattctagctgaaatagaagcttaagaaatgatttaagtgggaaattaaatgagataattgatttagagatgagttaaatgtttgtgttgtattctaacagtttaagggttgctagtattactgactctattacactgcttattatcagttgtttaaagaaacttttgaccaggcatggtgactcacgcctgtactcccagcattttgagaggccaaggtgggtggatcgcttgagtccaggagttcaagaccagcctctgcaacgtggggaaaccccatcgttttgtgttttgcaaaaacacaaaaatctgggtgtggtggcacgtgcctgtattcccagttgcttgggggctgaggcaggaggatcacctgaaccttgggaggttgaggccacagtgagtagtaatccataatcgtgtcactgccctccagcctgggccacagagtgagaccgtgtct

SEQ ID NO: 52237 - DNA, 1236 bp, Homo sapiens
tgtgccaccacacccggctaattttgtatttttagtagagacggggtttctccatgttggtcagggtggtctcgaactcccaacctcaggtgatccacctgccttggcctcccgaagtgctgggattacaggtgtgagccaccacgtccggccaaggctcacacttataatcccagcactttgggaggcgaggcaggtggattgcatgaccagcctggacaacatggtgaaaccctgtctccacaaaaaatgcaaaaattagctgtgtattgaggcacacgcctatggtcccagctacttgggaggctgaggtgggaggattgcttgagcccaggaggcgaagtttgcagtgagccaagatagtgctactgtactccaccctgggcgacagagcaagaccctatctcaagggaaaaaaaaaaaaattcatactctggtatcttctggcatttcacagaagggcatctggattcctgccaaaattgattcttttgtcttttattaaaaataatctttcaagcaaatttgagattcaccactaaagccctaaatttgtttttatttactttgtgttttaactctctctcactgcaggtttgttgttgttgttgttgttggttttttggtaagtacagagactacaaatttaaaaaatctttcattaaacatgtctttactaagtgcctactaggaactgctctaagctctgggaagcaagaaaatgtaccctcaggtgtcagtaatgaatgagctataaggaaggcgtactatacacaattatcttagatgggataatattttccactagagttattgtaactcactgcctgggaggccttttcacttctaggaagatctggttttcctatatttagaatagatactgttcccattgactgttttctgttggatttcttaaatgcatgagatagaagaagtatatatggaaaagcatttcatatttaattgaaataatatatacatttatggagtgctttctatgtgccaggcactgtgttgactacatctatgaaatattaactcatttgattgttactcaataaaatgtttgctgaaggaatatatagaagcttttatttttttccgtgcacaggcttaatttcagaggaggttgggaggaaaagaagaactaaaagatcacatgattgggaaaaagcaaatgcctaacaagaagccagagaaataggtcgagagggtgatgcaaatgactgggct

SEQ ID NO: 52238 - DNA, 1133 bp, Homo sapiens
agagtgagactctgcctcaccaaaaaaaaaaaaaaaaagaaaaagaaagaaaactttagcatgtctgtaattggtagatataatctctatcatttatttaatgataattaaaaatagcggggcatggtggcacatgcctgtggtctcagctactagtggggctgaagcaggagattgaggctgtagtgagccactctgattgcaccactccactccagcctgggtggcagagtgagactctgtctcaaaacaaaagaaaacaaacaaaaaaacataatgtaagaatcatgaagtgactttaaaatctttattttataataatgttataagttttctgaagctacttaatttatcactatacagaataaacagatatataaaaaatgatcagtaagtttttgtttccctactaaagccagaataatggtcatgaggtaatagatagcattgggtgcttactatgggccaggcacagtgtgccagccgtttgcatgtgttagctaatttaatcctcatataaactttgaaataggtgctatcaatactgtttaacacatgagaattagagagatcattgtttgggtatggttgcagggccagtaagtagcagtactgtgatttgtactaacgtctttgggatttcagaacctgaatcaataactttgtttatgttatttttctctatttatttgaaacttgaatgctttcctaacagaatttcttatgttctgttttcagtcaccctgaaaaaaaaattctgagaatatttaaggatatttctaaaacatactaacaactagtgagcctagatggttcattagatgactttggttgctttcagttctcttggtaaaatttgaaaggcaactaaaatttccattacctcacctcgttgcattttgggggcctggttaattagtattttataaagcactttagagggtttatttataaacttgttaaggaacctgacttgaatgtcttttttttttttaaggcagagtttcactgttgcccaggatggagtgcagtggtgtcatcacaggtcactgccaccttgacctcctgggctcaagtgatcctcctcctttagctccctgagtagctgggacttgcagtgccaccatgcccag

SEQ ID NO: 52239 - DNA, 1036 bp, Homo sapiens
ttttaaatttaaaaaattattatgttcttctaaagactaagggactattttcttcatcttttatatctaccccctaccacaaacctttatatataggagataattcattaattcagtaagcatttattagtgttttttggcaaattggtgtgcatagtataggaatataagcatgtaagagagaatatattaaatattttctgttattgtgttctatattacctcatagtaaaataccagagttaaaagtagtattcagttattgaacttgagacatgtaattggggttttgtaactagctactcactatatagctattggtctaaacctaacagattggtttagagaactagaatattatgtaactggaaggccaggttcaagtcctatgtgtatcctaattgatctgctacctcatctgtcaagtgggtgtatttcttggaggtgatgttcagtccagtttgtattattttatatgccaaggtagccttaggcttggcttaagcttaggcttaggcagaaagttgagccctgagattccaacgtcagatccagagaattaaattctcataattagaagcaatctattagataacaaaaatagagccaatacaaattcttcatgataatggaggcagtttgccaaagaaagaaaaaatatttcaggagtgaattctttgacccgaaagaatatattttatttcccaggtgagctcctgaaagaaagtttaaggaaagattttgtttgttgtatctaaaataaagcagacacagaaccattcttcttcttcttttttttttaaagccagtcaaatttatagaattttccttcatcatatttgagtaacctgtgcattgaaatccgaagtaaaatatttcagtaagaaacatcctgctatgttatactcttcagatatttgaagttttaggccagcaaagaagatagacaagaattctgaatattaactttcacagctgaaatacagtgttgaatatataatttttgcggaaactaattttgtaatgtatatatata

SEQ ID NO: 52240 - DNA, 1044 bp, Homo sapiens
gaagatggagaactttgtgagacctattttttttttttttttaaagacggagtctcgcactgttgcacaggctggagtgcagtggcgcgatctcggctcaccactttaagggaatctcctgcctcaacttcccaagtagctgggattacaggtgcccgccaccacgcctaactaattttttgtatttttagtagagatggggtttcactatgttgaccaggctggtctcaaactcctgacctcgtgttccgcccgccttggcctcccaaagtgctgggattacaggcgtgagccactgcgccgggccttgtaggacctaatttttaaagactattgtacgctttatggtttttatttttaatgaaactattatgttaggtaattgatcataatttggtcatttactgaaagaaacagcaacagataacctttgaaaactactggaaggtgaatcatctctcccattcaacatttgaatgacttcaattcacagtgacttagactaaagcaagagaacatcaaatgtactgttataagctgaactactaactcagaggaggaaccactggcaagcccataaaactgaaactcacaaaaccatgatttattgggagatgtttatgtcacttttgagaaaatattaaacaggtgcttttttatttgtagtaaggtcatggagtatattttgagtttcattgtattctaaattgaaattttgtacttttagggtattctgaaattcttaagtgattcagattagactttggatgctataggtaatgcaaaggcagaaaccatttcttctcttattcatcaccagatctctggtgtttcgtataggtcctcacatggctggtgaatgaataaaaaaaaaaaagttttaattttaaaagattgatatctatctgctcttgaagataatatataaatgatggacaataaaagtgagctgtaatgtatttagaaactattaggactgaagtggaaactagattaataatttaaaaaacactttatttggaaataatttcatacttacagaca

SEQ ID NO: 52241 - DNA, 1565 bp, Homo sapiens
ctgaattaatagaattattagtgaatgtttttctaaacctgttatcagtatacactttactcctaaactgttatcaagatggtaaaaattatagactctatatttgggccaggcaaagtggctcactcttgtaatcccagcgctttgagaggccggggcaggtgatcacttgaggtcaggagttcaagaccaccctggccaacatggtgaaatcctgtctctactaaaaatacaaaaattagtcgggcatggtggtgagtgccttagtcccagctactcaggaggctgaggcaggagaattgcttgaatccgggaggtggaggcaaatcacgccactgcactctagcctgggcaacagagtgagactccatgtcaaaaaaaaaaaaaaaaaaacacaaaaacaaagacaaacgaattatggaatccatatttgaaatcttttcatgggtactattttttttgaagtattcctccacagattgacaataaaattgacattaaaagtagacagattaacaatatttaatccaaatcagtaaaattctttaactggttgaactgggacaaagacaaattcttagtgacaaggggtcttggtgtgtgtgttttgttgagtccatgattaatttgttcaattagtgacttgactatcagtcaaaccagaatatagcaaatctagtaaagaataattaatagtagtaaagcgttctgaaacaaataattctggttctctggtgttaacttttgtgaggttttttgttgttgttgttatatgtttatatagtgtccagtagtgtctttgatatgtgtgaattaattttatgccctgaaaatcagcaccttcaaaaaggaactcgatttttttttgttattgttctctttctggagaaaaaaggagctccatttaaaagataaggcctacatacctagtacttttttcttcgttgggcaagtcaacttgttacagatgggtcatcttcaagagccagctccggtgttctctagctatgctgcactcatttcataccaagcagctggaactgagtcaccagcccagcttcctccaattgttgcaattgtactgaactacattttaatagaaattaagccactcaagtctcttaaaatattagctcctataggattcctccttttcattcgtttcttttccttttggtttttgtttttatttccttttcttcatctagaaaaaaaatgggaaacaacagaataatttatttcatctgaaagactaccatgatacatgagggtaaaaataatacaccccaaaacactggagaatatttgcaccctgttgcaaggcatgagttctgtgcactttgctcttgatgtcacgtaagggaaatatttgaatgagttttaatcaagtgttgagtatttactgaaggcctttttggaagtaaaccaaagatgtcttgaaattttttgccattgcctattggctcagtttcatttatctcaaactgcaattcttacagtgttacatttctgtgaaacatctgtaaaatgagcctttgtgggtcaaacagaacacctgaggcctg

SEQ ID NO: 52242 - DNA, 1045 bp, Homo sapiens
ccaagtagctggaactacaggtgcgcaccaccatgcccagctaatttttatatttttagcagagatggggtttcaccatgctggccaagctggtctcaaactcctgacctcaggtgatccacccgcctcggcctcccaaagggctgggattacagacatgagccaccatgcccggacaatttatttattttctttttgagacagggtctctctgtcgcccaggctggagtgcagtggtgcgatcatggctcactccagcctcaacttcccaggctcaagtgatccttccacctcagcctccctggtagctggtactatagacacgcaccaccatgcctggctaattttttatgttttgtggagacaggatcttaccatgttgcccaggctgggtctcaaactcctgggctaagcagtgtcccacctcagcctcctgtagtgctacgactacagacgcaagccaccgtgcctggccaactttgagaatttaaagtattattgttgtttaagagtaaaaaatgatctgattttgaccaatattttgcccaacaggaagccagcagacctgcagaacttggctcccgggacccacccaccatttataactttcaacagtgaagtcaaaacggatgtaaataagattgaggaatttcttgaagaagtcttatgccctcccaagtgagtatcaaggaaaatacgtatgaaaatattgtcacttctttgaagcttgtgttatttgtcagtagagatctttctcgcagcattaatttggaatgactaggactctcttctatgtttcttataattaatgctacacagatataagaattggcttccagctaggccaatcagccatactaagaaaggtggggatttgtctaagctgtagaatatgtggtagaaacagatttgggatgtgtctgataggtcaggaaagactggttatttgtggactgtaggtctcaaactgagagagaagtttaaagaggagaaggggtggggaaagacacattccaactgaacccagtaagaatgtcttagcagg

SEQ ID NO: 52243 - DNA, 1009 bp, Homo sapiens
ttttaattttgtttgtgattaatttaaattcatattcaaataggtacatggcactagtggctactgtactggacaatgaagatagagaacatttccatcatcacagaaagttctcttggacagcactgctctagcaatctcattccaagactcccattggcctggcagaaatctctgaacaagtcaactgtttccccagcattctaatttatcagatggaggtggagtgcacatgccctgtggttgccaagaatattaatatgtgaacaaaaacatagtgcagagctttgtctcgtaaggaaaaaacagtttttaaaaataccatagaaaacaaatgatggtatttcttatagtaataactattaaaagacgtctagtaactgctagcatggtggtttgagagaacttatgctaattcatctttgaaggatctataatccatatcactttttctatttaggtacttaaagctttcaccaaaacacccagaatcaaatactgctggaatggacatctttgccaaattctctgcatatatcaagaattcaaggccagaggctaatgaaggtaaaaaacaaaaacttgaattaacattgcaacaaaaaaccccaaacaacaacaggctgttattatgacagtgattataaatgagtactttagagtccagccattcccataagtaataaaaactgtctttcagagttggtcagaaattggacaataaactggaataagtccctatgttgctatttttccatgtttctagctagtagcacagtatatagtaagtgtgtgataaaatgcttcttgaatgaagtttatttcatcttattttgagaagttactgtgaagggagctaggcaaagaattaatggtgcatcagaaacagtggattgtgtggttgtggtggtttagcatagattggttgagcttaatttaaactgtaactaaatgtttattgttgagtgcctgcagcctagagtcagtctgaggtttttttttttttttt

SEQ ID NO: 52244 - DNA, 1133 bp, Homo sapiens
ttctgctttgtattttataatatggattttcatttaaccatttccatgttgatagacatctagattgtctcaagttttttttttttcttcactataataaacaatgctgctggtgaatgtccttgagctagattccaaatagttcaaaaagtttgtgcattttaaattttgctctattttgctaaattgttctccaaaagtctataccagtttatattcccacaaacatgaaagtattcattaccctacacttaggaccctggtgtgtgttaatctttgtaattttgctgtgttctcttagacaagaaagggtgttttgactttcataattacttttaaactgattttgttgctctgttgcacttaaaaattttttgagagctttatgaaatagcttcttagggataccagcattactacatcggggtattggagaataatagtgctacttattagctataagacagggagctactttgtgatggcttgctactgccttctagtggttaattttgacattttctttatatttacatactcctttgtgatgattggtcttgaaaactgtattgtgtttattgaatgatgctgtttagtactttttgatatttctgtttgtgtttgttttattggccataccttatgttgatacatataattgtatcaaactaattcatcattctttgttttcattaatatacccttgttatgacattcttaactatgaaaaattactaacaccgtagtcaggtatagcaattcgacttcatcagaagtgctttgctaagtacaaaattatagagaaaacagtcattgtaatgttatgctagactcttaattttcttttgaaaaaaatttatttaaatgagacaaggtctcaccacattgcccaggctggtcttgacctcctggactcaagcaatccacccagcttggcctcccaaagtgctgagattacaggcgtgaaccactgtgtcttgcactgacgaatactatgttataaaccttgtaaatttaggatatttgatttttatatatataattcaggaaaaacattaatttagagcaggtctaaggttaaacatttgctcaaaaacttgtcaaaacactcaaatagcatttgagacaataat

SEQ ID NO: 52245 - DNA, 1324 bp, Homo sapiens
gccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagc

SEQ ID NO: 52246 - DNA, 1319 bp, Homo sapiens
catttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagca

SEQ ID NO: 52247 - DNA, 1033 bp, Homo sapiens
actgctgtttttcttttgccaccgacgcgcgtaccgtttcacgatgcaggaccgtggttacatgcgtaaaggaaaaaaagaaaaacgcattttgcaggcctcgtcgtgtttttcaaagagccacaggccgccacaacgaagaacgacgccgcgaggcctgcaagatcctgaaacttgttttgaggggagagcagagaggaaaggggttgttggccccaggctacttagggtccctaggagactcccttccgcctgtccccggtttggcacaggggccaccgaggctgggaccaaagccgcgcagggctgggagcagcaaaggccgccggccgggcgtggacgacgcgcaaaatcccgtgtggggtggaggctcttgggtcagaataatgtgcgggacgagggaggtgagtaacctctttggggcggctcccagtgcggcgtcaccggccctgagaccccgcggcccccagcccggggttgcagaagtcacaggcccgaagcagcaagagctggggaagcccggccgcggccagcggggaggaggagcgaaggggttgcgccccagcgtcagggagctacgacccgagagagggcggcaagggcgccttccgtgggacccggacgttctaagcaaatttctagcatttgccccgggctcccagagctctcgggggccctgggctgtggcactggggcctcctccgcggggtggcgccttccgcccctccccgttgggcggcctccggcaggccccgttcctccccgcgaacgccaccgaggtgcccgcgatgggggctccgccgattggctgtgcgacgcgtcgctccgccagccccgccccgcgggccccgggggtactaaccccgcgcgggcggccgcggccccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggc

SEQ ID NO: 52248 - DNA, 1027 bp, Homo sapiens
aaaggaaaaacttttgttcctgcattttgaaaaggggtcctgtattttctttttgcactgggtcctataaagtaggtaactggccctgcctgaggattggagagacatgcaggacccccagaaatacagtgcaggcatcgggggagctcagatgagctgccctgttgagtttctgcaagtgagaggagggagcaacggctcctggggtctcctggggttccagggcccaggcaaaaagaggaggctgcagtgtgaggaccctgggacatggaagccccgcccacaggtaccctgagctcagctatgctgacccctcctggggtggccccatgctctgagccaaggcccacccttctgccaagcagggtgccaagggccaaggccaaacccccgctccagagaggcctggcccagagtggcaggccagaggtggtgggtgggctcctgacggcctccctggcccaggccgcgtggatgataggctgggtgaggtgggctgctggccttggctttcacacacatcacggggaatgaaaagctcacagaggccactgcagagtgcaggaggccaggtcacagttcagtcagtgatgaaggccagtgggggtcagtgacaacttggactagaaatcaagctgtggtcaaggttgggactcagtttgtggccgcttggggagtcaggttggggcctctctctgtctcgttcacatccgccaagtccttggtgtgggtgctgggcagggtctgagtcacaggaggtgctcagtaaatgctcctggaggaatgaataaatgagtggtctgctcacggggggcggggcatggctggagtgcagccctggacgctggacgatttgcactttccatttagccagacttggattcaaatcttggctctgcttcttacaccctgagggggatatttaacctcctttttgctgtttcttcagccatacaatggggagaataacagtacctccctctcaggctgttagagaattcactaagacaaacctgaagtgctcagc

SEQ ID NO: 52249 - DNA, 1050 bp, Homo sapiens
ttggtgccactcaacaggcaggaaggcagcagctctcattggctaaatctaccccttctggtctcagggccccactcctagatacgccctgcgtatgtctctatggcctgagactccctctgttgcagaagtcgagagagcatcagtgtctgtccctcaaatagtgccctggctaatgcctgatgtgccactattgttgccatttccttttgctatttaaaaattgccattgttaacatccaagttgctctagacactatctcccaaaatgtgttccaggaaacattaatctctcaagatgcatagaaaacaaaaagaagagggagggctccacagtcaagcaagtttaggaagcactgcaaatgctagtcctcttttggagagttacaagtctagcaaaggctctgaggaatcctgcaatcgagttggagtttctttaatccactccccagacttacttcattacagaaccctccccttatcttggcagagcatccattaatatgctgaaagcctagtataccagggaaaaccctttgggaaatgacattttaggggtttgagtccctctccttcccccaagcctcaactgtggtcagaagctccaattatgaggctggtcaaagccagtgaagagaggaagggtgactccagccttcagtgacaggtgaatgtaagggtcacagtcacagtctcacccagaattgaggaagggaacatggatccatccacgcctagatgcaaggagggcgtcatgccacatggtgagaagagcatgtggggtgccctctagcccccatcccacccaactctggtagagcagcaacttagccatggaagaaagttctaacacccttgttagagctggctctcagaagcccgaacactgaaacctctgctccctgaagatttcttctgcaaattcacaggctgcctagtgttctggcagaagccccaagcaagacaatgcaggcctggattctgctcctgcttttcctagtggcctgctatgtgacccacggaaggccttcaatctgtctgtgctggtac

SEQ ID NO: 52250 - DNA, 1038 bp, Homo sapiens
acaccccccacagcatccagagcaatgccaggtaagtgcatgaacgcaagaagatccagcttttttttcccaaacaagtctatgggtaggcccagatttaaaaataggtagctcttctatattctatatatatatatatatatatatatatatatatatatatatatatattaaacacattttatatagcacaaaaacataaaatagtatttctatggattataaatgttcatggtggaaatttaataaatgttaaaaaaaatgtaatgatgaaaataaccatccccatgcaccccctctcccatcctctgatcacccagggaatgccattgctaatgttttgttggatttcattccagtcttttttctacatataacagtcctggccacttactacatatagagtttgcttctctgtgcttattactcaggagttgggagccttttctcatagccttaaatgttctttgagaacatgatatttaatggctgtcgggtgtttcacacctattaaggtcggagctgtgaagagctcagctgcccagaggacctgagctcagtagtgagaggcttgtggtgtccttggaggctggaaatagaccatctccatcacctctgctctcagaactcccactctgttctcaggaactgtgcggtatctcctctaaccctcctaaacgacgacaaggaaggctctacagagacagagcctctggaaggctcagagagacgaagtgactcactggaagtggccagcacacacagtagaggaagatgcctattcccaagcctcctgcagttatttatttatttatttatttatttatttatttatttatttattaagacggagtcttgctctgtcgccaggctggagtgcaatgacgtgatattggctcactgcaacctccgcctcccgggttcaagcaattctccctgcctcagcctcctgagtagctgggattacagacatgtgccaccacgcccagctaatttttgtatttttagtagagacggggtttcaccatattggccagg

SEQ ID NO: 52251 - DNA, 1063 bp, Homo sapiens
caattttgaattttgtaaattttcttctttccccaggattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaacatttttagtctatcatttaaaacaaacatttgtatatatacatttgtttatatacatacatgcttccattctacaaacactgaaagaatattttattatgggaaattccatacacccaatacccctggtgagtcccatatacccagtaccctgttcaacaatcattaactcatggccagtcctgcttcatctttatttccatttactttcttcatgactcttattttgacgcatatactagatatataatttcatctataattattttagtat

SEQ ID NO: 52252 - DNA, 1104 bp, Homo sapiens
gtctttcattagttttataaaggcagtttcagcccccaaacaaggaggggccctgtttaaggaagggactatgatcatccttgcttaaaagttaaactataaattctcccatggttagcttggtttatgcccaggaatgagcgaagacagccggcctgcgaggctagaagcaagatggagtgagccatgttagatttctctcactgtctttgcaaaggcggtttccaggaacagcgtgcagaatagggggctatcaggctccttttggtcatttcttcctagccgtccgattctgagctcttcccaacccttttcttggcgacttacctcccgctgtcctggcccacgctacttttcgcggctgcgcaagaccctacgcaatccaaaatatttcatagctaaaagggtcccaacttccggagacctcccggaaggggcggggcttatggtagcccattcgtacgtatcggcccgtttgtctgaaggttgacggaagtgctctatcttgttgccggaagtgggaagagagaaaggttgtgatggcggctatagctgcatccgaggtgagttccacccaccgtacaccgggggttttgttggtgagggttccggggagcggcctggagagaggtggaggcgaagtctagtttcgcttcagggaggctcagacactgtggggtcaagtcggcggtggaggccctaggcccagcctgtggggaccggcggggactcggcctgggcagtcctgggagaagctgagccggctctgcctgaagccagttctccttgtcgcaggtgctggtggacagcgcggaggaggggtccctcgctgcggcggcggagctggccgctcagaagcgcgaacagagactgcgcaaattccgggagctgcacctgatgcgggtgagtagtcttggaggccggcttagatccgtcatctggccaagcctgtgcgcttttgtagaggggacgaggaagccacaccactgcgtctgacagaccaacagagcaggatcatctgagaggaaagctctgttcggtggtactcaaccctggcagcacattgggatcattctgagaacatttgaaaatataactgttcac

SEQ ID NO: 52253 - DNA, 3643 bp, Homo sapiens
gatgcatatggaaccctcgcgcacacttggggtttacagtctctcaaacactgtggtactttctatctgcatttagtaagggggagaaaaaacaagtataaagtggaccagcgcagctactagtgttcaagggcaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaatgtaagtatatccaggcattgaacactcaaaaattggatttaggatgtatttttgcatctttgtgtttttatctttgtggtgatagttgggggcctactgacacactttttaaatagaattaaaatcatttgtttttgagccacttttataagtggccattataatgggtttgtaatatatataacattcacgttagttccgatattttgccattcttttaagtgtccccccttttttattgaaatattttaaagggaaatctttagaatactccttaatcacaatgttttaaaataagagtttcaaaaacgaagcctcaaaatcattataccttgtgtatcttgtgtatgtccagtgtctccctgctgccccagtatcttcacttcactttttgaatcaagctacaattaaggttcacactatgtgtttggttgataatccttttttttttgttttgagacagagtcttgctctgttgcccaggctggagtgtagtggtgcaatcttggctcactgcagcttctgcctgcctcctgggttcaagcgattctcctgcctcagcctcccgagtagctgagactactggcgcatgccaccacgcccggctaatttttgtatttttaggagacagggtttcaccatgttggccaggatggtctacatctgacctcgtgatccgcccgtgtcagccttccaaagtgctgggattacaggcgtgagccaccgcgcccagcaattgataatatctctaaggctcatacatgggattatttaatgtacttttttttgtgaaaaaagtgtacaatgtatgtttgggaagctgactgaatttgttcttttacagaattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcttagtctttattgtatatatataacctaatggatctttatttaatgtagagatataaggtggtgtgtgttgattaaagccctgttaatcccaagtccaaggctgactggccctacctgagattttgagaaatgctgaatctcaagtccctaccctagacctgctgaattagaaactgaattttaacaatattcccaactgaggtcaatacttcaacttgaaaaattgccctaaaaaatttatggaatactgggcttcaaggcaagaaactaagccagaaagaggaggaatagaatgcctcattaagctgtaaaatc

SEQ ID NO: 52254 - DNA, 1475 bp, Homo sapiens
tccccgcccggcactgacgtccagccccgcccgtgcagtgaggccagagcctggtgtagccccacgcggggccgttccatcttcgaagttttctggtgactgggtcggtcccgcaattatctcagatcaggggggaagccaagggcaacgggacaccctgatgtatcaaacacctccccctggagccccatcgcgcatgcgcaccctggaggcaagcgctcgaggcacagggcgcggcttggggagggaggaggcagggcggtggttgggcaagagaagagccgcgcccaccacggaacatctctgcgcatgcgccgggggccagcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggtaagttttctgctgacggggtctctcaggaccaccgcagtggtctctcaggagtgagggacgggaaacgtgccgggccccgcgtttggggaacgcagcgtttcgcttcaaggccgcggcctcagggcgccgagcggggtttctagggctcggttcctgtcgcggcggtcgccgcccgcgccgtggctccgcctcccggaggttccccgactgtggcttccgggtggccaggcgccggcttccgcgactcgacttgttttttctctcttggttttttaggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcc

SEQ ID NO: 52255 - DNA, 1111 bp, Homo sapiens
gtccccgcctcctggagctgaacccgcccctctcccagaggtggagctgcggggggcgggaacaggcacggagaaaataaacaagactaaaaagtcctgagtagcgctgtgtggccgcaaacctgaacccaccttttgcaccacgcgggacccggcactcttcctgccacccacccctgagagggctgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagcccctgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggacgtaagtgtcgggcggggagtgggggtaagagagtagcggccgcaggctggagaggcctcggagccggggccgtctgacgggctggtgcccacagcacaggctcgttgccgccaccctcccggaagccgcagacccgggctgagccgccgcggacctctcctctcctgggtccggcggcgccaggagaaggcgacggcgtccagaccccgccaagacggagaggggaccgcgccctcccccgggacaccccaggatccctggaaaatcccccgatcccccacttcacagctggacaagccgaagccccgagaaaggagcgtgacccggccagctccctcagcgaggggtgccccggctaaaggtggctcccccatcttccagcggcgtccctcgagacctaaaagtcccagagtttggagggcggggtctggcttgagcgtaccagtcgtcgtgcaaagaaaaatggattcggggtggggccattgggatgaaccgaaaat

SEQ ID NO: 52256 - DNA, 1101 bp, Homo sapiens
tcgcccaggctggagtgcagtggcacgatctcggctcactgcaactttcgactcccaggttcaagcgattctcctgcctcagcctcccaagtagctgcgattacagacatgcgccaccacccccggctaatttttgtatttttagtagagatggggtttgccatgttggccaggctggtctcaaactcctgacctcaggtgacccacccacctcagcctcccaaattggtaggattacgggcatgaaccaccacgcccggcccccaaaccattttttacattaaaaaagatactaaatgaatccagatattactttccaaagttataatgtggaaattcatcaaaaactaaatcaaatattctgaagaagtatgtggaaccaaaataaagcatttgtaatttcacttttatctaattattcctgagctattaattatttttcgggcttgaagcaagtaaatggaagtacttatttaattgtttgtttgtttgtttttaagtgacctgaaaaaaatgtctggatttctagagggcttgagatgctcagaatgcattgactggggggaaaagcgcaatactattgcttccattgctgctggtgtactagtaagtgtcattgattatttgggccttattttttggtgcgtttgtgtttatgggttttgaattctgcaggatgttttaaaatatgtactatttattttatctttgaccactttgaccatgttgatattttgttgtttgtggagagttattagttccactttaagagtttatggtttaaaatttgattaacaagtggttgggttgttttaactgcatggtaaaaatggcataataaaacatttgttcattatatggattatatctccttttaatgagtatattaaggtacaaggaagtgtttaagacgcagtcaggtcaaaaccagtcaatagatgtgattgcatttctccataatccagttaactttcttctcagtctcagggaaaaaaaagtgctcgctttggcaacacatacactaagattggaataatacagagaagattagcatggccccttaaaatttttttttaaaaagcaaaaacaaaaaggaaactc

SEQ ID NO: 52257 - DNA, 1050 bp, Homo sapiens
gcagaacctcagagctgttatttcacaccaagaagatagctaaaattctgtgaacaatagttgttctccatattaatttgaatgcttttttcttgattttggggaatatttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaatgtattaaaagggatctcctcacttaaataccttgcttttagccagtgagatacagaattgctatgatttctcattggtatcacctttgttttagttttttacaggctggtggattatcatagatgcagctgttatttatcccaccatgaaagatttcaaccactcataccatgcctgtggtgttatagcaaccatagccttcctaatgtaagtgtcatcgtaattggcattacttacatagcttgccacaaaataaaaatgtttcaaatatagttgcatagatttaaaattctaaatattatcagattaacacactggacatgatttaaaagtcacacagtagagatggacttatacagaaaagcagcagtcctctttattctttttgtgtacctctccactccctcccagcttctctcagctattcttttattttatacccccagggtttatagctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaa

SEQ ID NO: 52258 - DNA, 1272 bp, Homo sapiens
tcaaaaaaaaaaaaaaaaatcagacatataatggttacatagtaaacactggtaactttttaaaagtcacatgtgtattcagtacttgaaagttaaggttgttgggaatatggtggttaatagcacagttgaacataatggaagaattcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttg

SEQ ID NO: 52259 - DNA, 1751 bp, Homo sapiens
gtatttccatttctctgtacttgaacaaatagacccagtttacaacctgcgccataatagctactcagtgtgaatcgatgtgaagaagtgaattcatcgtttaatgaagatttatcatcttactgatggcttttgaaatttgaattttcttaccctaaaggttaattgtaaatactctttgcaagttattcagaggttcatctgcaaaattttaaaaaccgacagtgcattagccttaaatcttcttatgcttctctgttttgcattctttaagttaaatgttaataaaagacctaaatgtatttctaactgtctttcctggttggagtatcatatatcaaatgagcgtttcaactcacttatctgtttcttggtttatattatggagtattggactgaagaacaagatttttttttttttgcccaattctgtttttaaagagatttagaaaaatttcctgttatttctaaagcaaacaggatgagtggactggttataaactagaatgcttgaggattcatgaatatcaaatttctggtgatcatcaaatttaagtctatgctaagttgtttttcacaccatctattgcccattttgtttctcaacaacatgtggccaattttggattcattaaacagagagccttgttttttttctggggccgtgttgacagttttgataaccactgtctactgtttcatagccaaacctttcatggacttactattttcatgttctcagtctgtacaactttctgagccttggcataggaaggaggcagctgtggtgaaaagcgcactggactgcaggaatcaggagacccaggatcagactcaaaatcccagctctgctgctttaggcagacagggcatccacagctttgagccccagttctcccaccttcaaatgagttttgaggactaaaggagatatgtacagtttgtgaaatgctttataaatcctagtgtagtttacagatactatttaccatgttgttgctatcacagtttaacgtgtggttaattttttaaggaggcaggaaatactgtaagatttggtgcaactgtaaacaaaagttgagtagccaaaacaaagggtcagttgctgtttggtcttgctttaaaaaatcctgttgtggactcacttttaaatcatgggctgcagtccaacaactgttactgaggtgactgtcaaatgatatcatttattgtgagtatcatggctgtcttggaattctgtttcggggtgagatgcaaggaaaattaattttagacattatgttaatgtaatctgcatttatacatataaaacatcatttgaaaagtgaaacatgctatagaaatattttagtccagttaataattaaaaataggagaaaggaaataggaatagtgatcttttcatcttactaggggctaaagttcgatgtagttttaaaaaaatctgacccagcccagagcctgacagagtcgacattcagtgttcaataaatgttgagtgagtaaattaataaatgaatataagctagtccatttcattcatgaagtgcctacgttgttcagggaattgcggaggatacaggataacacatggctcattgtcttcaaggagtttacagtctagtaggccgtagtaataccatcttaaatttgtacagtggtttagagtttccaaagaactttaagttctgttcaagtaaaaatatttctgttgtgctaaattttagcttactgttttagtggttcatctg

SEQ ID NO: 52260 - DNA, 2344 bp, Homo sapiens
tggtaggctttaactttaacaatcctggacctggcacgaaagtgatagattctgtattgttttagaggagtgttggggaaggagaaattgaaatgttttcactaacctgtgcagtgaagtgtttattagctaaactcttctatttgtggttttcacaaaatacactttaaaaatcggccacactgggatgaaaaagcactttcctccaactttcattatgattcttcctgtctgagcagtcttggcagtttagtttcattaggtgttttgaaaatccctttaaattgctgctgggttgaggaggggaacaggagagaacgtgattcacttcacattatttgcttaaaagcttcctgttttatcattgatagtctcctttttcttcacatcgattcctcatggcctctcttgaacctcactagatttagagattgatcttaatggtaggtttaacaaataattatttacattttcttactagttatatgcttgtatatatctcatggacccagtccatgttctgtaagcatttatgttcctagaatctttttctttggccatttctcccagatctccccactgatactgttaaccctttggggttttatgtatataaagtgcactttgttttatctgtttctaggctaccatcttgtggagtttggagggcaagtagaaatttcacaaacatagttaagtgaaatactgtaattaggttacttttcttcataaaatttagtgtgctcttcagatatactgattagtttatccccaggcttactagatttgggcataattattttacttggctcttgctcaagaattaagtccagaagaaaaagaagttggctgtccagcaagctgcataagtaggatggtacatacaacagtagatacacatatccttgttagactttttccactgtggatttcttcagatgcttaagtagtgacttttcaaagcctctcaccttgcatcctggcaatggaagcttgaaaaaagttaatcaacttttagagaatattgaggctctgtatctttaatttgacatttaaccgacatcaaattgtctcagctgatgagccttccaaggcacttgtcttccctggcctttgaagacagtcatagtactgaccttgattgctttatatttttttctctgctgcctttaaggatgatatgcccactttgagtcatgggattgtggcaccaaaaataatgtatccctcaccccatctcctctgttgccttctctttttcagagcttttgcatttagtgattaaaatggtgtgactactccactttcatatatctgttcatatcactgatgagtttgagctgtttaggaccgatctcccactcagcacagaggagtggctagaaataatctcattctgtttttgaatcatattgttacgttgttcatcttcaaaacacttttttttttttttttgagacagggtctcattctgtcgcccaggctggagtccagcagcgagatcacagctcactgtatccttcatctcctgggttcaagagatccttacacttcagctgaccgagtagctgggaccaaaggcatatactaccatgcctggctttttttttttttttttttttttgcgtttttgcgtttttataaagatggagtctcgccgtgttgtataggctggtcttgaactcctgggctcaagtgagccactcaccttgacctctcaaagtactgggattataggcatgagccaccgcacccacccaacacttttaaaaaccaaataaatagctgagtactaaaatcagtactttgcctatcttgtagcaagaatagttgaacattaaagagaatgaatactatgttcatgtccaaagtaaggattcctgtctcagaaaagagagatactgtctgaggcttgagtcgtcttgctcagatgtaataagaatttttggccgggtgtgatggctgtaaccccagcactttgggaggctaaggcaagaggattgcttgagtccaggagttcaagactagcctaggtaacatagcgagacctcatctctactaaaattcaaaaaaattagctgggtgtggtgtcacattcctgtagtcccagctacttgggaggctgaggcgggaggatcacgtgagcccaggagtttgaggctgcagtgtgccatgatcgtgtcactacactccagcctgggcaatagagcaagaccctgtgtcaaaaaaagagaattggctgggcgtggtggttaatataatcccaaagtgctgatattataggcgtgagccaccataatcagcccccaatttaaaggaaaaaaaaaatctagaatggaaatcg

SEQ ID NO: 52261 - DNA, 1015 bp, Homo sapiens
actagtattctttaatgttaaagtaaccgctactttttatatggttgattttaaatgtttaaaatttccttttgtgaatttgctttacagttaccaagttatctcttagcagtttcaataattttgtccaacatgtgtttaacaatgtgtggttgaaaataacaggttctaagatgtatcttttattttgttttatttttccctttaggccttctcagtattttttgtttgtgtagcattcacgtcaaatataatatgcctgctgttcatccccatacagtggcttttttttgctgctagcacatatgtatgggttcagtacgtatggcacacaggtaagtcttaatgatttcttagatggatagaaatcttagattcaaatttttaaatgtggttatttctttgaatacattatttagagttgagtttaatgtggacattttaaagttttcttttcttaataggttataatataccttcaaaaatatatatcttttttcgttatttgaatacaaactttaagctgttatgatttgatattttaattacaggcattgcaggtaccagctctcactctgaatatatctttttaaaaaaaaaatagttggactgatttctatgtaggtatacttgaagacagccatgtgccaaaaaagaaaaaaaaatgttcatggaatttcatcattgaaaggaatgtcatttagatgaacccttaatttggcaaaagaatcctcacagcatccctgacacgtggtggttttacctctgatggaaaacctacagtgacaaggaacttacctactgttcctggtaccctactctgtttttgggcagctataaaataaagttattcctcatattaagccagaattttcttccttaaattttgacccagtatgtcttcactgtttttgggctcgttgatttcttttttaaaaatttctatttttttttaagatggggtctcactatgttgcccaggctggacttgaactcctgggctcaaatgatcctc

SEQ ID NO: 52262 - DNA, 1620 bp, Homo sapiens
tgctattatctgtctttaaaaattttatctaatagttaagaaaatggaatctgattggtttaatttgtatttctctaatcagtagttaacatctttttctatgttttttagccatctgtattcttttgtgactcgtaaattattttctttagttagctttttattgatttgtaggagctctttgtatgtcagggctatgaatcctttgttttacatacattgtaaatattttttgccaggatgtttgtcttttatttttgtcagcgattctgtggaatcatttgtcatataaaagctttcagtttggatcagtttgccttttaatttagtttaggtgaaggtcttaatgaaagttactgtcgtcaaattagtctcccaaacaatccatctgttagttactatatcgtttattaatgcttgcctctctgctgctttctcacagaaaggggagtgtgtttgcctacagtgtctctctggatcctctttgtttatattgaagcagccattagatttaaagatctcaaaaactttcatgtagacctttgtcgtccatttgctgctcactggtaagtattacataaatgtatgtgtgtgtgtgtgtatatgtgtgtatgtatatatatgtgtgtgtgtgtgtgtgtgtgtgtgtgtgtgtatatatatatatatatattttttttttttttagacggagtcttgctctgtcacccaggctggaatgcagtggcacgatcttggttatgcaacctctgcctcccggcttcaagcgattttcctgcctcagcctcccaagtagctgggattacaggcgcgtgccaccacacctggctaatttttgtatttttagtagagacagggtttcatcatattggccagactggtctcgaactcctgacctcaagtgatccacctgcctcagcctcccaaagtgctgggattataggtgtgagccagtgcacccagccagtattatatatattctttgtctataattcatttcactgtagaatgttaagttcaactgtaaatttattcttagaaattttacatggatccagaaagcagtacagcatggttggaaagaccatgagcccccccttttcaggcagatgagtgaatcccagctctgtcctctgacagcttgtgttgccttgtcactgcctctaagccatggttttcttacctgcctcactgggtcatgggaaaaaggaactgaagtgatacatgtattcaacttaatgccaagcacataggtgtctgatgaatgttagctatgtttattataatcaggtaatgattccagaaggtcttgatgaaatatatggctaattcatgaaacttaaaataatttagaatttccttagcctatttataaaagtaagagaatattattaataatttttgaatgaatattatttctctttatgttaatgaatattaagatattattcatttaatcttaaccatgaaacatttttgaaaaatgagcttggttcttatttagatctattgtggaacttaccacctaatgtatgtttctcctaaacacaccaatttttactaatatttatggcagaaaccaaaataaacagtaatcaactaaaaaaatactgtttccag

SEQ ID NO: 52263 - DNA, 1209 bp, Homo sapiens
ggaggctgaggcaggagaatcacttgaacccgagaggcggaggttgcagtgagccgagatcacaccactgcactccagcctgggcaacagagcgagactccatttcaaaaaaaaaaaaaaaagggtacaggtatctgcctaagttctaatgcataaggcagtttcttcaatatttcttcaaaggcattattagccactgtatctgacagtcactgtggtgactccttgaattaatttgaagaatgccaacgtctaatgggaagtgtcgtcttacggtctagcagtcctgttgttcctgggggttttgttctgtgtgccagttgcttctgatttccacagtagacattacatttatttgtgtgtctagtgaatgctcttctcaactaccatcatcaattagaatttatttttaatttttaagccataggtattctcatgtgcttgaggcacatgtggttcattttaaacctacaattactggctggattgtcttctttctagtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaaggtaggtctttaccctaaagctgttggctcaataggctagtcattattttgtctcttggtagaattttcttttctggaaaagtagctaggattttgtttttttctgtctaatggtgttcctcctcagggtcattgttttatttggtcaatgaaatacagatggtgaatgaagttttttacatactgtctgaagactatgtgtttaaatatgtttattttattattttaaaatatatttatatcttttttatattttaattctgatttttttttaaatttagttttttgagacagggagggtctcactctgttgcctaagctggagtgcagtgataacagttagggaccactgcagcctcaaactcctgggagcaaagtaatcctccctcctcagcctcctgagcagctgctaccatgggcacgtgccaccatgcctggctaattttttttaattatttttttgtagagatgaggtctcactgtgttgttcaggctagtctcaaactcctgatctcaagcaatcctcccac

SEQ ID NO: 52264 - DNA, 1626 bp, Homo sapiens
ctgaatagagccaagatggataggtcgtgttctaaatgcttcatataatgtaatgcagattttaaattgaaccatttctaatggaatctctctcatgggcatttgaccaatagaaatagataattggcagtagctagtttccattggtttgaaagttgaaagtttgaggtcatgtttttatttaatatatttcaaaattttctttttgtgtgatgtggtgcaaaaatatctcttcaagtagaccttaataaattggaatgtgtagacccaatacacaaaattctttctgagtggtctggtaaatgatacagacttccttattacctcaacactagagtccagaaaaaggatagatgtcctgtatcctaaaattattcctcttcttttgtttcatttaacctctttcttttcagtaaagttattaacagttcgtttactccaggcacttaaaaaaatatgacttcttaggatctgcctttgtcctctcacctcagtgataggcgagtttgatttgactaatacacaaagtgtgacctaattataaaaccctgatcttgttttcaagactagacctttagtggccatcattttcataaatgatgatgattttctaaatgtagagtttctcaaatgtatttggattttcttctattttttcctacatcttctagtaaactatgaggatttgcttcttgattagcgtataatgagtgtgcaaactaatgtgaatttcttaagtgtagataatagtttgttgaattaatctgtgttgttaaacaactaaatattccggtgggggctttttgtttgttggtttgtttttggtattgtagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggtaagtgcacatgctgcatccttactaacactttccagtaaacttgacatactcttgacatactcccatatgggcctgtagggattgtttgtaatcagatattgtgactagtgacgtgtggtgttttacatgagtttgttggccaccttgtgttattgtgttgaagcattgatttcagctctttgcagtgttctgaataatgagtgacactgattacttcccacatgtgacaaattgacctgtaacttgattcttctagtcgtgttgtaaggcacttctttggtccttgtc

SEQ ID NO: 52265 - DNA, 3004 bp, Homo sapiens
gccaggctaatttttttgtatttttaatagtgacaggatttcaccatgttgcccaggctggtctcaaactcctgacctcaggtgatccacctgcttcggcctcccaaagtcctgggattacagatgtgagccaccgtgcccggccataaaagaataacattgttttattacattgactggctcagacttaattttactatattttatatggcttatgttaggcaaacacaaatatgttcctttcacctcagatctttaatttggaaactgagatctaaactggagcttttttgtgtgtatgtaactcaagagggcaattgaaactctccccttccagtaagttatattcttctttctctggcttgctttaggcagccctttaggcagtccgtttattctaggagggaggctttccagcattataaatggtatgaactagattattaatttgttttaattttctgattggcagttaaactaagcgaggtatatttgggttctactaatacaggctctagaggtttcacagcccccaggctacttttggaagtgtgctatttgctgttgcctggctggcatccatatccatttgttaggacattctggccattgtgcccagcagaaaaaacacgtggaagagaactctcctccagatgcccatgggagaaagaccaattagtttaccttctatttcagaggaatatcccacaaattcactaaatgctatacacaaaacatctgtcacagctatttaccatcctttctcctacacatgtttttttttttttttgagataggatctcactgttttgcccaggcttgagtgtagtggcgtgatcacagctaactgtagactctacctccccaggctcaggttttcctcccacctcatcctcctgtgtagctgggactacaggcgcatgccactatgcctggctaattttttaatttttttgtagagaggagatctcgccatgttgcccaggctgacacaagtttagtaatagcggtcaagctattactaaatgatggtttgtgatattgattgactctactatctgatctgcttttagtagagaagttcaaggacccagatggctaattgtccagtaagctggagatgatgacatgggtccagtgcccccgtgcctacacctaaggagtatgctgcttcttgtggtcactaatgcgtactctgccttgacctacagtgtcccaggtattactctgttttggagaactacttactatcaaatgactaatagacaacattatatttaagtaggtttataagctcccatggtattattttcaacttttaatgttataaaaaataaggggatcgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacaccacatgttttcactcataggtgggaattgaacaaggagaacacatggacacaggaaggggaacatcacactccggggactgttgtggggtggggggaggggggagggatagcattaggagatacacctaatactacatgacgagttaatgggtgcagcacaccaacatggcacgtgtatacatatgtaacaaacctgcacattgtgcacatgtaccctaaaacttaaagtataataataataaaataaaataaagaatactatgcaaagaatataggtttttaaatcacaccttggttggatcctggaccttctatttactgtctgagtggccttgggcatattatttgacccctctgatttccatttcttggaaagttgagataaaactaatagaatagtgctgttgttaaggtacaggcattcaataaatgttggttctcttccttcccccccctcaaaaaaaagggtgatgtaaatatccaataatgggagaaatttaaaataaattatggtccatccatttgataaacttttcatatagatactataaaatcatactttcaagccatattaaagaatatggggaagtatgtcaaagcatttcatgaataaaggagaaagcaatttaatgaaaaacaattttttctaatatacatagaaaaatgatttaaagggaaaataaccaaattgttaacaatagttgttatcccttgatagtattgggcatttattttttctttttattttcatacattttcacatttttctatgatgaacagcaatgaaagagtttaaaaggaaaagcctctatctgagcagattatccagcttggttggaggaggtcttatcttacttcctcccacccttccttagccgtcgcctctgtttcctcatttgacttcatgtatgttttgatccatgtcaataagattgtgactgattcaaacctgacatgtttgagttgttagctagagagtgggtttgttatccagatggagcagcctggactcagcagtctctaagaccccttctgatgcaaacatacagggctgacagtatgtacatgcactgtttgcttctgcaggcatacttggggtggtgcacagtttcaggccaacaaacttccccagggatgctttagcgataaaactgatctctccttttttttttaattttagatttaggaggtacacgtgcattcatatgcaggtttgttgcaagggcatattgcatgatgctgagctttgggcttctattgatcccatcacctagacagtgaacatagtacccaataggaaggtttttcagcccttgactgcctccctctcttcctccttttcaagtccctagtgtctgttgttccagtctttctgtccgtgtgtccctaagttgatctacccttttctaagtgttgaagacaaaatttgaaaaccagtactatattaactaaccagtaactctactgtaataatatagattaattgcaacacattctacagctatgtc

SEQ ID NO: 52266 - DNA, 1552 bp, Homo sapiens
tgattttttaatgatttaattttttaatgacaatcaaatatgaatgtactgtaatttagccacccttctgttgactatctaagtgcttctgattttttcttattacaacagacaagcttttacataagatatgaatattaatgactgctgatacacacttgtcaaatctgactagattcctttatggaccttactaaaatgactagttcttggcactcacagctttattcttgaagaactttaagaagtcagtaagtaccctatttccctaaatgaccagttgtgtgaaagtctctagaattcttttctgtctctctttgcattcctttaggaaaattaatgtgtttgccttttgtgtttgacagattatggagcagagacataaagtactttgtaacatggcttcacctagtaatcaggtcatcaagctcttgcttgtttttgtacacttatgccttgtagtcactacagtgacaccagaggcagcttcatgtcagtatttccaaatctgtggtttatacctgctacactgaagcagggtcatgttagtgtaggcctcacttaagatgggatatatctaccatattcttaaaatacatttttctgtgaatgacccaagctacctgtcctgtcagtgtgagtgacctggaaaggagagagggaggagttggtatagagggtaatcagtatttcttctgaggacagagctttgatttatgagctcaactttctgcacagacagctgtgtggtccttaaacaagtcttgtcttgtatgattaatgtgtaccaggggaactcctaatggaactaggtactaatcgagatgaagcagttgctcttcattaattcttttcatgtgcacctgccttccttaaaagcaaatgcccacttacccctgttcccttcagccactatttaaattaaaaatcagatggtctgctgtagataggtttccagagcctcttatgtcgtaacactgaccctgttccattgtgagcactgaggagatagacacagagtgaagattagtgacatgatctataaggattggaagaaactttagaaatacagtcccagcttctaattttgtagcacagtccctggcttcaaagaacttatagtcttgttagaaatacaatacagtcacaggaaaagattaaacatcagaacagcagcaacaaaaagaagcccagcacagggcgatggtttgatgccaaatgtgaaacactaacatggagagctttagggttttagaaggagaagagatattgggcaccgtgtgctggagagtttaatttttgttgttttttaactgagccttgaagaatgggtaagattgaaaaatggaggccattcctcccaaagaggtaacatagtaaaaggcagaaaatgtctggaaaacaaggagtgggtcattttggctgatgtgaagggtttgttagaaaacctacctttcaattagttggctgtataatttggagatgactttttgaagccccttctcctacagagcaagcagcagggtaaattctgtattgcagagcctagagc

SEQ ID NO: 52267 - DNA, 1023 bp, Homo sapiens
tagataataggattcagaggtagcttcacaactcccttagaagttgagtgctatcttttgaaattatcagtaaagtgagtaggaaaagttgcctggacctgatgtgtaataatttagaaccctggcttgttcagttggacaaaaatggacatatttattgtacatataaactccagctttgccatgggccctgtctgtgtccaaagtggtgatgccacagggcaggcctttgtaagggtgaaaactggttccacaagaattaggcaagaaggaagtgcatttatttcctgactaagccttattaaagcttggtccagatgtatctggcccattattttttttttaaatgagattgtagctcttctggagaaaactactcttttatcccttaaaattctatagtctagggaagagtgtggcccttaactcagataaaaggggtttgatgttttcctccattctctctatccctgtctgctgagattagtttcaaggcttataatctattacttctgcctcgttttcttcctgatcattgcttttaatttaggtttcagctaatgacattttaataaaatcatattaatacatttggcgattttgcattaaccttttaacaccacttaataaaaacttctttgtacttcacactaataaattatatatctgtattttacctataaagtattgaacttcagcaccaaagggttaagtatgccattaagacaaatagtagttatctgtttaataaatgcttctagcactcaactatcttgattcagttcaatttgctaacacatacttcttttttttttgaaatggagtctctctctgtcgcccagactggagtgcagtggtgtgatcttggctcactgcaacctctgcctcctgacttcaagcgattctcctgcctcagcctcccctggtagctggaactacaggcacaagcccagctgctttttttgtatttttagtagagacaaggtttcaccatgttggcagggttggtctcgaactcttgac

SEQ ID NO: 52268 - DNA, 1366 bp, Homo sapiens
ttagtttgctaatctaaagaggcaaatcagcagccatctgtaagtgtgtcaggcctagaaatcctagcccaaactgggaggaactttagagttatcagccgtagatgaggaaactgaggcctggaagattacacaccttgtgcagggtcagagagttggcgccagagctgaatgtagaaccctgatcctaaactctgttactaaaccaggcttagcccctattttcacctaaaaactcaccctttctactgaaaatgcaatcctcagactgtgaaatcagcttctgaagaaagacaaattacctaacacattttcagccaaatttctcaaagaggatagcctgacagcattgacctctttcggaatatattctttgggctacttaggagtgaatgagagacagtatggtgatggtataaatgccgatctgtaattgtttagagcagttctgagagtacattcaactggaataactctggcaatagggaaagtgtggtgtgatgtcgacttgtgacccttccctggggagcaagctgtcaggacacccagcggtgcttttggaacaaaaggtttctaggccatgctcccaggcactggacaggaggactggctacttgcacctgcagggtgactgtcagtgttttatgatttggggttttgggggttttttaaagttgcctaaaggtagatatgtaaataaagctgccctatgtcaggcaacatttattgagtaagcgttgatcactgtggagggctctggggatttagtgcttaataaaacatgtctctaagacttagtctttggagctgacagttccaaagagatcaccattgcccttcagaaatcttggttctgttggtatgttgaattagtgacatgaacaagaatctcatcagagcaaactgactttacctacttgtgagtttgtatcctgatggaaaaagcctcttctaaataaatattgttattcctagtttgtggtaggaagagatttaaaaaatgaaagtaataactacaaaattattgagatccagcctctgtagatctaatttttctttcattctcaactgcagctcacatggcagccatccttgacctgaccttcagcaccactctccacagtcctatctaccagatctgttctatcctttcctactctctccccagtacaagcttttctcagaagccagactaatggcttgcccgcacatgtctatggctgttcctgcctttgagttttttaatacatttctcccctcatttagaatgtcccctcctcttctacttctccaaatcctatccaaacatcagggcccaagtcaatctctacctgctctgcaaagcctttcccagtcttctctcctc

SEQ ID NO: 52269 - DNA, 2534 bp, Homo sapiens
cttgctgagggcatgaaaagccaccagaagggagcctttagtcttcagccaccctctctgctgtccctttctcctttatcagcagctcggatggatattcacaagcaccatactcacctgtcactattcataaacagggggaagttgaaagttacaccccagtaggaagaggtagggacccaggtggaatcattcaacaaaattaacccagttgcagacaggagtcctcatcatggcaggaactgccagcggggtcctttttctgccattcacccagcagtccaggacccccaccaggtccctcccagctctgtgggtgccctcacctagatgaaaatgctgcatttctcattctcctaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagtacgtgcacctttcaggcctttggccgtaagcccggcagcttcactgcttctcctgttgccaggggttggagcacaagatttatggtgacagagacctgctgagaggtttttaaataaaatgtttaaaatactttatttagtaccagatattcaacatgtttataaaatctataaaaacttatttcattgccacaaaacagtttattaatattactgtttttgtcttctctcatttaataacttcttagtttaaaatagttattgagtttttggatagtaaaattgacaagaagtagttctgtcacattttgaaaattttgctcctttgagtgaaaatttctagaggatttgactatatttacttttatttccagaactaaaagatgacattgaactttgattttatttgaaaaggcaggcagaaagccaggtcttctgtgtgaattcatttaggcttttgattagttcattctggaattacttcttaactcagtgtaggtctgtccttttttctttttttaaatctcccagcaatgtgtgcccgtggtagtgatgatcattacaggctgttggctttctgggctttccctgttgaaagaggagttcaacatttttaaggaatgtaactcaaaagctagggcattacaggcaaataacctctccattgcctctgaccagcatttgtggtggttctagcattgatatgtagagaacatcccagtgataaactcacctcatgctgataggtaaagctgggggtggtagtaagcaggaaatatggctgaaatttctatctgaaattaagcatcctgtgactctaaaagaggatttggggacactgtgagcaaacatcctgagctggaaaggaaaagctgtagtaggctacagcaaaattgtattcaggaaaaataaaaaccttcccctttccaccccttaccttagtttcactggggctggtcccatcagtggttctttggtgggactgaagttctttcagggtgctctggaacattagaattagttctacaattatcttcccctctgttcaaaatttgttttaccctgttttctggatgaccttttgtagatcacttacttgaacagagcagaggctaggtcttaatctctgttttgtaaggcagcttgtttattggtgtttaggaattattaaagaataacagtgtgttttcctcaggcattctgggcattgacatttttgatttgctgttcaaacctcctgtttaattggccttaaggtgataaagagatgtttctcaagggtttatagtgggcatttgtaattttaagactttatatgacaatcatttccatataggttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggtatgtccatgtcacctgagtgtttaatccaaggttggctttcctttaccaacaaagacatgggaatttggtgccttgggcaggattggacgtacagcaatcatgcacggatggattgcttttaagtactgttttattaactggtttaaactccatgtgtgcaagcttgcactatcttataacagctttatccctcagtgacctcatctataaagtgggatgagggaatcaccatgtttcccatacctgggaggcaaagtactgctcataaaaaggtttccagtcactttttgtcagactgatgattactaaatgcattgagagattctatctggaagttcgttccctttagagagctatcattactctccactcttaggtatatgtgtttctgaagtttttatcttaaaatggaagaaagataaaatcttggttgcccaagcactgtgtactggctgctcaaatggatatcagcaaactgtcaaatgaaatgg

SEQ ID NO: 52270 - DNA, 1097 bp, Homo sapiens
ctggtcttgaactcctgacctcaagtgatccacctgccttggcctcccaaattgctgtgattacaggcgtgagccactgcactcggccaacctatagtcttttttaaaattttatttatttatttatttatttgtttttgagatggagtctcactcggacgcccaagctggagtgcagtggcacgatctggactcgctgcaacctccacctcctgggttcaagcaattcttctgcctcagcctccccagtagctgggactacaggcatgtaccaccatgcccagccaattttttttgtatttttagtagagacggggtttcaccatgctggtcaggttggtctcgaacccctgacctcaaataatctgcctgcctcggcctcccaaagtgctgggattacaggcctgagtcacagggcccagccccaacctatagtcttttaaatcactttatttccttctcttctttttcaaaaggggagaatgcaccgaaaccttacggaatcggatcagagaactagaagcagagggcaagaagctcacgatggacatgaaggtgaaagaagaccaaatcagagaactagaactaaaagtccaggtaaggggggaacaaaagacttcccttgtatttgaattccacttttatgctaaacttgtgctctgtgttgcagtgtagagatgatgccttttaatatagatcaaatctcattgcatctgaaaaatctctatgtgacaaaaagatttgaagttctaatcttgtccagctcatttcaagtcatattaatgtagccagattctaatacaaaccagaaatgttgacaatcccttggtatgttttataccaggatttaacttgctgtagattcatttaactttttcaggttataggccagattagtgtcctttgaaacttacacacctccttttagccccaaccctctttctattgccaggggactgaccctcctgcatggctctgagccttgcagattgttgttcatagcagtgaatgataggaaaggtgctagtgctatggacgtagcctgttttatgggctgtgtatactttagccaaatatttgtcatttaaactaatgtc

SEQ ID NO: 52271 - DNA, 1094 bp, Homo sapiens
ctaaattctctgtaataagtttggatttttctgttaaaaagaaaaattcaaatatctgtatatattaattgtttacattaaagtgggcttattctgcagtatgccctgtcaaaataattaacatttttacaattattaatgcaggttgagttttggcaagttcgattacagcattatgataatttgcacgtggccagcaaggaaaaatgttttctgtggttctgaattaagcttataagaaaagtgttttatttggaagcagattccattgttttctagacacatgcccagcacagtcaaatgatcatcttctaaatatttttgtatgtgcttattgccatataaacacatttagcacttgcctaaacccatgaaacaccagattttgtgttctagtggccagaccaagaatagtgggatttaatttgtgatttcaggctaatttatagacatcgatgccaaaactaccttgtagcattgctgttttgatgatattgataggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggtaggagaacgtgggcccctggtgaggtggtgtgactgataatgcacagggatgcacaggccagacctctcctgagagctctcaaccaaggggcatttcagttttctcttcaagagtcttggtaagtgcccaacattgaaatataggaaccatcacattaattcatttgcagacatattttgagatgagaacatgtcaagtgcagggcatacagagaatagtatgatttctacattcaaggagctcacagtgttgttgaagaagtagagaactgcagaggcatcaaaaggtgcttaggtataagtatatacggggcctgagggaacatagaaagagtcagggacgaaactagtctggggaattggagagggcctctccccaggggagctgatgtctgaggtgggcctgaatgatgagg

SEQ ID NO: 52272 - DNA, 2126 bp, Homo sapiens
gtactgcctgccgatgaagaatggtttttacatttttccatggctgggaagaaaagatgacaaagatagtaagtacactgtatatggcccacgacacctaaaatatttactgtgtcccattacaggacaagtttgcctgctcttataaatcactgaacctggagctgttcacactgaaccgaatctacttagggattggcccctggggacattgtgttgggtgaggcctcccttttcactaatggtgggtctttgatcttacaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggaca

SEQ ID NO: 52273 - DNA, 1059 bp, Homo sapiens
gtgctgggcctgggctgatggtaagcaaagtgctacccccatttccacccaggcagcacggggccaggctgctccctcccccatgaccattggcatcttggagtgatccttgtgcaaggtttttgcttctggggcagcagggctgctggggggcatgtggctgtcttggtttgagtttctggccccttttgagccatgagcagcctggttcctgggaacaaggaatgtgaaaaactgggcaaggtagcatccactcaggataataaggcagacccgaaggccagaggcagtcaggaggggtgggcatcccgcctgggcaggcctgagcagtccctccacctaatgctggtcctcggatccctgcagccaccccaggaagcagggcccaccccactcccagtccctgcccagcctgggcttgcagctacctgcacacatccacctcttgggttgtattcagtttaacttacagcttgggacttcagggcaaaaaggtaggaatgtatgcaagtgaacaatcagatttatgcaactacagtctaagcttgtgtctccagatttccagcaggcttaaataatggcgttttcatatccctgccacattgggtgtccagcccttgcttgggtggatagtgatctgacttgggctggtaattagcccatatttttagttcatgggcaattctcaatggtaactgggtctattaaacttgattcagatatgacagcttaaattgtaaacagctgcgaagagtttcatacttaattaccatatttaagttttgccataaagtgcctgtacttccatcaaaaatgtaaatgttggagacattcaaatgaggttttatactttcgtgaagtgtaattggcacggatcagtcagtttgtttaggaattttaaatatttttttaaaaggagttttaaaggcagtggccacaggtccatttctcaattaaattgagttgtctgggggagggcagggagcggggctgaggctggtgaggcctgaacttgtagacttgaaagaggctggtgctttcttctctcagccagggctt

SEQ ID NO: 52274 - DNA, 1042 bp, Homo sapiens
tctcttaagggaagctgctataatttacttgactctcccctattcttttggacatgtaggttgtctccctttgtaaatttatttttcgaacagcacggtgttgacacagttatagccaaagaatcttccgtgttccctcccacagcttgttccccaccccacccccacccccgctgctccctttaccagccccttctcctctttcctgggcatgtcctgactgagctggggcacagagtgggtgctctggcctctcccgggggtgggtgcaccgctggctgcccctgacttttctgagctgtttgactctcaaggggaggtgctttgatctgaggttactccacctcccctgcaccgggggcttccttcttgggccatgtgccctgctgttccccactggtgccccctcgcgtctgaccctggggcgcgccagccctcacccaggctctcggctcacacagctctgccttccaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctg

SEQ ID NO: 52275 - DNA, 1037 bp, Homo sapiens
ttgaaatctcaggttgagtgacagctggaacttgcagtagctaagtaaggggcattcatttctccctttcttgttaaggaactacgctgttgaatactcacttggaccacccatagctctttctcaaagctgcttctgagcacagtggctctttttgcccctctcgacctcccagtagggcagtgacccccagtgaaattacatataaattgcatgcatgcagtttttcatggggcatccagaggtgccatcagattttcaaactgatcccccaaaggattaagaattaactatcatcttcctcagaagagatactctctgtgtttgcatttagatggtggtccatttccgaatgccaggggctggagagtcatggcaggaaggaagggctggctagtagggaacttgattctccctctctgtgtaagacaatttattttgccagcagagtctgggatgatgcttgctggagtggctggagggtgggaagaggggtgaggattctgtgctttgcaggtgggtataaaataacatgatgggagaaggtctaagttggtgaccagatgtctggatctttctagctggtatctccttgcacccctggtactagctggaggcatgctgcatatacttggagttggtgttcagctagccctctcttactaatcttgaagaagagagggctggtttctgttgttttgaaacctattgtctcttcaggcttcctgccactgaccacgctctcacgacaacctgaaagatgtagagtgggttttggtttagttgttaacagttaccattcctgctgtcccaccccaggaagaacgcatatgatggttgctggagaatgtctttatttccttcacatttaaattctatctgcgtcatgcccaggggtagatcattttagaaaggtgcctgttttcacaaaagggactgttgctttcctccctggtttgtttatttccagacatggattgattaaatccaaggaacagagggggagctggcatcagataaaaaaaggccctgttctt

SEQ ID NO: 52276 - DNA, 1040 bp, Homo sapiens
cctgctttggtgtctccaccctcaaagagaatagaagccacagagaccacagcctcagtgtggggactcagttgcgggtgtttcctcccctagaaggctgttgcctaagatttgattgagagctccccacacttggcaggcaggtggtcaaaacagttcttactcacaagggggtctgaatttcttaacttggaatcttctttaattaaaggctacaaccagggcaattgtccatctgttttagtggtaacttttacagaagaaactttgctatattgattagtgcccgccttgatagatgatcaataattgtgcttttatctggcatcttcttgggagtcagctgctgccaaggtgaaccttctgggcaaacaattgtcactaaatagcaaccattttcaatggccaaataaaaggaagtttttctctcctccttccacctctgccatcttcttaagcatcatgctaaacacaaatcattcttgctggcctcgtggtcgccataaaatccactgtgcaatgcagcgatgtcctgttggggctgatgggttgtatcactaagactgtttgcttcccaatgtttgttctttgtgatctcatcttattttttatacaacaaccttgtgttgtagctactatttaagtataatttattaatacatatagcgaaatgcacagatttttttttttttttttttttttttgagatggagtcttgctctgtcttccaggctggagtgccgtggcacaatctctgcacacagcaacctctgcctcctgggttcaagcaattctcctgcctcagcctcccgagtagctgggattacaggcacctgccaccatgcccagctaattttgtatttttagtagagatggggttttgccatgttggccagactggtcatgaactcctaacctcaggtgatccatccgcctcagcctcccaaagtgctgggattacaggtgtgagccgcacccagccaaatgcacagatcttaaatatacagtttgctgtattttcagaaatgcagaaaaccgtg

SEQ ID NO: 52277 - DNA, 1066 bp, Homo sapiens
attttgtctttactcagtgaccacaagcacacaggggccaaatagataacaccatgttcctctcagtttctgcctggaatcctcgacttgaacggtagcattcacttgaaaccaagccccgaccattgaagggagagtcatttggcaaagttcctgctgaaactgccatccacttatgtctaagtggcattctggctccagccatccttccagatttccccgatatctgagccctcactgctgccaccagagccgccctgcttcttggccctgcctgggtttgaagacagctcctcagctgggctgcatgtctaaggaggtcttgaaggctcgatgccacagcagtccctgtctctggcaacaagtagccttggcttttgctgtcttgcccaaatcactctgagctttcttcagtggtgtgagcatcttgaagaatgaatgttgaggtctgcctatcccccagggtagcaggtgagatggggccggtgcatgtctattccagttcactgttgcagaactgagaaatgtgcggggactttctcctctgtgttcgctgcgttttcagcagccagtgctgggcacttagccttcttgcataggtgcggaaagctaaccggagttcctgttccttcctccgtgctggtccccgcagggcttgtggtggaggaccctgtggccatctcaccaactacaccgaaacgcatctgacttctgacgccacgcccgtgtgcggtgcagcctccctgctgggcccaggcctggccgcttggagatggtgccctcatcgtcctgggccttccaggctgcagagggtgcggggagcactgaggaactgcatagatggctgtgggaggtggtggcttttaaaaaattgtggtaaaatacatataacataaaaatatatgttagccattttaaaatgtacaactcaatggcactaggtataatacattcacagtgttacgtgaccatcaccactgcctagtttcacaactctgtctccccaaatggaaaaccatacccattaggcagtcactccagacccactacccccagcccagtccct

SEQ ID NO: 52278 - DNA, 1051 bp, Homo sapiens
ttcagctgatgggatggtgcttacctacattgggcgagggcgggccttcctaactcaacccaccaactcaaatgttagtctcttccagaaacacccttgcagacataccctttccagtatcctgaaaagaatactttcccagctatctgggcatcccttagtgcagtcaagttgacatctaccatgaaccatcacagggagaatcccttcgagaggccacctgcatctctgcattccttggctcatggccaccttcctccatcttcaaagccagcagtggtggagtctttttcacatctcatcacttggacactgattctcctgcctctctgtcctacttataaggacccttctgattgtactgggcccaccccgataatcaggctaatctccctctccccaagtcagctgattagcaactgtaattccatctgaaaccttaattccatcttaccttgtaacccaacattcacaggctctgaggattagaacatttgggggccattgatcttcctgccctaggcaaggggggctgtgtgtgtttgaggtgatgggcaaaggccctgtggctgaagcgtggtggggaaagtccaagaggcaggtaggtgttttgaggctcagtgccatggggctggcggttggaggctcttacacagaggaatggcatttaatggtttgccttttcaaagggtggccctggtagctgtttggagaaaggatgggggtgacatgcggggagagagggcagctggagaccattacagacagtcagatgacagccagaggtgaacggggagggggaaaggaggtgagtcagagatgtcatcgccagaaatcctgttgaatagatttgggtggggaggaaaggagacttgagaggacttggtttctgatatgagccagcagcaggatgacagcgctgtctcccgatgcagggaagacgatgaatgggaagcccggggcaggcggagcacctgcgaacacttagtggagtatgctgtgcccaggtgctgtgccgagggccttggcattgtaactgatccttgcagca

SEQ ID NO: 52279 - DNA, 1079 bp, Homo sapiens
tacagatgttacacctgccgctaggctttgggggaatattaaataagctagctaaagaacatggactcagccgggtgcagtggcttacacccgtagtcccagcactgtgggaggccgaggcgggtggatcacttgaggtcaggagttcgagacaagcctggccaacatggtgaaagcccatttctactaaaaatacaaaaattagctggacgtggtgacatgtgtctataatcccagctgctcgggaggctgaggcaggagaatcgcatgaacccatgaggtggaggttgcaatgagccaagatcgcgccactgccctccagcctgggcaacagagactctgtctcaaaaacaacaacaacaacaattaaaaagaacttggactctggggccagatggtttgcatgtgcatgctgctttgccactgcatgaccttgggcgagtttcttaacttctctgggcctcagttttcccatctataaagtgggaacaataatggtaccgccttcacaagattgttttgagaacaaaatgagttcacacacatgaagtgcttatattcatgcacagcacataggaagcattcatcaagcgtcagctgcgatgaggatgctgcaaaacccttagaacagtgtgtgctgctcccattttgattggggtgggcgtccaagtcccctggacccaggaagccacatgaggacttcagggctttcccagccctgattccccctgttttttcccccagccctcaaatgcccatggcagaaatcttgggtgagccaatcattggtaggctgtgtacctctcacaacttcatttaagcagcttacactggaacttttaacaggaggaggtggggaaggttagggttcacaatcttggaataaatcagcctcctgccaatggccaatgggggtcagctggccagccttgaaagtacttaacagatatccatctttccaataaatctgtgtagtccgtgagaaattcatcctcccttggcagcaggggaaattgtcaaggggcacagagtcctggaatgtcaccccagaagggttctttgatggcgagtccaacccc

SEQ ID NO: 52280 - DNA, 1031 bp, Homo sapiens
cccattccttgcacatacattatgccaggcaccatagctgtattcactctctttctaaaatatatatatttcttaattaattcagacggggtcttgctgtgttgcctgggctgatcttgaactcccatgctcaagtgatcctctcaaagtgctaggattacaggcgggagccactgcgtccagcccatagctgtattccctttgtctgcctcacagcccttataaaatctaaattacccatcttatccccattgcacagatgaggagattgggatttggcaagtttgaggacttgcaaagtcttaatcccagttccgctggacttcaaaacccaagccataaactaccatgctgccatgtctcccagtgaccacatacagtggccgccaagaacacagtggggtaggggaatggtctctgggttggtgtgtgccacgtcctgtacaccactgcccccagtggaaggccagggaaggcatgtgattcgtggtcagggtctgcagcctcccatctctaggcatcatcatttattagacatcagctgagtactcaggggtcgaacagaagactcagatttccctcttttcttccaccataggaacatcttttatgcgtgcctaataacctaaaaacatctacagttcacccttgaacaacacaggggtaagaggcaccaaccccctgcacagttgaaaatctgagtataacttttgacttcccagaaacttaactgcttattagcctactgttgactggaagctttaccaataataaaaagttaatacatattttgtatgttctgtgtattatatactgtattataataacataagctagagaaaattaaatcttattaagaaaataaaggaagagaaaatatattcactgtccattaagtgaaagtggatcattataaaggtcttcatcctcatcattttcctgctgagcaggctgaggaggaggaagtgggggttggtcttctgtctcaggaatggcagaggcagaagaaaatctgcgttggctgggtccag

SEQ ID NO: 52281 - DNA, 1020 bp, Homo sapiens
agaggcacgctccctgggctctcccaggctctgagggtcggggctgcagctcttccttctcctccaaggagcaaagccaggcagctcctcagggcccatccccccaaaacataccagagtctacagctcaactcactgaaatggggaggaagcaaaaccctggagggaggatcccagggatttgaagcagttaaacagaagcacaggctttggcaccagggggcctggttcaccattttctggctgtgtgacctggggcaagtgaattcacctttctgtgcctcaatttcttctggaaaaataggaattatagtacctacctcatagggtagttgtgaaaatccaattagttaatacactgtgaagggcttaaagtagtaccaataaatagcagtggctgtcatcatgattaccattatctttaccattagtattgtcaaagctgcccagggaagcaggagagttgggtggcatctttgcgtgccagtgactgcctatgtagcgttggacaaatcactttcctcacccttccctgggactcagactctgtgaattgaacagtttggatgaatttgtgctgctcttcgccaggaggaagcatcagaattgcctgcagggcttttgcaaatgtagacttccatgttccgtctccagaaattctggttcattgggtctggagctggcccagggatctgcattaaaaatagcatctctgttgatggttctgatgcacaacccaggttgggagccacagttaaccgggttaggatcctgaagtgattggtccccttccctcactcccattagctcaggtggtgttttagcaaaggggaagctcctgccctctctgtgggtgctgaggctgttgcctgggtgggggtcccactttactaggtgtggcaggtcaccagttccacaggaagcagtggtggctggagaacagccctgaggcgtgagtggagccggcacatctaggagttttcattcagctgatgtttggtgaaagtgggatctgtaggc

SEQ ID NO: 52282 - DNA, 1049 bp, Homo sapiens
ctcatctctattaaaaaaaaaaaaaaaaagccaactgcggtggcatgtgtctgtactcctagctattcaggaggttgaggtgtgaggatggcttgaacctgggaagtggaggttgcagtgagctgaaagtgcgccactgcattccagcttggttgacagagcaagaccctgtttccaaaaaaaaaagtaaaattcttggtttaggttttggcatgaaggctgtattagacacataaccatgatgatcatggaggctgctagacccagctcagattactacccagtggactagctggatgaccttaggcactagtcatttaaattcctcctctgtgaaccgggtttaacaacactgctcagggtggggataaggaacaaacagactaagtcctgcctgtggatagactttggaaatggatacttcatgtccttgtcgtagtccagggcactggtggtatttcctctgccaggtgatttgagaactcctcacgggtccccagtgagaggcggtgagcgactgtgtgaaggaatgagacagcatgggaggtggaggaggttggtgtctgcacccaccctgcccgagaacgggacagtgggggatacgtgcaggacaaaatggccttgcccccgactccaggctccagaggctgggggtgagcattctctacccccatcccaaagctatggcagaggaaccctgcagcaaaaggacacggagtgcccatggtattctgtgtgaaagtcactgaggccagagacagctcttcacatcctgtgttgctcaggccttccccaccctgtccccctgtggggtctcagccccagttctgggcagggagtgtgggatgcttaggagcggggtacaggctgagcctcagccaccctcacgggaatccatcctgggcccctggccctggccagacaagctggcagattgcccagccacatccaaaggcaatgcatgctctgagcacagagcctggccgaggacaccagagagcaggagagcgtgggggccgtgcagacacatgacaaggctttgataacac

SEQ ID NO: 52283 - DNA, 1035 bp, Homo sapiens
gggctgttaaacagggcggtgatgtgatcattatgctcatctttcatgtatcagcctccagtaagagcattctattgggttccaggaagaatccctaaaaaatatctttccttccagaggcttcaagaaacctttgcctggaaatattcagcctcagagcacagtgctatgtcacccaggaaatagctatcatgggaaaattcaaggaaaatattcctgctcaaggaaaaaaaattaaaacacgacacacgagaaacagaccagatagaaatggagaggtcccagtccgtaaatgggttttatgccgccagaagacctcatcatattagacgatctggttttaaacaataaactttgggtaatggggatgtcactttaattcatcttcctaaaaaacccatgtggcaaaaacattccagttgctattgctacattgcaaattactccaaaacttgggggcttaaaacaattattttattatgctcacagattgagtgggtcagtaattcagaaagggcacaacaggggacagcttgtctctgtgcagtcatgtatagaccctcagctgggaaggcttgaaggctgaggctgactcgacagctgggtggtagtattatctggaagctttttgagtcatgcgttgcaattgatgctggctgttggctagaacctcagatgggactgtcagtcagaaaactgatacatggctctctacatgttttctccttgagagctagctatcttgggcttccttacagtatggtggctggttccaagatccaacattctgagaggcaggaagtggaagctgccagtttcttaaggtctgggccttaaggtcaagccaggcacagtggctcacacctgtaatcccagtgctttgggagactgagatgggaggatcgcttgaggccaggagttcaagaccagcctggacaacatagtgagacccccatctctacaaaaaaattttaaaagttatccaggcatggtggtgcactcctgtagcccctgcttctcgggagttcaaggatg

SEQ ID NO: 52284 - DNA, 2032 bp, Homo sapiens
cattcccaaattcagttgctgctgtttttggtcttctctgagctgtcttcttctgaacaaaatgttttataggttgactctcaaactttctcttacttgccttttggaccaaattagattcaagacccttattgctagccccctcctcccacttgtgtcctcagatcagaaggagctgggtcagtgaataagaatgggaaagtaccccagtcagcaaaggttcagatatgtcaccaaccaaacgcagtccctcttgtttttgctttgaaggttgaatagtcagtcttggctcttatatttagcttaatcaccagtaaaacaccttcatgatgaatgtatataagttcactaggatttcaagcaactattttccaggtatctaggaccctcttatatgatgtatcagataacttgggcctacttcagtctggagttggttttgttcccatgagtttcttatgtgaatgttttgctctaattctggctctcataaaaaatcatctcccctgaaggggagacccggtggtaggaaatcccaagcacaccttttctccagaactatcaagggtcagaatagccaagagtcatcagtcacttcccctgctgaccctctggggaaatgctactaagaaaacagggccagaaggcagaagcttagccaccagaggccaactctaacagactgatggtcctttactttgcccatactttatagctatttcaggaaatagtaaagcattctagttaatagatgagatctggaaccagctagtttggttctgaactctggattcaccgcttacttgctgagtgactagtgaccttgggcaacttgtataacctttctgtgcttcaatttccttatctgtgaaagggaattgtaatggcacctacctcgtaagattgttgtgaggattcaacgagataatgtattcaaaagatatacagcactacacaggaaagagtaagtactcaagctattattgtgtctctaggaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaatgcatttgctgtgtccatc

SEQ ID NO: 52285 - DNA, 1148 bp, Homo sapiens
gtaatataaaatgtgtttaagaaaaaaaacagcccaggcttcccagcagtagcccatgtgttggctggttcagcagcctgacctctacatctagacaaggaagtgaggagggtgattgctgggcattggtgtaggtttatgacggagcagcataagattttccgtgccctgtgaacatgtatacaaacattcatagccccttcccctcagccctgctctgctgcaaggaagctgctgagtgagtgacagctgggcacaaagtgtcttgtgagaccagctatagggtctaatgcagtgaagtcagtcatttaggacctattttcacacaggggcaaggaaaaaccagaaacaacttctctcttaccctttaaactaagatacttcattctacacgattacctgaaacaaatgtctcaggtcaaatcacaagccttagcttctgctagggtttgaagtctgggaaatatataatccagctcttctctttcagtccaagctctagcttgtcagcaagactgttgcagaagatctatccttaagaggcagaaacatctgcggtgaggaaggcagctattgaaggtattccaggagcatgagactgagtttgcagagctgagggttgtcaatttccttttctactgatatcttcttcctttagagcaaacttcctccttaggacctcagagataagcacagcagggtcttcctccttcaataaactccggttcctagagacacaataatagcttgagtacttactctttcctgtgtagtgctgtatatcttttgaatacattatctcgttgaatcctcacaacaatcttacgaggtaggtgccattacaattccctttcacagataaggaaattgaagcacagaaaggttatacaagttgcccaaggtcactagtcactcagcaagtaagcggtgaatccagagttcagaaccaaactagctggttccagatctcatctattaactagaatgctttactatttcctgaaatagctataaagtatgggcaaagtaaaggaccatcagtctgttagagttggcctctggtggctaagcttctgccttctggccctgttttcttagtagcatttccccagagggtcagcaggggaagtgactgatgactcttggct

SEQ ID NO: 52286 - DNA, 1084 bp, Homo sapiens
cacacttagaacatagatatttagcattccgtataaatcacgattactgttttcaaccagaggctaatgagtgatctaagtttatactcttgagttggaaattatgcagtttttatattccttaaattgacttttaaatttacttaaatgatcaatcagaggaattctgaacaaagcttggtttaaggagttacgcccatgtagggcaaataggagcaagtgcaagtatagttgaatacaacaataggttctgagcaatatctaaaccaagaggacaggatgaggcttgtgtgcagtggtgcagcacagttcatcttggctcctgtctctggcacatagcaggtgctctgggatctttaaaataccagttctgaatagatgggaatataaagagggcctgagggtagaaacttggcataatgatacgaggtgtcctacaagtggcagtgagcttttgttcatctaagacatttagggagggaaactggcctcaggagaaagcaagggaaggatcaacaggcctgaaaggatgcctcatcagttaccacccatcccatggtggccctgacttcctatcagagggcgatcctgagcccctgccttgtgacaggcttaagtcacaggaaactgaaggggatgcatcttaccacagaaatagaagctctggcttttctatttcaccttgacctttggagaagcacttagtcctgggcccccattttctcctggataaaatgagatggttgggggagatcagttaagtaactttcactcccccattctttgcatctggcttggagtgaagaggaggagcggtggcacctacgagcttctggggaagtgtctctgggtatgcattcccgggcccggcattctctgccatcacgggagtctgcgtctgtcccagtggggccagcctctcccagcagtacttccaatagattggcctaataaggccagagtggtttgacaagcagttggggctgtcaccaaggagcagactccattccttttgtcttgaatggaaaatgaggcttgtcccttcctgaggattttgtacttgggccttatggttgactgggct

SEQ ID NO: 52287 - DNA, 6895 bp, Homo sapiens
gtcttaggcacccatgtgggtggcgcactagaaggggcactgctctgtccgagtgctgcccttggggcgaggcgggcatgtggctctacaaggtggagtccaggcggccaaagtttggaaaggtagggaaggacccccccgccctccgcctgctccgccctgcccttgttctcgagaatggggagctggttcggacctagtccggggtccactgccacgccctcttccacggcgagaccacccccctagtcccaggcccacacctggggatgctccccaggcgccctgcaacccccggcattgtcctcctgccctccgggacaggactacacttcccgaggtgcttcggggtcccggggggcggcgctccacgcgggttgtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggtgggtgcggggctcggaggaggcggcggctggctgaggccagcaagagggacgcggtcggcgggaggggctgggccgtggcagcgaccccctgctgcagggcggcgggcggggctgcgggcctcggaggggttggtgggcgggggtcgctccgctttgtgtgtggctcgggcggagcctcgcctttgtccccgctctccgggggcgcggctgttcgtgggcagggggctgggcgatcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccagggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatcatattcaggtcatatttcccaatgtttatttagtagattttgataatttttttcgtggttaatttagacgtctttattccacgtatttttctgacgatgtatgtagatgtgatgtgagatttttttgggttgatgacatatagaaaggcaaagaaagtgattgcatgtttttgaaaatcattttcaggactttccttatcccagttgattgtgcagaatacactgcctgtcgcttgtcttctattcaccatggcttcttctggtaggtaatctatttggaaaatctgaaattgtaatgggcttatgattttagattgagatggctcaggtcttcgcctttgatttggcacttatgttttggtcttaccaaaacctattttatgaataggagaagaatttaaaaatgattatcacttgaatgtgccgagagctcgtaattgtttattggacagtttggcttagtctgaagcaaaattgtggagtttgcacaagtcttttgtttatgaaagcgattgtcagatactgatgtctcaaaacagtatttattaatccaaaaatgttgagctttgtttttctgggagatggtttttattttttttgagacagggtctcaccttgttgcccaggctggagtgcagtggcttaattatagctcattgcagccttgacttctggagctcaagtgggctcaagcgattctcccacctcagcctccatagcatctgggactatcgacatgggccaccacacccacctaatcaaaaaaaattttttttgtagagatgggctttccctttgttgcccaggctggtctcaaacttcagggctcaagggatcttcccatgttggcctcccacggtgctgggattataggcatgagccatggtacctggccttgggaaatggtatttagataataatatcttgcctgcaaatacatcttcccctagtgtcagtagactgataggaataaaaaggggaaaaaaaacacaactttcctcatcagccctagtttaatacattaaattgatttgggttttagaaaattatagtacagtttattagaacaggagaatcctggttttctgaattataaatataatcaattctagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattcttctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactcgggtggttaaggttggcagatacgtcatcttgtatccagaggctgt

SEQ ID NO: 52288 - DNA, 1086 bp, Homo sapiens
caccatgttggcctggctggtctcgaactcctaacctccagtgatccacctgcctcggcctcccaaagtgctgggattacaggtgtgagccatcgcgcctggccgtctctgtgctctggacactagccttttagttggatgacctgagtgcattcacattcctcacaagtgcacaacaaacagcctggattgagtttgcatttaaaacacatctgtcttacgcatttattgactttttggaagtaaattttcatttttatatttctgcctgttcgtttcatcttacacatcgtgagccttgattccagcctgtgtttggagaccttagggtcaataagagattttagggcatcattcttatcacctggcaagcagggaatggacccatgtctcaagactttaatggcgcctgactgcctggtcctcagcccccttcccctgtcccctcataggcaccatgtcattataaaagcttaagatgaaagatgatgggaagcccaccatggcacgattgggctccctttaaaagcaatacccgttgagctaagatactcactgttagaaacctgctagcagacatggaaatgggaggtaggaggcacttagactgaaagaagatttttgaggacttactttatgccaggccttctgctcctgctttatcgcgtgtaattctagagacagccctttccagtagatacctttattattaactgcattttacaggggaggataccaaagcgtaggaaatttaagtaatttctttaaggttatctggttatcaagtggcaaagccaatatgtaacctagactggccaattccaaggcccatgcccttagtcacttcactatgctggcggtgactctggtgacaattcagagtgataagttccatggccacagtaggcactcagtctttagactgtccacacggaggacagtctcctaactttgacaggagaggaagaacagctaggaaagggggcttccttgacaacacaatgtttgcctttaatcttagtggagggttcacaggcaggaaagggcgagggtcttctggacagaaggcataaatgcttgagtggg

SEQ ID NO: 52289 - DNA, 1115 bp, Homo sapiens
ggaggatcacttgagcccaggagttccaggttacagtgagctctgaccgcaccacttcagcctgggcaatagagcaagatcctgtctcaaaaaaaacagaaaaaagaaaacaggctgatatgtctctgagaaagtgaaatcaagactgggaaggcaaagaagccagtcgtgtgaagatctagaggaagatctttccagccagcaggaatagctaatgcaaaggccctgcagtggaaagaagcttgctgtgttagggtgggaggagcgtagtgagtgagggggaggcaatttaagctgtgatcagagagagaagcaggggccagatcacagggtcatctggccagggtaaggaggtgtatattttattctacgtatgatgggaaactgttgaagattttcaacagagaaatatcagtcttacattttaaaagatccttctggctactatgtgaagaatggattgtagcaggacaagactgaaagcctagaggctcattagagagattctgtttcagagtcaatgtgaaagatgataaatttacatcaggattgagatagtgggatggagagaagtgattggagtcaggatatgtcttagagttttcaggatttggtcatgtgggaggtgaaggaaagagaggaaatccaggtttttcttcttatttttttccctctgagacagggtcttgctctgttgccctatgctggagtgcagtggtacaatcagctcactgcagcctcaacctcctgggctcaagtgatgcctcaacctctcaaatagctgggactacaggtacatgctaccatgccctgctaattttttaatttttttttttaagagatggtgtcttgctatgttgcccaggctggtcttgaactcttgggctcaagtgatcctcctgcctcagcctcccaaagtgctgggattacagggatgaaccaccatgcccagcccaaggtttttcatttgtgtatctattatttgagtggaagatgattgtcctttattgagatggagaagaatagaggagcatttcaggggtctgaggaaggaaatggcaaaatcttaaggcccataatattgctcttggtgacatggttttgctgttggcacc

SEQ ID NO: 52290 - DNA, 1027 bp, Homo sapiens
tctccgtcttttcctgctaattccagattacctttaagatcttagtttggatgtcattgtcctagggacacccatcttgacacctatattatattaggttaatttttccagaatgtgctttcataagacaatctatacttctcagcatttaacataattgtaatgaattaattacttgtgtaattattctttaatgcctgtcttcttcactagattgtaagccttctgaaggcagagaccacatctgtcttctattgctctggcttctaggacagtgcctggaaagtagttgtttagccataagtatttattgaatgaatacaagggctgtgctgtgctaggttctcattcattcagcagacatctgtggagcacctgctctgtgccagccccttggcatgagaggaaggtgggacataccaagattaacaaatcgaggaaatcgcatctgctagaggagcaggaacatagactcctgtaactgtagcccatggcaggaagtggagagtaaatatggagatgaagttagaaaggcaagtaggtggtttttgatgctgctttcttgttcaataaattgagtacctgctgtgtgccggggctgggcattcagtagtgaagacgagagaattcctaccttcaggaagattatagtctagcagggaaaagaagcaaagaaaccttttcctcctaggccaacaggtatttatggagagagtaggtgagcactttgaggtggtccttttggtctaagaatctgtattgagacttcacacttcattagacctgggcgaggcagttaaaaatactctcattaaccagagtgaaattccaagggaaaaggaagggaggataaggaacattgtttcctctcattgcatctgtggttaattcaggctctgaaatccttcccatgggtcatggacctatggtttcctatcctaagttggaatatgtgcagttaaatacctaaccattctcagtgtgccattgtctcatttgattcccacatagccctctgaggtgcaca

SEQ ID NO: 52291 - DNA, 1001 bp, Homo sapiens
ggctggagtgcaatggcacaatctcagctcactgcaaccttcgcctccagggtgcaagtgattctcctgcctcagcctcctgagtagctgggattataggagcccgccaccacgcccagctaatttttgtatttttagtagagacggggtttcacttggccaggctggtctcttgacctcgtgatccgccctccttggcctgccaaagtgctgggaatacaggcgtgagccactgcgcctggcttagcttcccattttctgttgtgttcactcttcctagggaagaaagggagaagaaataggtgattaactgccctgagctgctcaggggccgatggtggttctccagaggggagaaacacatgtccccacccatacctatactcaggctgcccttgggataacagctttggggcagccagatattctatagcccatgtctctgctaggatcttgtcgcctgcctgttagctggaatggcccctttaagacaaaggactctggataccccttgatcatcttctcccatggcctaggagccttcaggtaagagcttctttcccccagaccttgccatactccttgcctggtgacagctgctgagtcttagcttattctcaaagggcaaaaaaaagacatttccatctgctagctgtcttatctcccatctgcttcgtcccatagcattgggttcaccttccccagaaggcctttttcaagtccttttcaccttgtggagcctttcagcagcctttatatgctttacttctcatggtccagcatttatataaataaacacttttagctttcctcctatgtgatagcccagaaatgctagaaggagcatgagctttgtgatcagagcatcatttatttatctattttatttttatttttttcagacagggtctcattctgttgcccaggctggagtgcagtggtgtgatcacagctcactgcagcctcaacctcttgggctcaagcagtgctcctgcctcagc

SEQ ID NO: 52292 - DNA, 1017 bp, Homo sapiens
tgataggaacatgcttctgggtggccatggggattatagcaagtgaaatcgtagtcgtgaaaatgtggaccagaacacagtatatactcagtaagcgtctgctgcatgcatacgtgtctgaatgaaagaaaagttcatccagagacatttctaatcaaagtctagaccagaggttctcaaactttgctgatcagaaacacctgggaagcttttacaaacgaattgatcactagaaataggggcccccagaatatacatttttgaaaagcttcccaggtgattgtgacaataggttcaggaacctaagatctagattctctatggaccactgttgcaggcaagtcactggttgaaaactgctagaataggtgttaatccaagagctgccctaaagtagtctaagattggttaccagataatggatgtggacagtgatcagagatgataggaggaaaggttggaaggacctgggaaagcttcacagaggactagagatttcactgggcctcagtggatggagaggcttctggacaggtactaccatgaactatttagacaaagtgagcaaaagaaggtagagacacatagactgatttccttggaaaattccatgacttttattagaaatgactctggatgctttgtgtaaatgtctctttggcaaaatttgcaactcagattggatttttccatctctccatcctatttggacatcagtcaatgtgagtccaggaaataaagattcatttgcgtgttagcttcactctggccaattagcttctgtaatttttatttccaaacaatttagttgatgatcttcccagaaactttccaggagcaccagagagttctgctgtcttctgtttggccatttccaagtccgcttatcctgattcctatcccaagtgctgttctctatgcagagtgagacaaaaatctgttcccataagaagcttaaggactattgtcctggttccccaatcttaaaacctgacttattggctcttgactccccag

SEQ ID NO: 52293 - DNA, 1046 bp, Homo sapiens
aggagctcaggattgaaatccccaccctgccacttcttagctgggtcaccttaggaagagttcatcccctctctgagctttcctcatctgtaagaaatgacaggtaaatctctgccttggagggtggctggaggactgagagacagaggctgtgataactcatggccagctgtgagttgcagtacttgctggttggattagcaattgaggaaactggtttggaaggggttaaatggagaccctgcctcccagccaggagcgaatcagggctgggaggggaggagccaggctgctgctaaggaaagagatcaggatgggccagttgccgactggagagggatgggaggagataccatagggtttggggggcttggcacagcggccctggcctctgcactgtgatagctccaagccagatggtgcaaggcagctgctgggctgcggggaagaggggctgcacttcctgagctggtgcagcggcagagtggataaggatcaggaccccgagccctcctggccctccaaggcagggggacaccggctgcacccaggctgtgacctcagctgacgccgatgatccacatgggatgcagggtctaattttagctccagccacaggggccacagcccagaagcgtctgccagcgggcacaggggcagccagggctgctcaggcaaggggaggagtgggaagaccagcccagctccctccagcctgtccctggccaagccgcctcctgtgggagctctgactggtccccatggcctggcagacagccctcctctcagttgagggcaaggtcaaggggtgcagccaggagggcagggggacacggccctgcattctggacaggggttgcgtcagccagagcagtgcccaggggcaggggtccctgctgggagggaaaaggctggcttggttgtccaaaggccgagaaggcagagtcctgagagcaggggggccaggccagcaagctgggtcccacctggcctcctcctgcctggctggtgactcactatctgaccttagacaggcggcctggtct

SEQ ID NO: 52294 - DNA, 1083 bp, Homo sapiens
agtagagaaagccatctctggagagatcaaggagggtttcccagaggaggtgatgtttcagcttagacattaagacagcgtagaagaaggccaggtgtggtggctcatgtctgtaatctcaacactttgggagactgaggcaggaggatcacttgaggccaggagtttgagacagcctgggcaacacagagagaccccatctctaaaaaaaaaaaaaaaaaaagccagcacgtgcctgtagtcccagctactccagaggctgaggcaggagaattgcttgatcctgggaagttgaggctgcagtgagctgtgatggcaccactgcactccaggctgggtgacagagcaagagcttgtctcagaagaaaaagatgagtaggaggacttcctcaggctgacaaggcagggaggggccctccaacgtgagggagaagggatcttaaaggcacagaggatcaagggaggttaaggctcagtggtgcagttgattcagccttaacctagaggttttcaattcattagaggttgacttaagggtgaagggggctgtacctggttggcttctgctgtggcttttcatgaggtgaagggtgtcctgatgcttacttgtggcttcttccaaggagggcctggtggacacttaagcatggagggaggacaaagaaggctggggtcccctggaagacccctaaagcagcagctctggggtggttcagataactcagggtcaggagctggcaaatctctgctctagtcccagctccactcaaccctatctgtgaccctgagccagtccttgggtctctctgggcctcagtttccccatctgttcaatggggcatggccccgaggctgcctaagtactcccaggtctgcttcttggaggttcaggctcagagccaaacaggctgtaactgaggagggtcctagtaccctctgggccctagtcatgagtcccacactgagcaggcctgtgtcctggtccctccctttatccctcccctggctgggttgcaggcaatggtcccctgggtggacaattgccaggctggctctgaggaggctgggactcctgccctcccc

SEQ ID NO: 52295 - DNA, 1085 bp, Homo sapiens
cagtatgggcgcgctggggccagcctccccttggacgtcccgtggctcaccacctttgcccctgcgagtggtagaacatttgctgaggattaggcccaaatacagcccttccagagctggcccaggagctggaagagcagggtcacactagctttatacccgctgagtccccaccctggctgtagtcagatgggaggctgggaagagctccattcctggagtggggcagaggtcaggagggggacctggtttacaacacagctggggtaggcaaagtcctggctgggcctgggggacactcagtccagccacctgcaggtcctgttcatgccccagttggtgcctggctgagcagtcagtctgaggggccctggcatgcctgacagtccttcatgtcctccgagtagtcctcgatctggatggtcacggtgtggaagtggaacttcccttggaggcggctgctggctgtcttcagcacagcctgggcgtctgtattctgagctgggggccgagaggacacagcgggggaagccatttactctggccctttggaaccatcaggagcccaaatctcataccccatccccagcagaacaggatgggggaccatgaacatggagaagcccccagattccattcctctgccaggtagcctcccagcccagacctggctcatgcctgaaagagctggtaaagcactggccttaaggccaggaatctgccacctactgccatatactagctgtaaaagcctgggcaagtaactttaccacccaaccccagcctcagtttcttcatggataaatgagattgtgctgatcagatggaataatgcgtatcaagtactcagcatgaggctgggcttgatgcatgggcactgtgagcatctggggtcacctggacccgttggggatggcactaggcctttggctgcctgtctcccaccccaccctgagtgtcccaagcactcaccaatggcgatgtggacagacagaacaggctgggccaccgtcagtgcccagatatgcaggctgtgcagggcttctaccccctccaccgacagcagcagatcacgaacagctgtg

SEQ ID NO: 52296 - DNA, 1121 bp, Homo sapiens
agatgaaagcgataatgatgaagatgatgatcgtgccctgggtgggtccaaggattctcaggatctgttctttccttctttccattcaaaaatatatttattggccaggtgcggtggctcacacctgtaatcccagcactgtgggaggccgaggcaggcagattacctgaggtcaggagttcaagaccagcctggctaacacagtgaaaccctgtctctaccaaaaatacaaaaattagccgggcgtggtggcatgcgcctgtagtcccagctactcaggaggctgaggcaggataattgcttgaaccagggaggcagaggttgcagtgagccaagatcacgccactgcactccagcctgggtgacagagcaagattccgtctcaaaaaaaaccaaaaaatatatttattgagcacctactatggagtaggtgctgttttaggcaccaaggatactgtggtaatcaaaggagactgtcctgccctcatggagtgtccattttagagggagaaactgacaataagtacattcataaataatttcagtgttaagagtggagaggaaatacaacagagtgatagggcagagaccttgggaggtgaaggcagcctcagacctgcaggccaaagaggtcttctttgaggggatgacacctgaggatcaggagccagccctgcaccaatgggcaggcgtgggaggggtagtttcctttagtttcccctgtccttgccgtcctcagggacccccaagggcgttgacttcacagctgttcgtgatctgctgctgtcggtggagggggtagaagccctgcacagcctgcatatctgggcactgacggtggcccagcctgttctgtctgtccacatcgccattggtgagtgcttgggacactcagggtggggtgggagacaggcagccaaaggcctagtgccatccccaacgggtccaggtgaccccagatgctcacagtgcccatgcatcaagcccagcctcatgctgagtacttgatacgcattattccatctgatcagcacaatctcatttatccatgaagaaactgaggctggggttgggtggtaaagttacttgcccaggcttttacagctagtatatggcagtag

SEQ ID NO: 52297 - DNA, 1089 bp, Homo sapiens
ctagtcctaataggtgacctccatctgcgacctcagtgagcccttggctttgtctccacttccatagaatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaaggtcagagctgggacacagggtggtgggggtggcaggggagtgtagaccacctgagtatactctctaccggggtttcttttcagattctagctccctcccagttctagggaaaagggtggggagaggaaaggaacatttatccaatacctaccaagtgtcagcacttctgatcctcacaacaacctgaagggtaggtggtagtgttttctgtagctcagaaaggttcagtgacttgcacagtgtcacacagccggtaaagcatagagccagattcaagcctacgactgtgtgttgtcaaaccctgggcaatgcccatcacatagaggcagggagctgtagtggaaagaggcaggcatttgctctgaagcttggctctcctccttgctagccatgtgacattggatgagtttgcttgctctaatggagcctcaatttccccatctgtcaaatggggacggatggcggatcagatggtatctaagatgcctttttgctctgtccatgtctcagctccttgagaaggaggggtgggaagggactgccttattctgaactgtggtctgtcctttctgctcttgcagatgtgaaataaagagcagaaaactgggaggcagggccagggcgaggctcatgcccacccagcagagagagcacctctccccagcagtgctgggtgggaggggagaagggaagctgaggtgttagatggtgaactccaggtctgccttcctgtcttcctgcagccagaatacaagtatgtagaccccatctgcaccttcgtcttctccatcctggtcctggggacaaccttgaccatcctgagagatgtgatcctggtgttgatggaaggtaacctgggctt

SEQ ID NO: 52298 - DNA, 1028 bp, Homo sapiens
tttcatcatagcattggctattaaccccttgaatccccgtggctcacttgctgggtcccatccctgacccactagcctggtgccggggggagaccaatttctggaggaagctctgggtacccagtcttgccctaagcctgcctctgaacaggctgttcttgtttatgacccccgtcccagcagaatagtgattgctcatccctgcatgtgatttgagagggccagtctttcaggcctggaggaaactcaagccccaccagccgcttggcatcggaatgctcagctggtcccctcctggggctcatgtgaccaagatctagctataaatatcagaggggcctcagaccaagacagaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggtaagtgccgggtgcagcttcatttggggtccccaggtggctacttggcttccctgtgatgaaacccttctcccttagacttccaacctggacagcctctttccccttggaagtgaacccctgcagaggcctctggacagggctgagagggggctgggaggcggctctggctgctgcggttcttctccataacacaagtttcccctccctgccctgcccacagctcccccacccctgccctgagcactgctgttgactctccaatcaagagtcaaatgcctcaagtgataagcggggtaggcagggacaggagagagaaaccagacccctggggctggagccaggtcctggtggcaagaggcccagagctttgggaggagg

SEQ ID NO: 52299 - DNA, 1033 bp, Homo sapiens
ttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgta

SEQ ID NO: 52300 - DNA, 2030 bp, Homo sapiens
agctgcggcctcagggatccgcacgaccccagcccgacccaaacgccgagttcgaccccgacctgccagggggcggtctgcaccgctgtctggcctgcgcgtgagtcccggacgagcccggcctggggcggaggagggtccgcggtaccggccgggagatgtgaagttgaagccccaggcagcgcagagtcttctctcttgggacccgtgggtccgcccgcctcccgtttctcagacccggatcctggcgtcagggacaagctagggctagggagataggtgcacttgggagactatcacctcctcactctccttctcacttccattcctacaggaggtacttcatcgattccaccaacctgaagacccacttccgatccaaagaccacaagaaaaggtatgaaggagtaaggagaggattgatggatgggtgctcagcagatagggctctcacctggtcagctcccaactcctgtttttctttctcccaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacttgcctccaactctaacttccaggccgctgtctcaaactcctgccctggaagggcttctctactactttctgtacaccaggcctagggtgtctactccccacttggtctatctctgccttccctctgaggtcctagcatctgaactggagcacccagatggaggcctgatgcagtgtggggtggcgggagtgggatcagattactctgtcctgcttctgacagagactgatccccagaaaagaaggcttctgagattgcacccccctcccgagtcacctacccccagcatccaagtgagagtctctcttcttcgttacggggcccgtggcacccgccgctgccccaccatcttccagacggcatagcaggagccacccaggccgaggacagctagcactgtagccacaactcctgccagcagactccggggctctgccttcagctcaccagctacctgcatctggaggtgcacagagggtgtgcctcaggggtcagttgagactgccaggaaggtggggagtgggaaagggctgagtagatgtagctaggggaaggagacatggacgccggtcctgccccagggagattccaccccaatccctttcgcctcactgcccatctgggcctgcctgctcaggcggcagggaacgtgacagcctggctgttgggggtgtcaacccagctatggtagggggaggaaggggtcagtcgtgccagaaaccgttgatcaggggtacttacctgtaacacccggaagtaaccaggggtcaagcgtcgaaatcgcatggtgggcggcactggtctccctggcggcctgtagggtgggagcggacgtgaagaccagtggtcttcatgacaccaagaagtggaaactagggtagaggggtctctgaccttccacatacgcaagacccaagctctcagaggatgctcacccgcgcctgcctgcccaggtctggcagggggcggagcaactggacctttaaatctggtcccttcccccactgcctaccatcctgccagccttagaagcagctgtcaaaagagatcagcatcaggcttgagcggcacctcccccactctccgaggaggcgggtccggttaggcaggagaggccttggctggcagtgctcaggagtcccaggcctggaccaggtactgggcgggcctccctcagccctggtccaggccccatcgctaccttagatgattggatgccaccaatcagcattatcgaa

SEQ ID NO: 52301 - DNA, 1030 bp, Homo sapiens
tgaggctgggtcccactcagcctcggtgagtggggggctgccgggggtaggaggtggggataaacaacagggcgtggagctcagacagaaaccctctgtgctttccaccctgcctgcagcccagccctgctcaagctgggagtcccctccatggagacacatcacctgcagccacccccacacagcgcagcccacggacctcctttggctctctgacaggtgctgggctggagttgggagctgggctgggggctggggtgggcacatcctcatcctgctcttccctcccacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggtcagctggggggctctgggcacagcaagggactaggctctgggcttcaggctttggtttgcggctgtcacctccaccctgggcaccagactccagactccagactcagctccggaccctgggcttagcagctgacagcgggctcagctgtggactgggccaggctctgggttccgagtggggatttgagtctcacctaggctcctcgtgccacgctggccaggtgctggcttccaggcaccggacctccggagtgaagtctggcctcgggctctgcccacttccctgggtgatcatggtcccttagcccctcctctccacacaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtccccccactccctgccctctgaccctgaagagcactcccatctctgccc

SEQ ID NO: 52302 - DNA, 1048 bp, Homo sapiens
agtaatttgttttaaagtttaaattttttaaaaaactttttaaaagtttttcagctttgtctgttgactgacaagattttttttattccagtacaaaggactaagttaaaagtgaagtcattattgccttttgttagtttaccttgtgaatggcatttgagatcctggaacatacatctcccagtttggttgccgtttctttctgcctgatacttttgatgatggtgctctctctgcttggtctcaggacaggccgagagcttctggcatagcattcaaactcaagaaagcttgctacttcaatttttacttatggaagactattctctccccagatttttgcagctcaagtggcagtcctcctttccagcccatcaaaagccacgtaaccattccaacagcccatgtgatgccttctactttagggacctctcctgccaagccaaattctacacctgttggaccctcttcctctaaactccctttgtcagggttggctgaaagtgtgggaatgacaagaaatggagacctcggtgcaatgaaacattctccaggcctatctagagatctcatgtatttctctggtgctactggagaaaatggaattgagcagtcctggtttccagcagtgggccatgaaagacaagaagaggcgaggaagtttgatattcctagcatggaatctaccctcaatcagtcggcaatgatggagacactttattcagatcctcaccaccgagtccgcttccacaacccaagaaccagcacaagtaaggagttgtacagagtgttgcctgaggccaagaaggcaccgggcagcggggcagtgtttgagcggaatggaccacattctaatagcagtggggtcctccctttgggactccagcctgctcccgggctctccaagcctctgccctctcaggtgtggcagccgagtcctgacacttggcatccccgagagcaatcttgtgaactcagcacttgtcggcagcagctggaattgattcgtttacagatggagcaaatgcaggtagaggtctatctttcc

SEQ ID NO: 52303 - DNA, 1037 bp, Homo sapiens
cacgcctggctaattttttgtattttttattagagacgggttttcaccctgttgcccatgctggtttagaactcctgagcttgggcaatctgcccaccttggccttccaaagtgctgggattacaggcgtgagccaccgcacccagcatattttcttttaaaaaatccttgtgctgctgaagagtgggaaggaagggagcagacatattccccttccttggttggtgaggacatcctagctcctggtttgcctctgttgctagataataaaagataactgaccttttcttagaaactagagcctttttgaacagggagtgttcagttggcagaagccttcctggcaggttctttccagtcatgcctcagagctaaaattatttcataaacattgggcctcatcaggctgagccaagttgggctttgactacagacccagctgattactgctcaggtgttttcaggcgtgtatgggtcaagatcaagctcatctgggcctacttgcctttcagcttcagaatggagccatctgccaccatcctgctgcttttggtccttcactgcccatcttagagccagcacagtggatcagcatcttgaacagtaatgaacaccttctgaaggaaaaagagcttctcattgacaagtaagagggcaaggggtaccacagagccagactactctcccaggccccattgaagacacctaatggagtcttcccaagggcaaagcattcctcctctgtttaggtccatgtcttgcctcatggtggaggtagtttgataagcagcctagtcgtgtatatataactaatataatagaccagttatgtatttctttaggggctctagggagtgcctaagggggtagccagttcattgcttctgatcttttcctcatttccccagttatctttctcatttgttcttcttccttcagaaaatagtgatatccagaatctaagatcttgcttacgtaatagggattgtacttagtaggggctcatattgtgaggggttagcatcaggaccctgacc

SEQ ID NO: 52304 - DNA, 1026 bp, Homo sapiens
taagaaccaggtgaaagtccagatgcctgggtgtgaagacatacttggaagaaaggtagatagtaaggtcctagagttgggtgatgttatgagaagtcttaattttctagccctagccaaaggagagagaggcaaaggtaatgcaggatttagagctattctctctctttttttttttttcccctgctctgtcacccaggctggagtgcagtggcacaatctcggctcactgcaacctccgcctcccgggttcaagcaattctcctgcctcagcctcccaagtagctaggattacaggtgcctgccaccatgcctggctaatttttatatttttagtagagacggggtttcatcatgttggccaggctggtctcgaactcctgacctcgtgatccgcctacctcggcttcccaaagtgctgggattacaggcgggagtcactgcacccgggcattctcatttttatcctccatatctaggagcagctgaagaagataatattctcactgagatcaatggttgtggggctttagagtttgaaaagaagcctgctttgttgaccaagcttctgcaatttgggcatttgaatgttggatatttgacaggttatagcactggctttgctacctaattaaggcagtatcctgtctcatagaatcagaatgttaagagtgggaagtgccttaaataaaactagttaattcttcgaatttactgattaaagaattgaaacctgagaaagaggaagaccttgcctgagatcatatagagaatgagtggagggaagccaggctttgagcccaggtcttctgatgtcttgtcctaggttccttccagtatacaatggcttaggtattgctttaaggcagtggttctcaaatgtgagtgtgcatcagaatccctggagcgcttgttaaaatacagattattgggacccatccctacagtttctggtttggtgggcctaggagttaggcttaagacattgcattgctaacaaattacatcatcaggtaatgctgatgc

SEQ ID NO: 52305 - DNA, 1048 bp, Homo sapiens
agatttcacggttcacattaagccttctctaatagcctggctaacagagttggctgagggactggcttgagatagagttcctaggggcgggagcatcttctctggttcttgaacagaaacttggatgctgatgattcagaaccagttgagggttggcttcctctccagtgctagagccctgtgggcccaacctacccacaggaagaaccaggcctgatactgatagtgggagaagtgctaaaagcctgttggcaggggtagggttggggaaggagggacactgcctatgactcacccatcccttccacacccacacactcatgcacagatactcttcctctccctgggcctgagttaatgtgcttacccatctgtctgctcagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactgtgagtcctcagaccagtctggggcccaggaaggagggtccttctttctcttctctcccccatcctgctttcccatattcttgtggtaatatgtagacagagtacatagtcctggccactgccctctggacatttatttgtttcacaaagtaggtgttcacaaatctgtttttggaaacaagctatggggtacttgcatgcaggacaaactaaaagtggaccttcagcagcaaattaacccactgtccccagatgctttttttaaagtgcatgtcccaagactgtgggttcaagatactgcctatccatactgcaccctccacatgaaaatgtctcataactaacattctcttgaaatgctcttctccccagcagcacagcacccagagactcagctagatttgcagaagccagatgtgatcaagaggaaactagaaga

SEQ ID NO: 52306 - DNA, 1045 bp, Homo sapiens
gggatggatccatgttcattcccacttcacaccttggtcctgctgattagagagctcatcagaggggcctggaaaggctgagcaagtaccagtgacaatggccatttaagaattctcaggccccatgtgccagccttcttgggaactgagctggctttctgggttttctcatgcctggtcttactgcttcttcctcagggctcttgttctcccagaagcctcagggtaatgtgttggttagcacgtaactactaggattggggccctagggattatagccaggactctaatctgcctaccatgccatttaacaagagatcccactctccagctgccttgtgtccctagggtcctggccatgtgtttagtgtgctaaactttctcctttgttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttagggagcatctcacacttgttagtatctggttgttgggccagccgtgcctcctctagatctggagccaggccaggcaggggccacgtgtgggccagtcagccactacaagatttttgctaagctttgggctgttggcagcatcttggacctcatgcctgggcctgaatgaggctctttcttaagtgtttttacaagtttgtgttttatttatggagtgacttatcccttccattcagagcagccccacccagccagcccttcagcctctgggctcctgctgcttaaaggcagagccgcctggttggtctcc

SEQ ID NO: 52307 - DNA, 1008 bp, Homo sapiens
aacagacttgagagtcagccccggctcccttcccagttcctcctctcaccaagtggcttgggacgagtcatttttcatctctgtgggcctgtttcctcatgtgtaaaatggaactaaataacccctgcctcagcctggcgtggtggctcacacctgtaatcccagcactttgggatgccaaggcgggcggatcacctgaggtcaggagttcgagaccagcctgaccaatatgatgaaaccccatctctactaaaaatacaaaaattagccgggtgtggtggctcatgcctgtaatcccagctactcaggaggctgagataggagaatcgcttgaacccaggaggcaaggttgcggtgatccaagattgtaccattgcactccagcctggacaacaagagtgaaactccatctcaaataaataaaaataattacccctgccttaagcctcagggttggcgtaaggaccatgtgtgcaaggtggagttgggcacagtagcaaacatggacagggtgcgtgttccaagctggctcttaacatggttacttcttggagccttacagccatcctaggaggcagatactactgtcatccattctagaagagaatgctgcagcacaagcattaaatgacctaaggtcacacagatagaagggaggaactgggatttgaacccagaaggcctcgatccagagctgggagctctgccctgtacttttcagctgccaacccagtgcctgacacagatctgggatcagatcctgcttctgctgcttactactgtgtttctcacaagccatgtaactttctctaaccctcagtttcctcatctgaaaaaatggaggtgattatagcctttatagataggcttgataagaagtgggaatggaatatggatagtaaacccctagcacaaaataagtgctcaataaaagacagctgctgttattatctagcgttgtccttttccccaggcagtcagttaaggagacattaagaccactgccca

SEQ ID NO: 52308 - DNA, 1150 bp, Homo sapiens
agggtgggtgtcgtggggagagttctcaagggacccctggcatgagtgagaggtgaggccctattgggtggctgcaggtgctctgagaatgtctatcctggatctaggccagaggcccacaagtgccgcaccctgggccctgctgtggcgggctgggctcaggcttcaggtaggcctgccatcttgttgcagggcagccttcctcctggccaggggggacctccttgctccttgccaggtggctggtttctggacctggctctgtggattcctactctgccctgtttggttgtttgtgctctgagtgcctcaagtcaaagtaacttgtgaaaaaccctgccctccatcttggaggccctggccatatctgtggtccctccgtgcgttctcttccttcttttgttctttgattttttcagcatgggcggggggccttgattcggctctttctgccagatgaatgacgtttttcgtcgctagcagcttctgttcctgggacatctctccggcgtccccgttcctctctccccaggtgccaccctgctccgcccaggggcctcaggctcacagcctggcccccgctggcctgcctgacactcggctgattgctctgctctccctctgttggagaggctcccacaggcgctggggtggaggcctgtggagggtgagccagggccgtctgtgccgagccagtggggtgatcaaacttcctggagcctgggactcctagggaggagggccggtggggccatgaaggggcttggcctcaggctggatcgctcactctccccctctctctgccagcgtcacagagcatgctgtgccaggtgcttcagggtctgtggagacatgaaagggacagtcctgctctggtcacacgccactggggccaggtgttgggcctcggggctgagagctctggtcagctctgaagttctcccttcccccccaccctctgcatctctgagctcctcactcctcactacttccctgttcccctgagaatcctcaccctctcatccccctctgaaatccccacttcccctacccaagtcagtccctgcctccctccatggctccacctctccctgccagcaccccacacgcctccctccttcctctcaagccccacactcctgagtctggg

SEQ ID NO: 52309 - DNA, 1033 bp, Homo sapiens
cacacaccaccatgcctggctaatttttgtatttttagtagagacagggtttctctatgttgctcaggctggtctcgaactcctggtctcaagtgatctgcccgcctcggcctcccaaagtgctgggattacaggtgcgagccactgcacccaggccctcagcttttcaatgtgatgttcctctggcctggattctcctctgtgtccactgtgccccagtgagctcacctgcactccatgtgtagacagttcccaaatgtttgtcaattaagatgcatttaactataagtcaaagaaaacccttcctcagccaacaagaacattaaggaagttttgttatcccacatgcaaagaaatcctaaagaggcagctccaggggtgttaattcagtgactccaagacatcatcaggggctcaggtttctccatctttccactgaacctgccttgacatgtcagcctcatgtggttgtaggatgatggccgcggttcctgcttcatacatagaaaggacactgtctaggggaagaaaaggaaaaggcctgcttcttcctgtaggtttctcttcttttccattttcatacttttttttttttttttttttttctgagacagagtccctcactctgttacccaggctggagtgcagtggtgcgatcttggctcactgcaacctccgcctcctgggttcaagcgattctcgagtagctgggattacaggcacctgccaccacgcccggctgatttttgtatttttagtagaggcagggtttcaccatgttggccaggctggttttggactcctggcctcaagtgatccacctgccttggcctcccaaagtgctgggattacaggcatgagccaccgcatgcccggccctggctactgttttctacagcaccccgcattctggctttgtctggcagtttgcccgtggggtatttgcctcactcctctatctgctgttttgcgtaccaactggacactagatttggaggtttgattagatcgagggtgaaattcttggcaatgc

SEQ ID NO: 52310 - DNA, 1128 bp, Homo sapiens
tgctaaagcctatgctttggaagccaatcatggaaggattcctggaggagttaatatttttccagcccttttatgttttctcacactgaaccctcacaaaagccagcatttggggattcccatccccgagaggaaactgaagctgaggaggattaagagacttgcccagggccacagtccctaagagccaggattcagagcagatgggtcaagggtttcttgggtacagtagagtccctgtggggaggaacaatgcctgatgacctcctggggcctcagatggcccccaccatgagcctacaggtgattggaccccctagcccaggctccaaggtggtgctgtgggccgagagccgcctgccgcgccagacgtggagcatcagtgaatcgggccacatctgcagccagatgttcgaaggccagatcctggacgtgaagggtaaggtgggatgtatggggaagagggctcctgagggggctgagagccatggagtcccagctctctctgactatctccctatcttttaatccccatcccacccccaggaggccggggctacgaccgggaccacgtggtgctatgggagccggatgaggacagggcatcccagatctggactatccacgtgctttgaaacttttcccctcaccctccagccctggaggcttttgctgggatgaatgtttttatagggtttttgttgtaacataagctattttctaatatgctgccaggtacccttgtctctgtgcaccttgatatttcggggtggggtggggatttgttcacttgccttcttccctgacgctcaggctggcttcttccctccaggccccagctttcgggttcagatgttaggcctccttctgccatcagagggcgccctgggaccagactaactggggagtgtagtctcgcgcagccacccaaatgaagtgttgtgagagcaggctctgagccgggtggggccctaggctgtgcgggcacagacacaaactgagcctttcggtccctgtccttagggaacgcacagtcccacagaggatcctgacaggtagggtgatgcatccatgagaagggaggaaagaagtagagggactcacacagcaggaacatcacccccacaa

SEQ ID NO: 52311 - DNA, 1011 bp, Homo sapiens
gccccagcacttttcagagccttccattttcctgtatggactcgagtgcttcgaggggaaggagatcgagctcagcagggaggtgcggagcctgcaagccgagggcttcaacaaccatgtgctgtctgtgcggatcaaggggggcatgtgagtgctgaggggaggcatgggtgcggtggctgctggtggggatgagtcatggcaagacagagatcctgggggtctctggcctctttcccctccccacttttcccccactcccctccaagccaggaaggagggagaagtgcggactgagaagggtcactggctctcagggcttagaccccagcttggtgggcttctcaggatccttctttaccctgaaaaccccaaatctacttcccagcctccctctccgccctgggaaccctattccaggcagaggaatccctccatgggagaagaggaggtggagaacgttttgacgtctgtgtctcctcctccacctgtctgtctgtctgtgtgtctgtgctcttctctgtgtccctgacacctgctgggcccagttgggtgctatgtgaacacagtgacttccggggccgccagtggctggtgggaagctgcgagatcaccaactggctgacctacagcggcacccagagggtgggctccctctaccccatcaagcaggtgggtagcgtggctggagctgagcgtgtctggggctgagcgtgtctgggcaggcctttctggatgagtgtctagctgtgtgtttcccaaacacagcatttgtgtacttttgtcacaacttttgccacatcgtcattcctcttgagccattgtctacttaatatttttctctagattaactctctttttaaaagtcttttaattaatttttatttcttaaaaaaagcttttttttctctttctttttcttttttttttttgtgtgacagagtcttgctctgccacaaaggctggagcgcagtggcaacatcctggctcactgcagcctccacctcccgg

SEQ ID NO: 52312 - DNA, 1045 bp, Homo sapiens
ccaggctggagtgtagtggcgtgatctcagctcactgtaagctccgcctcctgggttcatgccattctcctgcctcagcctcctgagtagctgggactacaggtgcccgccaccacgcctggctaatcttttgtatttttaatagagacggggtttcactgtgttagccaggatggtctcgatctcctgacctcgtgatctgcccgcctcagcctcccaaagtgctgggattacaggcgtgagccaccgcgcccagcccactttttcttaatttattcagctccaatcccctattgatggacatctgggctgcttccccccttttctattgcagaagtgccataatgaatagccccctgcatgtgttatttcatgttttcaaatggtgtccttgggatggattcctaggtatgagattgctgagtaattactcatggagttttgcctaatattgccaaattcccctccataggggcagtatgatttcattcagtcttttcttaggtctgacctcattccctgctgctgtagtgcctgttcatcccacctcccctgggacaggggatcatgatcaagtctgcattccctcttctgtatctcaggggaacctgggcaggccaaggacaggtaggctcagataccctccatttcttccccttccctagctggatcctgtttgatgagacgaacttcgagggtgaccagcacattctctctgagggcgagttccccactctcacggccatgggctgcctcgcctccacagtcctgggctctctccagaaggtatccctggtgagtttccatgtctggttccaggcaatcccggaagcagaagttgctgctgtgggacttctggacacagaacctgtgtgctggtgcaggggttgattccagtgtttttagaactgccccaggtccccttgactctggggctgtaaagccagtttagtttgctagctcttcattgagcacccactgagagaggacctggggacatggaaagaaatcagacacagccctgcctgtaaggaacccatgatcc

SEQ ID NO: 52313 - DNA, 1597 bp, Homo sapiens
gcaaggaggtgggagggctggggggtgccacattggcctgatgctgggcagagccattcctgagctggctgggtgtgtttgggtccagatgactcctgacagcccctttcccccaggctgtggtgtatgaggccccaggctttcagggccgcagctgggaagtgagccgagacatctacaaccttcagcagccagaggacagccagagcccccacctggcctctgtggggtccctgagagttctcggaggctggtgagaactcaggacccttccttctatttcatcacctctggcctttacccttgggagtggggagtgacctgggctgcgtaggggtggggacagctgtctcattcatccatgggcctcctatgactgaacctgcctgtctgtcctcctgcttttcccagctgggtgggctacgagaaggagggcttccggggccaccagtatctgctggaggagggggaatacccagactggtcacactggggaggctatgacgagttgctgacctccctccgggtcatccggacggtaagcaaaggcaattggcccatccctctgcctctggccacagccagacctcccccagtacagtttgtggagggaagaatttgtaccccctctccgtgttctccctgtaagtgttcccagaggtctagcctctcttcccctgctgctcttctccaggtcgtactgacagcctcacccctaattccccgggtgggctgtgaccctggggtctgggcactcccaggggtttcggtttgtgggcgggagagacctgactgtccctggggacccaggacttcggggacccggccgtcgtgctatttgaggccatggacttcgaggggcacggcgtggaggtgagcaaggcattgccggatgtggagctggtgcaacacggccccagcacacaggccatccacgtgctcagcggcgtgtaagtgacccgggctccgggagcggggcgggcccgggcgagccgggggcggttccaggagaggtgcaggctccgtcccagctgactcgcgccccgcccttcctgcaggtgggtggcctaccaggaggtgggcttctccggggaacagtacgtgctggagaagggcgtgtatcgtaactgcgaggactggggcgctggcaacagcaccctcgcctcgctgcagccggtcctacaggtgcgtgccggccgcggggggcggggcctccccggtggcgggacctggagttcgggtgcgccccgcccccacgcagaggtagcgggctggaggacctgcctgggcgcttggggcggggccttagaagggggcggggccgagggcgcggccgcggggtggacggtactgaaacctagagaagacaaggctaggggccggcaccctccctaattctcgattcggtccctaccttcaggtcggggagcacgatctgcacttcgtctcaaaggtaaggcagggactccgcagggagccgctgggctcacgtctctcccctcatttcggacctttcccctccccgctgttctcggccccactccatcgtcctccttcccctcatctcccctctctgcctccagattcagcttttctc

SEQ ID NO: 52314 - DNA, 1045 bp, Homo sapiens
caggagaatcgcttgaacctgggaggaggaggttgcagtaggctgagatcgtgccactgcactccagcctgggcgacagagcgagactctgtctcaaaaaataatgataacttttcttagcgataagatctctctgtcactcaggctggagtgcagtgacacgatcatagctcattgcagcctgggctcaagtgatcctcccacctcagcctccagggtagctagggctacaggcacacaccaccatgctggctaattcttttaattttttgtagagacttgtagagtctttttatgtcacctaggctggtctagaactgctggcctcaagcaatcctcccacctctgcctcccaaagttctgggattacaggtgtgagccactgcatccagctctgagaggctccatttagacctacacttgcacacagacctgcccctgtgctctggagaccatcagcaggtgctcatgcccatacacacgtgtgcacaccagctaacatttggtcacaaatctccaaggtgacagcagaaagttgatgagccagcaatttaggttataaggcgagcattttgggtgtggtggcatgtgcctgtagtcccaattacttggagagttaacgcagaaggatcacttcagcccaggagttcaaggctacagtgagctactgcacttcaacctgggcaacagagcaagactcagtcttataaaataaattaaaataaaaagataaaaagttaggccaggcacagtagtggcatatatccataatcccaacattttggaaggccaaggtgggaggatcacttcagcccaggagttcgagaccagcatgggcaacataacaagacctcaaagtacaaaataaaaactagctggggctgggcacggtggctcacacttgtaatccgagcactttgggaggccaagacgggtggatcatgaggtcaggagatcaagaccatcctggctaacacggcgaaaccccgtctctacaaaaaatacaaaaaaattatctgggcgtggtggagggcacctgtagtcc

SEQ ID NO: 52315 - DNA, 1038 bp, Homo sapiens
tccggtggtcctgggccaccagctacccataaagaccatggaaaggaagttgcttgctgcctatggcccttccatctttggaggtttgggactggatctggaaagaagaaattgctaatcccagatcgtgtaggttgacacccaggccgggcagggaggggttacttaagggaggttggctttaggaggtgtgggggaggggaaaggaggatgtggggattaagggttggagcctgaagggatggcattctttgggggaggggtagagaagggagatgctggatggactagttggaggcagcagggacgtctttgagcacagccttcagtgaggaacaaacaagggaaatagacgcagggagatggggagccaccacttactgttggggccatggggtcagtgggctacttgaacatctgccaagaggacctgcagcaggatactgagctgcccctttgcagcacccttattcccccaaccccccattagacagctagtttcccactagtggcttttctcccttctctgtctcatttacatatgtgaatgataacccacaggaagtaattgtgggagaaagaagggaattggcctttttagatctattaaatcactttattacaggaaccagctttgaatggccctcctcagcagggtagcaagcctcccccactctcccatttatctgatcacaaagagattaaaatctttcctggtctggggactggacagctcccccaactttgggaggctggaataaaagagtcagacccaacgttttctcatctcccatccaaaggctgccagatagggaggggctgaggggaatgtatcccctcatcttctgggttccttggtgatatacataccccaaggaaggtgttttcttgttttgtttgtttgtttgtttgagcaaatggggacttgggcctcagcaggcttcaccttaggatctagagcaattgggaaactattggatggcatagagcaggcattgagtctacaccatgctgggtcagatgtgctggcttggaaat

SEQ ID NO: 52316 - DNA, 1930 bp, Homo sapiens
ggctggtgagaaggtaattgtcctaagatagcatctaccagagggagggggtcagggagcccctttgcaaataaagaggaagggggaaaggcaatttaaaaacattttcttttcctttccaaagttggggttattaggatcccaatgccctgttaactaatgttcttatgctctctcccaaatgctgtaatatcctcttcaagagtagatgagtggggggaaaagcccacccccagccaaaaactaagcaaaacgacaacaaaacaaaaagcaaagagatttctataacaactcttttccttaggtacacatctttagatctagaaatctgcctgtctctagagttagggaaatagatagcaagcccttaaattagagtttctcgacttcagcactattgacatgttttgagcaggataatttgttctggggagtctgtcctatgtattataggatgtacagcagtattcctggtctctacccactagaagccagttgcatcttaggtatgacaaccaaaaacatctccatacattgtcaaatgtccccttggagtcaaaaatctcatccctgcttgagaaacacagttatataggaaagctggaacaagaaagctaaactgtcaactattttcctgagattcatcaagaattcaaaaatcctcattttgggccattttaagagttttggcttaactcatgtttcctgtggctcaatttgcaaactctcaagatttatagaaatttggaaataagaaaagttccctgctttcccatagctcctcaggacccagatatgtttcaatctcaaatatgtttaaattggctttctggctaaaatgctatattagaagacttggagtcaaaagcccagatttgaccaagggaccaagttgggttaggagaaaaggttttcaatacctagacaactgctgaaattgccctgtagccaggtggccttctttttctaaaagccatgagtgaggaggtggtaagagcaactttattcagggtctaggttaggactgctgggtttggtgttagggttgcgggggcgggtggggaaatatacggaatctttcctcctggtttgtaacactgcacctctgattactcacctcatgtctagttattgaggtactggtcttatacccttctctatgtaacccataagctctttgaagggaggaacttagctgcctggttaattttctagtatgcatttggtgggctgaggaatgaataagaaaaggggcatcttgaggaccttggtgaatcagaagtacacttagcagtctggggtccatgttggcagagatctttgttcagagaaaaagactagagatactgaggggtgtcaattgtagctgctcgctttctgggctgggcacaacatagaatatggcctgggcacaacatagcactatgaaagtttgtggagtgaatatgggtagatcaccactcggagcccagagaggttcctctcgtttttgttgacagagtggaagccacggatttagtggtcatccatgagttatttctgtcttaataagaaaaggcagcttaaaaataaattgactcgatttttcagaaagttggtagagaggtaggaaggttcatgaagacattgtggaatcttctggggtcctcttctttctgagacatgcttctagacaatgtcttttttttatttttatttttattttttgagatagagtcttgctctgtcgcccaggctggagtgcagtggcacgaactcggctcactgcaacttctgacttttgggttcaagcaattctcctgcctcagcctcccaagtagctgggattacagatgtacaccaccacacccagctaattttagtatttttagtagagaagggttttcgtcatgttgtccaggctggtctcaaactcctgacctcaagtgat

SEQ ID NO: 52317 - DNA, 1034 bp, Homo sapiens
ttactgaggtattaagaagggatcagaaggcctaagtactttaactggagagattccttccctgttatcaaaaaaagaaaaagaaatgcttggggtgggcgcggtggctcacgcctgtaatcccagcactttgggaggccgaggcgggtagatcatgaggtcaggagatcgagaccatcctggctaacgcggtgaaaccccgtctctactaaaaatacaaaaaattagccaggaatggtggcaggagcctgtagtcccagctactcggcaggctgaggcaggagaatggcgtgaacccgggaggcggagcttgcagtgagccgagattgtgccactgcactccggcctgggcaacagagccagactttttaaaaaaaaaaaaaagaaaaagaaatgctgtctgttgtctgatgccacattccccaacacagtaggcccatgtaggctccccacagtcctaacttgaagaaattgggaaaggatgatatgggtcatgccttctctccccctcccctttaaaataatttatctgaatcaataattcaggattggactgaagagacccaaggggagggggtcctgtttggttctatccatgaagtgggcagtgcgcaagccagagaagggagatggctgctgatggtgactttggcaagactgcctggggaaggaagaattttctatatctagttctctcccgtgaccataaccccaacatagagaggaaggaagaaacagttgaatgtggggaggagggagagggagatgcaagagggatctgctccttggaactccaggaatctgaccaccagaaccagccagtgtcaactctttgtttcctggggctgggctctactgggggagctcaggccatgcccctccccctaaggtcttttctttttggaggggatggggaagggggcggggccctgctttgtgtgtggttgggggtggaatgggggtggtacaagaatttcaggcgcttttcagatgcaggccctgggaggctggctctgtggggctgcacgctgatt

SEQ ID NO: 52318 - DNA, 1027 bp, Homo sapiens
tttcaccatgttggccaagctggtctcgaactcctgacttcaggtgatcctcccgcctcagcctctcaaagtgctaggattataggtgtgagccaccgtacccggccctctgttctattttattaagaactttaaacctgaatagctacaaaaatgtcatggcatctgcttatataattacgatttttgttaatgtactggtagactttgttgttcttaatcgtagtgactctttgagtcagtttccttaccagtaaaataggagtaccatcacatttgattcctaccctacaggaataagagttccttgtcttttggtataataatggaaattaatgttaaaatttactgcatttcccttcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtatggattggaaggcagcttatataggttgctaagggcatccccagtctcccaatcctgtcactttttgggtcacactgcaaaagacaaagggaagcctgtggtccctggcagcatctggaaggctgagcgcctgcaataggtgtgggcaagggcagtaggtgaggaggccactgggggtgacttagtgctacttgggacaagtaagtttgctctgtggtctctaagcctcaattgttaagtgaggcagtgatactaacatcctaggatggttttagaattaaaggagatcatagatttgcaaatggtgggacaagacagtattatctatatctgttgctgctttaccaggtctgcaaatggctggtttccttaatcttgcttgggcttaaagccccttagctctgaacagatactataatttggcttctttaatttctcctatattaagggtatggaagaatctctcctatcc

SEQ ID NO: 52319 - DNA, 3940 bp, Homo sapiens
aatagtcctccttttgcaagtgggaagtttggtctctgggaagggaagtaagtgacaaacctgtaccagagcccaggtgtcctcattcgtgggaggcatctggcctcttcttgctcctttctcttacttttacgatcttgctttgtactaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggctggagtgcagtggcatgatcggctcactgcagcctctgcctcttgggttcaagtgattctcctgcctcagcctcctgagtagctgggatttcaggcacccgccacactcagctaatttttgtatttttagtagagacggggtttcaccatgttgtccaggctggtctggaactcctgacctcaggtgatctgcccaccttggcttcccaaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatccccttgtcagatgtttttgcccttccgataactcccactttcttggattgggactcagaagtttttctgttcagccagtttgttaggaatgaatcttgaaagttcagtcctcttagcacctcattacagtggatttttgtttctagttaaggcctcttgtcctttccttggaagcttccacattcaagaggggattaggggcttggcatgcataagaatggggttgcctgtgccactggctgggatgaaaggatggggccatggcttggggcatgagaccctaataatactttgtcccct

SEQ ID NO: 52320 - DNA, 1517 bp, Homo sapiens
tcccctcagtttgggtgacggaaggggcgtgtcgcagcgcccaaagatgacgtgttctgccagcgccacgtcatgaggaagtgccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggtgagcaatggcccagagcaccggttggccttctggtcagttggataatcttatataaaaacctgttattaaagttgatgatgttaagtgcaattcatgatgttaagtggaatttagcaaggaaaccaaagagtcttagaatggtaacttccaggtctacatttctggtagacttttgtcctaactctgatattttctggaagcccaggcctcttaatgtcactgggcagcctagactgctaagtattctttatagagaactgaaatttgtttccctggaacattgatccattgttccatgtactgtcttcttgatttaaataggttaatctttgatatattctttgatctgtcagtagagctgggcccggtcactcacgcctgtaatcccagcaatttgggaggctgaggtgggcagattgtttgagctcaggagttgagaccagcctgggcaacatggcaaaaccccgattctccaaaaaattaaaaaaatagcagggcttggtggtgtgcacctgtagtcccagctactcggaaggctgaagtgggagaatttcttgagcccaggtcaaagctgcagtgagtcatgattgtgccaccacactccagcctgggtgacagaacgggactgtctcaaaaaaaagagttcagaacaagactctgtctcaaaaaaaaaaaaaaaaaaagagtttgggctctagacgcagacaaacatgggtgaaattcctgttcttttttttattttgagatggagtct

SEQ ID NO: 52321 - DNA, 1097 bp, Homo sapiens
aactgcagaagcatggggtgtgtatccgggtcctgggcgatctgcacttgttgcccttggatctccaggagctgattgcacaagctgtacaggccacgaagaactacaacaagtaagttctcagatttccctatagggagctgtttcaatctttgattccctgctggctttagggagacgtcctgggctttccttggtctggattggtgcaaggggcaatgagagagtaggttgagcagcttagagactttctccgtctgcagggcacaccagacatgattctgcaataacatgttatatgtgtgtatactgacacatacacatagtttctctttcctcctttctctgcccagcccccaccaaataagtgtgtgtgtgtgtgtgtgtgggtgtgtttttacttgacagggaatgggatcggaatacagcagttcttatccctgactttgaagacagatccttcaagaaattcttgttctgttccactcctttaacctatggataggatgaccttgggaggtcatacagatgtacaggggaatagagttcaataatccaaactctgtgatgtgtagctttgaaatataacgtgtattttggcagtggacttgttttacatcaaatctccttcctattttcctttgtttgtgccaatatcacagtagagtcttcctctgaaagccggtgtacagtagaaggggagagggttaggacggcaataggagctatttggtggctgggcacagtggctcacgcctgtcatcctaggcaggtggatcacctgaagtcaggagttcaagactagcctggccaacatggtgaaaccccatctctactaaaaatacaaaaattagccaggtgtggtggtgtgcacctgtaatcccagctactcgggaggctgaggcagaagaatcgcttgaacccaggaggcagaggttgcagtgagtcgagatcacgccattgcacttcagcctgggcgacaagagcaaaactctgtctcaaaaaaaaaaggagccatttagtatttgtcttattataaaactagttacatgtttattccaagaaaacttggaaaccacaaaaaactcataatttca

SEQ ID NO: 52322 - DNA, 1112 bp, Homo sapiens
tcagacagggtttatctctgtcgccagtatggaagccatctgtgtataggttaacttgagcaaagaggggatgagaaagctaaggagagtctgtctgtctatctgtgtatttatctatttagagatggtctcacactgtctcctgggctggagtgcagtggggcaatcaaagctcactgaagcttggaactcctggtctcaaaggagcctctcaagtacccagtactacagacgtgcaccacctacccagctaactttttatatttattttttgtaaaaacagggtctgactttgttgcccaggatggtcttgaactcctggcctcaagtggtcttcttgccctggcctcccaaaatgctgagattacaggtgtgagccactcagccctgcctgttaaggagtgtagagtgagaagaagaaagagcctaagatggcatttttgaggaactctaccctttactggctgggtagaggagaataagctttataagcaaaaacacagaaaagcaggaagaaaaccagggcagccagcattacataagccaagaaaagagggagtttgttggtgcaagttgggaaggggtagggcacccatggaaacaatggtgtcaaatgctgtagagaggtcaattaagatgtagagtgaaaatcagctgttgttaaaacaattaagagactggtggagttagcagaggtagagagcaggcaggaagatgagacagaaaaggggtatagaaatagaagcatgttttcaataaaattcttagtttggaggtactttcgtagttcattatatttttgtgctttataatgaatatgtttcaaatattcttgtatgtatgaaataaatattaaggcacaagggttgacactagaatgaaagaaagccatttgacaagcagatctaatatgcattatgcctaggactctgatcttgactcctagtccagcatgctttaccctcataccacattacagtaaccactaccttatctcctgcttcttgtccagcaagtttttccatatccttctctgtcctgcatggtttagtaacttgcctctgtggggttagttatgcagacagggtgtgggttgggcagtatcaccaggg

SEQ ID NO: 52323 - DNA, 1036 bp, Homo sapiens
aggagttggatggtgatagtgagaaatcaggaaaattccagctattagaagcataggacctaattgtaattaacgcactgactttgttataaatgcaggtttgtctaaattcgaataatataaagtgtaacgcctcaggccctgattagcccagtctgagcacaccaagcttcaggagttggtgggttgagacattggcctcctgaccctggtgatactgcccaacccacaccctgtctgcataactaaccccacagaggcaagttactaaaccatgcaggacagagaaggatatggaaaaacttgctggacaagaagcaggagataaggtagtggttactgtaatgtggtatgagggtaaagcatgctggactaggagtcaagatcagagtcctaggcataatgcatattagatctgcttgtcaaatggctttctttcattctagtgtcaacccttgtgccttaatatttatttcatacatacaagaatatttgaaacatattcattataaagcacaaaaatataatgaactacgaaagtacctccaaactaagaattttattgaaaacatgcttctatttctataccccttttctgtctcatcttcctgcctgctctctacctctgctaactccaccagtctcttaattgttttaacaacagctgattttcactctacatcttaattgacctctctacagcatttgacaccattgtttccatgggtgccctaccccttcccaacttgcaccaacaaactccctcttttcttggcttatgtaatgctggctgccctggttttcttcctgcttttctgtgtttttgcttataaagcttattctcctctacccagccagtaaagggtagagttcctcaaaaatgccatcttaggctctttcttcttctcactctacactccttaacaggcagggctgagtggctcacacctgtaatctcagcattttgggaggccagggcaagaagaccacttgaggccaggagttcaagaccatcctgggcaacaaagtcagaccc

SEQ ID NO: 52324 - DNA, 1077 bp, Homo sapiens
taggtgctttgttcacttggatatgctcaatgaccagagaatctacatttaaacccttaagttcagcattactctctgcatttttaagcatgtgcagcaaaaattcagcactctttttgggccactgaccttgtgtccagccccactgcttggcctgggcacacctgccagctccaccattgtaacgtcggaatggtacgcactgtttctgtaaagtgacatctttcaggtacttcatggcttttcgtatatgcatacccttgatggcctgggcagtttcacgaatattcttaaagtaaacacgaagattggaacctcttgatttgcatgatatcatgaggttctccgggttaagtgaatagtgaaccattttcacagattacctcaggccgcttagggaaagagcaaatgggcccattttaaagataagagaatgagaaattatatggattgtacagagtctcacataacttggagaattaagaccatgctgccaagacaagattgtcagattaccagagaaatctgaaccagagcccttcttattgctcaattataagtgaatactgtttcctctgtgatgatgatacggaaaagaaagctctctctgtggtttgccttaaaggactgagagagatgagcaacttggctgggtgcagtggctcacacctgtaatcccagcactttgggaggccgaggcaggcagatcacttgagctcaggaattcaagaccagcctggccaacatggtaaaaccccgtctttactcaaagtacaaaaattagccgggtgtggtggtggctgcctgtagtcccagctacttgggaggctgaggcaagagaatcacttgaacccgagaggtggaggttgcgggagccaagattgcgccactgcactccagcctgggtgacagcgcaagactccatctccaaaaaaaagatgaataacttgcctaaagacacacaactagtaagtgtagagtctggttttgaacactcagcccagatctttctgctttcctgaccatgcgtccagaaacatgttcccaccaagaaatttttgtcttctggaccctttc

SEQ ID NO: 52325 - DNA, 1974 bp, Homo sapiens
aggacttcccctagttatgtgctctccagggaccaagttaacaggggatagagacttgagtgtttgcatattgtttaccatgcttgcataggtatggccctttatcctgaaggggagggactagtaactgcaaggcaagcttccaacccagaggggctagggtccctggcaggttaccaaggcaagagcttacgctcagggatgcaagacagaagtcccattccttgaaaagcggcacaatgaagttttcactatagttggattcgcaaagccagcgacagatgaggaatggacatcaaatattatgagacacagcctagagatgcttctccagattttagctttccccagaagtactctggccccagcctgtttgggagtggggatggaccactctgatccattctgtggatacagttggtttccccatgacacaaacataatagtacttggaaatgacctacctgccatagcaagaagtcactcagccgcacttctccagaagtccgtatcaagatgtcaggatgaggagagcggttggtatagaggcacttatcaagcagagactcagagatatcactaagatgagcaagaagagacaaagagaggcacacatcctgtagtattctctttctgtagtgttctcatggtgaacttccatatataggcttctcagtttatacaataccatcaaatacactagccaatactacacagaaggccctcaaaaaatgtttgctaaattaatgaatgaatttaaatcttcacaactacataaggtatttcttttttttttttttttttagagaatacaatgtaaaattcttttctcttttttattttttgccttttttgacatgttctgatacataaggtatttatttatttatttatttatttgagatagagtctcacactgttccccaggctggagtgcagtggcacgatctcggctcactgcaaactctgcctcccaggttcatgccattctgcctcagcctcccgagtagctgggactacaggtgcccgccaccacaccctgctaatttgtttttttttttttttgtatttttagtagagacagggtttcaccatgttagccaggatggactcgatctcctgacctcgtgatccgcccccccctcggcctctgaaagtgctgggattacaggcatgagccaccatgctcagcagatacataaggtatttctatcctcattttatagataaggaaactgaggctcaaagatgaataatttgctgaaagtcatttagcctcaggcctaaaaccagatgcacccacaaaaatatctgttgtcttttgctaaaaacatcttgttttttaaaatacatacatacatcctatggcccagtatttgatgaaatactatgcaactgcattctaaaaataaagataaatctaaatgcactgatttggaaagatgtccaaaatctaatgttaaatgtaaaaggcaagtttcagagaatatatagtataaaacatacacacacattcaaacattcacacgtgcatataagtatacataaagaacaaagtctaaaaagatacatcatactattaacagtggattggataagaagtaaggaagaaaagactatttctttttactttatgtacttctgttattgtttgaatttatgtaaataactttttttggccaggcgtggtgactcatgcctgtaatcccagtactttgggaggctgaggcaggcagatcacctgcgatcaggagtttgagaccagcctggccaacaaggtgaaaccccatctctaccaaaagtacaaaaattagctgggtgtggtgccgcatgcctgtagtcccagctacttgggaggctgaagcaggagaatcgcttgaacccaggaggtggaggttacagtaagcccagattatgccactgaactccagcctgagtgacagagcgaggctctgtctcaaaacaaaaaaaaac

SEQ ID NO: 52326 - DNA, 1016 bp, Homo sapiens
tactttaaaggaataatggccagtttctctgagaagccttttcctcctgagtctttaaaagataaaagacctgtagctcaaatcctattcctacctcttactgattatgtgtccttaactaaatcatttctgtttgcttacttacataagggaggggctaataagacttccctcattgggttcttgggaacattaaatgagttgcagcatgtaaaatgttcgcagtgcctgacaagtagtagatactcagtaggtggtagctactatcatcattatcatcatcttattaggaagtgcctggtatatagtaaggtggttgtcaatcaatgctaatcttttcttccatcccatcccatctggccagccctgaactctttcttacctgaagcacgctatggttcatctggaactgcaggatggcctcgaagaggttccaaaatgtatactctggccacagaacgggttggaacaccaggcaggagtgagaggtctgggaaaggtagggaggagagtatgatttagtaacatgttgctgggccgcatccctggtcagtcctccagggaaaaagcaggctaagcaggacccagaagcccagagatgacaatgttacaggcatcctgagctgtagctgcagctgctgctggccctgattcattcactagtagggggaggcgtcacttgaggcagccagatcacctgcctgtggtaaagcagaactaaaacgagactagatcaacatttccaccaggatttttctaagagccaattttaggactatgaaataacatctggattatgttattggctcttggcccttagagggcatctggaagacatactgtctgataaaggtcaccaatgaacaaatggtagctgccattgttatttttaagtaccagcagcagggcacagtggttgagagcatgagctctggagccagactgcctggctttgaattttggctccaaccatttaccatttatttgagcaggggtaatttcacctggcctgagat

SEQ ID NO: 52327 - DNA, 1063 bp, Homo sapiens
ctcaaacccaggtattctgggaccatctaacttagagcaaacagccctacccctcaaggatattgttgtacaatgaagtgtttaaagatgataattactattatcataatcattagaatatgacggccaggcatggtggctcatgtctataatcctagcacctggggaggccgaagcaggaggatcacttgagcttaagagttcaagaccagcctgggcaacatagtgaggacttatctctacaaaaaataacaaaaatcagccaggcatggtggtgtgtgcccatagtcctagctacttgggaggctgaagtaagccaaagttgcacaactgcactccagcctgggcaacagagtgagaccctgctaaaaaaaaaaaaaaacaaaaaatagcacgtgattatcctaatcatcatcattattagcaagtgcctggtatatagatttcaatgaattatgtacaagatacattttagaaatttttccatcaaaaaagggtaaagttttagtttttagagggagctttggtcatatggaaaaatctgatattcattccccactgacagtggataattgtgcctttgctgtttttcttttcactaattctaaacttcttttaatttcctcatattctgagactaagtaattaaatacatgatcaagtctttgtgatttgatttacttatagcaggagttatggacttgggattcaggggcagatttcagcagttatgtgaacccccttaaagtattctatgtgtggccgggcttggtggctcatgcctgtaatcccatcactttgggaagccaaggcgggcggatcacctgaggtaaagagttcaagaccagcctgaccaacatggagaaaccccatctctattaaaaatacaaaattagttgggattggtggcgcatgcctgtaatcccagctactcgggagggtgaggcaggagaatcacttgaacccgggaggcggaggtttcggtgagccgagattgcgccattgcactccagcctgggccgcaagagcgaaactccgtctcaaaaaaaaaaaaaaaaaaagt

SEQ ID NO: 52328 - DNA, 1114 bp, Homo sapiens
tcagaggagaaagcaagtgtggctgatgaacatcacggagcagtgaccttcatggacagacagaatttgagctggccctttaaccaatgaggaggattcaaacagaggtgaggtgtgtggggggcagggagaatattctggcagtgggagtaatgagcaaagatgcatggaaccgaagagcctgttaaggccagagtaagtccacctggagcactggggtttgagaagttcctaaggcctccctcacctctctaaggctctctcttactctgcaaaaccgggataagagtacccacctcactgggttgtttgaggaaaaatgagataatgaattttcagcctactgcttggctattaactgttagctgttctatcaccgccacttgtggactgggctaagtagtctaagtttctggcagaacagaaaggatgggggacgctcagcaacagagggaggaaatatggagctagctaaagccacttcatgaggcgcaagcttcttccagatggcatcagagtgcatgccagcaatgggggctgtagcccaggcagagcctggcccctgtctgccaggaattagcagttcattgttcagatagcagagttgggagggtgtctgctcgtcattttacagaaaatgacagcgaggctgagatggctgaagttcccttggcttctccactaagataacttcttgagaggacaatgtgaagtgtatctcgtgcctgtgtataagctctactttctaggggtggaaaagctggtggcctgtatctggatacctgtctatccagcttccacatggtctgaatctaccctttcaatctcagaggtgtttccagttcttctcaagtacttacccttgggaaatccaagctaacagaagtcctagaggtcaacttttctctccctgaccatttgtctactatccttgtataatgaccaatcagggtaagtgagggcgttaattctttccttagagactttttgtacagaccttatccaatcttggtgcaagggctccaagaagctcactttgagaaatgtggttctaacctatgaatctaaattcctcctgggcattatccctctctgctcttattctctccttggt

SEQ ID NO: 52329 - DNA, 1028 bp, Homo sapiens
tgcaataagtggcttaagagagttgaacctgcttctcagaatgttcataggggggtcatttgctggaaggatcaggctggtcttcatacaggaggcaagtctggagctctgaaaaatagcctagggagtggggaggatggtaccctcagaggaaaacctggggagatcaaaggaagtgacccaagggacatgtccccgacaagaataggacctttcttgcagcggagaatagacaataacaacttgtaaaattgctgtttctgtctaagagcctgctaatatcctagagaggattttgcatatgttatctctaatccttaaaaccactcttcaaggtaggcacaacccccactttacagatgaagaaatgaggttaggacaggatttgcccaaagacacaaagccagttgatgggggaatcagaagtcagacccacatttgtttggttccaagagcatgagaaaaactttaagaagtacagacgcttccacacaaaacaaaccaagatggacccagaattgccactgccctgcctgtacaacatgagcaccacccactgcatacctactcccaagccttttcaaatctggtacctactttccactgttccacttcacttggcccaccctgtgccccaccccctacctcctccatcccagtttcacccactcctaaaaatgatctccccaccccaatccccacttttctctagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaag

SEQ ID NO: 52330 - DNA, 1658 bp, Homo sapiens
atttggttggtgttgctggctggtacttgccggtgtggggcacctgaaatagagttgctcaggcagacagctcttcaaaggcactaatcctctcagcagctctgcagcaagtcctggcagagggaggtaagggaaaggacacagctttgaccctcacaagcagaggacctagaacaagctttgccatgccaagaataaatcatctagggcctacttagggagccaggtcaaaaagctgagagaaacctcgaagagtggagtgggaatcagagtttgagatggtgagggcagggagcagagtcagttggaagaagtgtttggttctgctcagtcctgttgtgttacaggggaggcctgtgctggattcagttcaccagggcctacaggcccttctgttaccctgaaccatggagggggccagtctcatttgggagtggagcctggccccatgccctgcaagaggaggagaaaagcttgtgtgggctgagtcgacaataggtaattggattgtaatcgcccgcctggcttccgcgcaccattgggggtgctgagtctttcagtgagcaatcagtactgtgtggtgggagagggtagagattcaatagcaaatcccaggtggagagccaagggggaggagcagcagatgggcaaattttctgtctctcccaccccttttttccttacccaaataactgcctgcctattagttatttactagcagatccaaggtagagccaaatcttttgtggaagctgggtggaaggctaaaatggaagggtaaagagctagggttttggggagaactcttccctgaaattctgtgtgttgaaggatgtgctggtggaaaaagaaagtgcatctaagagacaggcagctgatgagttgtggccctttgctctccaaaccctattggtgaccagacctaggtttagtgtactcgtgggagactttcaccctcaatcctcctcaggagcctgtcccaggcagcccaaaggtatctatggccagcaaacctggcctggggggctccccagccaagcaaagggaacaccattcattatcaggaaaggaggtgcctttcaccaagaaaaggaaggggagtggagccctggaggcagagggcagggcaaagtggcaggtggccagcctcattcaggctgatgcagtgcccagacgggccagccagtcagctcgcttgagttccaaggcctgcaggaagccttggactcgctcttcccgtctggccgagagtttgtgcaagcgtgtccttcggagctgggcgtccccactggcttggagcccctctcgcagcagctgctctgtcactgtagcctggtccctctccagctgctgcctcttccgctcctctgcatacatgtctcgggccttctgctagagaaaagtggggattggggtggggagatcatttttaggagtgggtgaaactgggatggaggaggtagggggtggggcacagggtgggccaagtgaagtggaacagtggaaagtaggtaccagatttgaaaaggcttgggagtaggtatgcagtgggtggtgctcatgttgtacaggcagggcagtggcaattctgggtccatcttggtttgttttgtgtggaagcgtctgtacttcttaaagtttttctcatgctcttggaa

SEQ ID NO: 52331 - DNA, 2071 bp, Homo sapiens
gctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaaggtaagtgctaacattggaactgatcattttcacagaatgaggactgtccttagtgccttaacttaattagcataatggtgcctccattaatggaggttataaactgtgtggatagcttacctcgtccgtgtcattcataacgttggtttcctgatcaagaattctgttgttagtttataggaaaatctgcatttaaatattaaataccccagggtttaaactaatttattcttctgttacttaggaaattctaagtactaaagattatagcaaattacagataatttagcctagttttgatcagttgttcttgtcaaatgggtgagggtttgtgttttatcttgagtaaacaatcctaccttgtgcagaactttgcagaccataccttggtaatacgaaatggggagaaacagttctattttttcccctttttcagaagggagagaaggtacccaaagggaaaaagggaaaagctgatgctggcaaggaggggaataaccctgcagaaaatggagatgccaaaacagaccaggtataactgctgtttcaccctttgttagatttgttcattcagttagttgctgatatcaaaaatttaattgcccttttcttgtatcactccaaatgtaccatttggtccagtgtgcttgtggctttcctgttaacttaaatcctggattcttgaaatctctactgtcagctgaagggcattgtgttttatactacatgaagttttcaagctaggagtaacctcaggtctcttattctggtgttcttcctacctcaattttacagtgaggcccagaggagaggtgacttagcaaagttacctagtaagtcattctcagaagaaatactgagtctcagtacctgaaacctgaactttggcctgggagcaaagtgatgctgtaggtggaatgtgaacacagatagttttgaaatctacgcattgcattaatttgtctgttttcttttaggcacagaaagctgaaggtgctggagatgccaagtgaagtgtgtgcatttttgataactgtgtacttctggtgactgtacagtttgaaa

SEQ ID NO: 52332 - DNA, 1051 bp, Homo sapiens
gaatccaggatttaagttaacaggaaagccacaagcacactggaccaaatggtacatttggagtgatacaagaaaagggcaattaaatttttgatatcagcaactaactgaatgaacaaatctaacaaagggtgaaacagcagttatacctggtctgttttggcatctccattttctgcagggttattcccctccttgccagcatcagcttttccctttttccctttgggtaccttctctcccttctgaaaaaggggaaaaaatagaactgtttctccccatttcgtattaccaaggtatggtctgcaaagttctgcacaaggtaggattgtttactcaagataaaacacaaaccctcacccatttgacaagaacaactgatcaaaactaggctaaattatctgtaatttgctataatctttagtacttagaatttcctaagtaacagaagaataaattagtttaaaccctggggtatttaatatttaaatgcagattttcctataaactaacaacagaattcttgatcaggaaaccaacgttatgaatgacacggacgaggtaagctatccacacagtttataacctccattaatggaggcaccattatgctaattaagttaaggcactaaggacagtcctcattctgtgaaaatgatcagttccaatgttagcacttacctttgcaggggcctttttaggcttgggctctggctttggaggagcaggtttctttttttggcaggaagagaggaaaaagtgaacatcagtacaatggactgaagaaaaccacccacaaccaaccaaaagtaccaagggtagagaagtttctcctcctcctcaaaagtttttgtggttggctttcttctagaatgttggatttccagaagcccactcaaatgtcccactttggctacaggcatcagaatttcagaaccagcaaaacccaaaggggcaagagtcccaagtagaggcaatgattcaaaaccaggcactaaccataattcatggaagcaaagggaattgttttttgatgttttttagtttcagg

SEQ ID NO: 52333 - DNA, 1052 bp, Homo sapiens
tggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcaga

SEQ ID NO: 52334 - DNA, 1086 bp, Homo sapiens
actgctggcagctcctagccaggaaggaggcaggtgaggggctggtgggggacttttcacagggacctaggatctggactgccctgccctcccttaatgctgctgaaaatgggccgctgggaggcagggcctggcccagggtgcagcccaggtggagtaatctatgggaagcgtgggtgaggattctgcctgggcctcgcttagccctgttgaaagcagtagccttgtccccaggcccagttctgccacgtacagagctttactatgtgccacccactctgccttacgaatgtcaccccactttaattctcacaacagcttctcaagatagggattattacccctgttttcagatgggacaactgaaaactcaggcttatgtgttaatatcagagccaggattggaaccaagatctctctcttccaccaagtgggagagaggctcagggatggggaagggctggagccacactagcccaggtggaaggtgctccaagagaggctccggatgttggcggactctccttatcctgcaaggccctcgtccagtctttgccgagggctggcagtgccagccagccctggcacctggcccccagcctccagcagtgagcagggctgccaatgctgggctcagaacccagctcctggggctgcttcctgcctgtggggcacgtgctgtccttctccatctgctgcccagcttctccagacgctgccctgggcccctctttctaagacagagttgcttgggtgggaaggaatgatgccagttggaacccatttctgacatctcagaactgggggcagtggtctggggccctgggcatctgtcctcatgagcagtgctctctgaggaagagggaggagtgtgggtcttcaacctctaagaggccaaaggactcctaagacaaagtccttcattcagtactctgcaaggtcagcaccattgtccccattcagtcatttatttagcacttaggtgataagtactatttcagacaacaaagtgcagatgtcagcaagacacacctgccctcgtgatacagatgaggaaactgagactttattactattattattttt

SEQ ID NO: 52335 - DNA, 2111 bp, Homo sapiens
gacccaggctctgagtgggaagccagcaccccacaacccccctgacccccctaccagtctgttctccagggctgcctgttcccttactcttacaggtttggcgttccataagaatgacacccaagccagagatccagggagtagaggcagccagactgccttagagcggggggtccctaagtcatccaggccactgctcaagaaacccacacctctaggtacacctaccccttcctccccaccctcagtaggcttgcagccacgtgactttgggttatggtcacatgtctgccacctgcctgctgagggacctcggtgagtcccttaactctcctgagcctcatctgaaaaataggagtaatagaacctgctctggcctccttgctgtctttgctgggttgaactttcactggataaaccacatgctggactctggctgggtgccaagatgttgatgatggacaagccatggccccttcccgagttaacctgcagcatgcttaggttatgggggtagagaggagggaggaaagaacatgaggctgtgtggacaggggtgacatttgaattcagtcctgataaaagatcaggagtttgccaaagtgacaaggcaggaaaggctttcttggtagagggagccaccatacaaatgctggggatataaaatagactgttttcagggtctgtggttgttcagtttagctcaaaaatagggcccaatgataagaatggctattgtttgtaggccagttacatgtcaggtgtatatatttataggcattatttcatttgcttcttgccgccaccattgaggtatgttactttgatccgcatttcacagatgaggaaactgaagccccagtaaatgaactaaccttctaggggtcacgcaggtggtagaagccagaatttgaacccacaaggtcaggttgcaaaacctacattcctagttattgtgctgggcagttgaagatgatggccttgatttctatgctaaggagctgggacttgattctacaggcagtggaagccacagaggggtttggggcctggtacatagaaggttctcagcaaatgttgactgagtgagttgagtgcagcagttgcacttgattttaggaatgatgagggtttggagtggggaaggctgtggggcagggagctggtgggtaggctgttctgatcatctgcaggaattatgtcaagagtctagaatgctgggtgaagtggagctcagtctacaaaagcatccctaccacagcccagcccctgggccctgaccaacccatcccttctccccaggctgctgagagatgacagtgtgtgtatggatgtgtgcatggaggggcctgtagaacatttggcccctggggagagattaggggcattaaaggggctcagggggcaggatgtcctgggagtggcaatggggagctgttccaggggcagggagattatgtaatgggtagagcacagctgtgcctacccagctgtagccaagcagggctacagctgccccatggacccagctcctggctccaaagtccagatccagacctgttctagagcaggccttcctagctgttgggaacctcctgtctgcctcaccacactctccctgttctaggaggggtggggcaatttctttcagcttccaaacgcccagatagggtaggttacttgcctcacatcacacaggaaacagatgggctgggtttgacacaccccagcatatttaataaccacctgagagtgaagtctgggggctggaaaaggcaagactgaccagaggggggctctgggctctgggctgtttctcagctgacctgtttggagcacctcctggatttgggaccagattttgaatccccactcaccagttgtgtgaccataggcatcatcactaggtcccctcagagcctcagtttccttctctgccacatggggccagggcctacctcccagggctgtcatgaggattaaatggtgccacaggggccaggcgcagtggctcacacctgtaatcccagcactttgggaggccgaggcgggcggatcacctgaggtcaggagtttgagaccagcctggccaacgtggtgaaaccccgtgt

SEQ ID NO: 52336 - DNA, 1055 bp, Homo sapiens
gtttgtatctggtagagctggaagccacacatgacccttcccttctccctgggaggaggtgacatttgaactaagtcttcagagatgaagtgtttgccaggcagacagcatgagggtcagaatgctggtccctgggaatattctgcctgagtcatgaggcgccattgccagaatacttggtccctgtgcctacaccatgaaagtggaggtggagggacccacccaggactcctgccctaccaccatggcctccatggctattgggagcacctaagggtgggggtgccccacagagtctttctcccaagcgtgtaagttctgacagtgctcccccaatctcctttctcttttccagaatggacagacctcaggggaagaagctggacttcagccgtccaaggtgaggaccatggccagcaccctgagcgaggggctgtgggggatcctgtttgcatggctttggaggaggttgagggctccagcctctagcccctttgcccaactcagccgtccttctcagggcccaccgaatccttgtggcaaccctgggcatagaaatcacttgttccaaccttcctattttgtaggtgaggcgactgtggcccagaaagggtcaggagcagaatccaggtcagggctctggttacctgtcacccaggccaggatgcccctgcagtttatttactcatggaatttgggctggctctaaggagtgatgggaggggctcaggccagctgtcctgctccttttggtagagctgcgcttgccaagagcctggaagtgagcatctgggcacgtgagctggaaagggggtgctggtggccgctcaaggctaaccaggcccattgcctggcatgtggcactcatggcatttcttagggcttccacttcccagtgtgagggtcattccctcacccctgctatctctgcttcccctgggccccttcctgtagccccctagcccctgttgctggttttgtgttttgccagaagcaccaggactaggtgacagtggtgtgaccttggggaggttccttgtacactctgggccttg

SEQ ID NO: 52337 - DNA, 1209 bp, Homo sapiens
gaagtccctatgcgggggatggggcagggaccaagggatgtgggctggtggctgtcctccccccgcccgccaccagaggcctcagggcccacacagccttcagcaaaggcagttctgagactgtttccttcctgttgccccttctggtaccctgctggccacagaggctcgtgtggactaggccccttggtttatctcagcccgtatctggagagtctcctcccacaaagtagctacctctctaccttctttgcatctgagggaccaggggttggtagggagggtgagctttggggcttccgagagctgccccagcctccaaacccctgtctgaggaagctggagagcaatgagaggcttggctgagggaggcatctttcacaatctcccggcagccatccacccgcagagactctgcaaggacagggaaggggaagtccgtgtgtgcgtgggggcatgtgtttctgcataggggttgtctgcggacagggtttccgatcatcggcctgagtgtgtgtgtgtgcatgtcagtgcctgtgctgtgctggtatgagtgatgaaatgaggccacgtagaaaggggctgggcctggtcaacccctgccccatagctgcctgctcctcctctcagacctctgtgaggtccttggtcaggctttctgcccgccttacccatcctggggcttgggactggcagccttcttcggggcagctgagcagggcaggaccggaggggggccactggtgcctgctttctgggctgccattgtgggtgggcatagccatgggaaggatgctatggaggggtgggacacagtatctaagctctggactggacagtcggacagtggcctttgctgacttttgccccacattctctcaggtcctcccctcacgtggatgtttgcgggtgctgatatgcccactgtgacactgcgttatcgccttgtgacttttgtctctgctcttgtctctcctccttagagtcagaggacatagggagaggtgtgcccctgggccttccctggggtcatgggcttggggtctgcagtgtcccctcctctatagaggagcctgacccatcatctgcccctcctccctgcagagggggaagtgagaaggaggggggccagagaccctgccttctgggccaggaaggctaaaaaaagcagaagtaggaagagtaacggggccctctggtcaccggctt

SEQ ID NO: 52338 - DNA, 2657 bp, Homo sapiens
ctctcagctactgtctgggtccccctcaggtcttggcataggaggaaaatcctagggaaatgggagatctcagaggtgggtctgcaagaaatacgagagtcctctcctgagtggtgggagtttgcagattgtctcccctcatctctttccccaccccaggtacagcagcaagaacccacagctctgcccttaaccccttcctggggatccctgccctgctgcctgcccgtgtgtctgccaggtgtcagacctatctgccctaggtattgtcagtctgcttggggctcgctgactctcccgctgtctctctttgctgcctacctctgtctgtggttgggttccaatctctgtctccacttgataagtgcctgacttcaccttttgggtacatgtcacatgttaggtgcctgttgttcatgtccccttctgtctctgcctgttgggtttatgtcttcatctgtctctgcctgttggatacctgtccccttctgtctttgcctgttgggtttgtgtcaccatctgtctctgccttttggatacatgtccccttctgtcattgcctgttggttttttttttgaaacggagtctcactttgtcgcccaggctggagtgcggtggtgcgatcttggctcactgcagcctccccctcccaggttcaagccattctcctgcctcagcttcccaagtatctgggattacaggtgcccaccaccacgcccagctaattttttgtatttttagtagagacggggtttcaccgtgttagccaggatggtctcgatctcctaacctcgtgatccacctgcctcggcctcccaaagtgctgggattacaggcgtgagccaccacgcccagcctgcctgttgggtttatgtccccttctgtcattgcctgttgggttggtattctcttctgtctctgcctattggagatgtgttcctcctgcctttgcctgttgggtacatgtccccatctgtctttacctattgggtatatgtccccatctgtctctggctgttgggcttgtgtccctatctgcctacacacattggggatgagtctctgtccacctctgtctgttagatatgagtcccctcctgcttccccttgtcaggtacgtgtctccatctgttttctattggatatgaattcctcctgcctctgcctgttgggtgcgtgtccttatcctccatccctgcctgttgggtatgtgttctctcctgcccctgcctgttggatgccattctttctttttctttttctttttttttgagatggagtcttgctctgccacccaggctggagtgcagtggcgctatctcggctcactgcaagctccgccttccaggttcatgccattctcctgcctcagctcccgaatagctgggactacaggagctgaccaccacgcctggccaattttttttttttttgtatttttagtagagacagggtttcatcatgttaaccaggatcgtctcgatctcctgacctcatgatccgcccgcctcagcctcccaaagtgctgggattacaggcatgatggatgccattcttacctgtttccacctgttgggtgcctgcttctgcctgttgggtgtctctcttcgtctgcctccacatatcaggcacctgtctttgtctgttgggtacctgtttgctattgggtacctctctgctgttgggtaccagtctgctcagcagctgcattggcaggggactttccctttgtaggcccacagggaggatgggggaacggccagagggcagccctcaggctctgaggagagggggagagagaggaagggaacgtggtgagggtgtaggcctggtgctgggaaaccacaggccctgagtgattggctgccctgggccaggcccagcccccgcccttaccctgcacatccgccttggtcccggccaccactgcggcagccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggtgagtgtgcccgaatgtctggtcctgacctggctgtgtcccttgcagcaggtgcctgggaagccagcttaacataagctggctttgggctgtcctggcccaggcctggccctgcagggtgactggaccctgcccagacttgcttcctggggaagtgaggaggcacttcagggcttcaaggcaatggcagcagattggagggagggtagagtcctggaaaggctaggacctggcaaggggcttccagtaggtttgtatgagggaagtttgggaagttgagccatgcagtctttggccttaactctgacctgccccaggccagcacttacctagttgatgggggagtttgggtgactcttgggtctttgtgcacgtcagccctgtcctgctgaccagagggatcccctcatcccatcctgaccaggaacgaaggcccagctctacctccccatatgagaacaagcctacttcctattgtggcaacactaaaacaacagggggagggaagccccacgggcggacctggggcaggtctct

SEQ ID NO: 52339 - DNA, 1050 bp, Homo sapiens
cacactaagcaccattcagcattgctacggctaatgtcccagaaccttgagacaccccatgagttgagctgtgacaccccagaaagggaggcaggccactcaaagccgtacttagtggcacagctggaactcagctcagggctcctgcgtccctcccaggcctgcccagacttttcagaactaaagtcctctccatgtgtgttgtgaccctgtttcccactccctacactgccctctgaccacaggctgcagtccaggcaggctgggagccagtgagtatgcccattatatagagtagaaaactgaggcccagagaggggcaggctgtcacctgcggtcacatggccaacactctaccccaagtctcctggcccttccctggtgctgtctctactgagccaagaccttaggtcctgggggatgacccctagcactctagagccaggggtcagccacaatttttggtctcctacagcaactccatgggaagaacctggtttttagtgacggctacgtggtaaaggagacaattggtgtgggctcctactctgagtgcaagcgctgtgtccacaaggccaccaacatggagtatgctgtcaaggtgggcctcctgaccacgtctcggccaaggctgctgggttgggggcaggtccccgtctggtggggagggatggtgcctgagctctgcagatgtatgaaaggtgtgtggccgagacctcctggcctgctccatggccagaaaggaccctggaccctgtcaccctgacactgccacatgcaccccctttcttcaggtcattgataagagcaagcgggatccttcagaagagattgagattcttctgcggtatggccagcaccccaacatcatcactctgaaagatgtgagtgggggtccttaagactggggtggggaccaggaactcaactctcaggatttgtctcaggattgccattcctttgacttctcatcctctttccagtggtcatgtggaggggaaggaggtcccttggtcccttcagtctgcccataccccaagggccctcctt

SEQ ID NO: 52340 - DNA, 1367 bp, Homo sapiens
aattgcttgaacccgggaggcggaggctgcagtgatctgaggtcgtgccactgcactccagcctgggtgacagaggaagactccatctcaaaaaaaaaagacttttaagattttgacctaagtaacaggaaggatggagttgccacaaggtaagattatgtgatgagtaggttttaggggagaattgagagttcagttttgacaggttaacttagagctacctgtagacacctacacagagtcagtagcagcagcaataagaccatcatttcagccccttccccttctctcggatgccaagtccatgcacccgtccctctgcaccctgtctgtgtagctttctaatctctggccgctgacctgggccactagccacctccccacactgagaactgaccccagccccctgcccctaggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgagtggcccagcctcctcagctgtaagagtgagggggaattggaggccttgtgccccctcccagaggccccacattagccgggactccagtctctgtgaccttggcccagctggcaagggaagatctagcctgtgcctgggacccttgtcctgcccttgaggggagtagcaggaaacatctgtggcgactttctactgcccccccagactgaccacctcccctgccctgttgccaggtgctgaagcgccagggctacgatgaaggctgcgacatctggagcctgggcattctgctgtacaccatgctggcagggtgagtgcccctggcctggacccttccccactcctgcagccctagcacttgggctgagtggtgcttgtctgataggaatggctcagccagccccgccccaggatggtctggaaatagggacatgctcctgcctccaggagctctaccttgggagtaccccatctgagggggagacacagtctcccaccgcagccccagccccagtatggaggccagagtctgtacccagaccgtgcgggcttttctgcagatatactccatttgccaacggtcccagtgacacaccagaggaaatcctaacccggatcggcagtgggaagtttaccctcagtgggggaaattggaacacagtttcagagacagccaaggtgagtctgtacggcctgcgtgggcttatttggaggagggaggcagggtcccatcctagggcttttcagcagttcatgaacagcctcatttctccaagcggatgtt

SEQ ID NO: 52341 - DNA, 1073 bp, Homo sapiens
tccagtctgatgggggaggcaggacccatgaccataaaggaccactgaggctggattaacagtgggctaggctgggcgcggtggctcacacctgtaatcccagcactttgggaggctgaggtgggtggatcacgaggtcaggagttcaagaccagcctgaccaagatggtgaaaccccatctctactaaaaatacaaaaattagccaggtgtggtggcaagcgcctgtaatcccagccatttgggaggctgagacaggagaatcgcttgaaccctgggggcagaggttgcagtgagccaagattgtgccattgcgttccagcctgggtgacagagtgagactgtatctcaaaaaaaaaaaaacaacaaaaacaaaaccaaaaaaagtgggctgtggaacactgagaggggctggcctacccttggggcatggatcccctccccgctacatctcccaccattgtgacctgacctccccacttctctttcagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcaga

SEQ ID NO: 52342 - DNA, 1019 bp, Homo sapiens
actgttcacaaatgtcgaggtcagaaaacagaaagaaaagactgaggaactagtacagattaaggtagacaaaagagacatgacagctaaaggcagtatgtgatcttggatttgattccagaccaggaaaaaaatagtcttatatcatatttttagggctcatgcctataaccccagcactttgggaggctgaggcaggaggctctctctcaaggccaggaattggagaccagcctaggcaatatagtgagacctactctctacaacaaaaatttataaattagcctgatgtggtggcacatgcctgtaggcctagctacttggcaggcaagaggattgcttgagcccaggagtttgaagttgcagtgaactatgattcagccattgcattccagctgggcaacagaacaaggctctgtctctatcaaaataataatatttttaggacaactaacgaaatgtaatatggactatgaattagttgatagtattacatcaatgttaaatgtcctgatttttatatctatactgtggtaacataagacaatgaccttgtttgtttttttttttgtttttttttttgagacggagtctcgctctgtcacccaggctggagtgcagtggcgcgatctcagctcactgcaagctctgcctcccaggttcacgccattctcctgcctcagcctcccgagtagctgggactataggcgcccgccaccacgcctggctaatttttttgtatttttagtagagatggggtttcaccgtgttagccaggatggtctcgatctcctgacctcgtgatccacctgcctcggcctcccaaagtgctgggattacaggcttgagccaccgcgcccggccgaccttgttattaagaaatacactcaggggtaatgagtctcgaatatatctcaaatatttcaggaaaaaatgtgcatatatttataactatgtatgtaaagagagaataataaagcaaatggagcaaaatgtaattaatttatgaatttggataa

SEQ ID NO: 52343 - DNA, 2190 bp, Homo sapiens
tttgtcctggcagccctgcccccttccttggctgctctgccgctggagttaatacgcccagaaactccgcctgatcctccaggcctcaaatccagtccgcgtttgctaagtgccgtgcggtcggggacggcgataagaactctcctgtgagggagagctagcgagactttagtccggtttccatgtcaacgattcagtccatatttgccatcaggctgttggccgaggtgctttcgcgagggtagcgctgtcctagtcctagttctccaatctgcgccgggattcctgagctgcctgggtgtggggttaaaaggcaggggccgtgggggaaaaaactccaccgaagggaggacccactgcccccagccggggtctcgctgctcgggccagccacgtgcccagctcctcccctcccccgctttcccgttgccactgcccctagggaaagctgatgggccagtttctaaaaaagttccctcagcccaacatttcctgggatcgtggtgtggggctctaaaagtaaaagtggaagagaaccctagtgaattaaaaaaaaaaaaaagtagagaaattccacattatctcctccaacccaggtggatagatttttgtgcactttaccttattgctagagaaaaatggtgactgttttcaaaacagcttgcccacgtgtagggaaggagatttttggcgctttccatatttcacagccattgaagaaaggggatgagggctttctttggagagaaatccattctagcttccagattttcactgggctccaggtttcccattacaccccagctctaaggaaaatggcagagtaatggcatgtaaaaaaatcctcatttgtgtgcaggactcaggactgtttgccagctcaggggcagttgattaaatagccaagctctatttatgaggcagcctataatttggtttctaggacctaatgcaccggggagagttgttgcccctgaggactgtgagtgaaaagagggcactggcccataccagtcagtcggatcttcttggtaggctggtttggttcttggcttgaggccgggggaggggagaagaataaaactgtgggattttttttttttttaaatctcatcactcttagattaacaggaaggttttgcctttctggtgtaggatgcagtaagttttcttggggagagaaatgagttcaggctttggaattattcatagtgaccagggacattgccagcactcccgggtcctgcataatctaagataatgctcctgtggccatgaagtctccctttacaaaatctgagggggaaaagagatcctggtgtctaggaacactggcctgggcctttcccaaggcagccttgggtctggtgaggagctggaatcccctctggcttttgtagcctgtcatatcagaacattccaagtcagcctgaggaagaaaaggctgctgctgggatttggtggggcctgtagatcaggagaacactggagctttctgtgtatgtcgatcttttcagataaacctggccttctacccaactccagctcaatcggggtctcttagaatgtaatggtaaactttaaacaatctttacgctacaggatagaaaacaaatctgacaagcatccattttctaagtgacttgttggactgtgccttttcttcaaggagaaaatggtttccattttctgcatctctcttctgtaatggtttgaacactcaggttcctgcagtccctggagcctcttctgtgggttttcagtattagaaggtactgtctttggagactggggctacttgtcatggtaggctaagttttcttaagagggagtgagaaacggtgtttaggttttcctgctgggtaactgttctatgctcctaaagcaacttcagtggcctccattttaagttagtggtgagatgatcagttttgacttcaaatccattttgatattctgatcccattgttgaatgtgctcacaacttgatttttttttttttaaaggcaagtagaccgaaggcagctttggtgactccacttctttttaaagtcaccctcctctgccctctgactttaagtgacaggcagttccctcccctctctttcaattctgtaaaatggggataatccggacctcatgcccccagagccttgtaaggaccggctaatgagggcaggcgagtgggaa

SEQ ID NO: 52344 - DNA, 8738 bp, Homo sapiens
tggctcttctctcttaaaatggctgcctgtctgccttcctctccttccctccttcagcctttgtgttgggtttttccagaggtgtctgctcctctttttcctctcccctggtcccttcgaactccaggggtcttgatgggggtgcggggcagagtgtgcggggaagggcctggccgggggtgagggggtgagggggcgctgggggctcaggttaggagtgtaggcagtggtaggagcccaggagttgaatgaacgtttctttgctcacctgccgctcctctccgtcccccggccttcctctgggccgccccccatctgtgctttcaaagagggcccctagagctcgaggggacctcgaggggagggcaggggactgcttgggagctgctagaggccggctgcggttcacctagggcagcccggtccatctcctgtcttaggctccgccggcccagtggcctgggcttctccctggaagtgctggtaaacagctgagtgattggagtagtaagtgcagattgctttggtttgggatttgaattatggaggtaaaatccttctgtcaaagccaggagacagttggtcttaggttgacatcctatctgtgatctgattggctccccatctcctgctcttggccatttataattgcctctgatgtaatggtacaacaatcctgatgagctcataaacttttacactctgcttttctgccagtgataacccaaactatcgctgccactatctgccttttattccagagctgaaattggctgtgaccttgaggagggaggtttaagtagcaatactgtatcagcaagagcaaagcctcagacagcctgcccttgttacattgtgcccaaacaaaagaggaggcaatggcattttgcttgtaccttggatttattttgcttgttatgttttatgcagcctgaaatgaattctgtgttgtcagaacagtagctgagttttttctctacaatgggtttgctgtttgttttggttttgtgactttcctgatggtataaatgacttctttgatggctctgaagatgcatttatcttgagtaattttgacactggttgctttgcagaattgaaatgattttactgggctttttattgagtggcaaatgtgggatctttatggggggccagaaaacagtttttgttattttttttagaactgggagctttctgaggaattttatattaggttcaagcggtctgttttaaggaagactggcctcattctttgtttacatgttgaatcttgttaacactttcttttgttaattgaactttggaatagcagcttaatttaaagggaagctggtgtctttcatgatcttgagggactttctcctaaaggcttggtttggtgaaattgtttttttcctggaataacaaaaagtctagttttctgttttgtcatcagtcattttagagctttgaaatagagactggccagtttattcctttgcattttaatgtatgttccactttttttcttgtcttccaagatatgaagatacgacctagaatgacacttaagatttgcttagaaattgcaacttctgagtaccttgttacactattctatcttgttttattttgttgcttttcttccatcttcatcatgctctgtcagcagtgcttttggtcagggatattgagtattctgtggagtcatacatgttttcaaagagggggaagctccattcatcccctcccaaaccccttgcgcttttgtgctaggaggaaattttgttcacttactagctgtattcccagcccatcctagagctactttactactcttttgagctggggattttgaaattagctgtgttagatggtgggcttggagctctgtgccttgattctacatcttccatgatgttctgcatctggacaagaaatagggaaatgttacattgtttttctagtgtctggaggaaaagttttgtcttaaaagacagcatcctcttgtctctgggtcatcctatagtctgaacctctttcctctcattccccttgttttgtttggttttggctgaaaattttacttttcttgaaaactattagaataagtcatttggggtagtaagtcagggttcatttaaaagcaaaattgattggaattctgctggtttggaaatatttagtcaaaggttttaaagaaaaagccaactcttttggtataatgatttttgtttttcagtcagtaaattatggaacactttctgtgtagatgataggagaatagatacagtccctgtttggatgcctgtctgtgctgcctttggatgaattttctgatctcttttattatcactagacccacacaacatagattcctaattaatttcagctcagttgtctactccccagagacccagggaatgggctggtgagcattcagttgtgtaagagacagtgcagcttccacttctgtggactgcttcaggtgtgtggtagtagtctaggtgagggttgtaggttcagactttgttctgaatttctctttgctacttgataaacctcttttcagaccatgatgctctactcttcaacattcttaaattaaaaagtcttgctctgtctccatcttttcctggcgcagtcttagattaagaatattttgcagagacttaattaacacagctaaggtgataacgttttcatttgactctgcgcttatgaaataaagtttaggtaagtgtgtgtattgtggctatgtctttttcacaggacctgggaagatcttagacaaacttttactttattccttttcataagtagtgtatctcaagtgttgaatcccggtactgatgaaatagttttagattacttacacacatgaagttgatttaaggctttttattgggacgctttttagcaataatactttgagagtaataccagtttaccaaggtaaaaaataaaatacaataaatagtccaggaacaagttggattttattgtagaagtttggttgttagtttctactacggaaacatcaaatgatatttctgactcctgggaaacagatacaggaatcctagatttattatgggaatgcctactggcagaaattctaggctggctgaaatacaggactcttggagctctctcaagtaggagggaccaggaaaaccacactgagatggcactttagttgtgggggtttcatgtttctctactgttcatgagagagctggggtgatgaggattgagatggtggtgtgagaacagagaaagcagccaggaccaggtttggcttcttgtgtattgggccctgtgaggactttttaggttcctttctttgtgtgtgacatgagtaaccatgacaagcagcacctgctgaaacaggatgtcttggattgcattaaacattaatatgttggattgactcctgtaggtgtaatgtctacagtagaccttttgcaaagaggttagtgaacttttttagaatgagggaataggctaacaaagtaataggcagggctctttcctgttcccatccctcaaaaggttgtattgattggcttcaactctcaaaattctagaagcaactgaagcttgtaaatatggtaaaaatgtggtattcaaatatattggcaccgagtagttcttttctgccagtgagctgtaatacctggggcttgaatggagtcctgattcctgtggcttttatctctgggtttttccttgtttagattggtcattatcattactgacgcacacttacgttgttattactgatgcatacttgagttgtgtgttgcgttagtggtaaagagcacaggactcacaacaggaggaggaaggaggaggcttaggttccacatacagctccagattaagctgtgtgaccctgggcaggtcatttgctttctctatttttcattttctccctcatcaataaaatgaagttggtctgcatggccttctcactctaagatgctacatatctgtgcttccatagctggcttgttatgaaggcagctttctgtacataaatcaggggtcttgagaccatctttcttcccctggactgaaggaactcaaagctattttctcctgggattcacaggaacaagctctgaacagttgggtgccattgtggtctgtagacttttacagaaaaagctctaccagactgttgccttgaaactgttaatctgtttgtcattagtcattccacctggctggtggttttaaaacactaaatagtcgttggaaagttaggtagatttcattaaagcaagacttgaaaaatagttgcttcaggatccccaggaggcttttgcacttggggttggggtgaggaatggatattcataagttcagtgttgatattctgctgcttttggggaggggtagggagagagagggagcattaagctctccagactcctggtgtttgggcaggtctaggtctggtttgggcagttggttgtaatctgagtgcctggacttgccctgtaagttttgctgagagagaagcaaatgttcctgagactggaagaggaaaagctgcgtttcagggtcaatttcataggtgcatttgttgtttctcatcgctatggtttaaaaaactacatggtgtgctttgcacgtggtcctggaaatgctattctttctcttctccagcacacctgaatttccattctttctcttcctggcttagtagtttagaagtgtaatttaggtatattagaggaaggaagcttccctttataaaggagggaaaagggtagagggaacagtgtttgataattctgtgcttgacacagcatcttctatcgtctctgaaggaaccaaatgtttcagagctttgtgtaaatacttgctgagctgtcaatatgtacccaggaggtttctgtagtaagatgtaaactgttctatagaatgtttgacaggcaaattaataaacagttttcaagcaaagataatgctagcctcctcatgtggtggagtaaaataacattggggaaaaagacttggggataggaaaagggtagtgctggggggcagtgagtgtggagataagaagtgatctaaaaaaaaattgaaatggaaagatgctgccctggtagtgaaacctctgtggccctggctgcgtgctaagttcagggcatgtggtatcctgttaaagtcaattgcagtttcatagtgaaaatagaagtttggaaagaagatcctgactgtcaatagtaaggtaagtattaccccagacacttggcttatgagactttgaggtttaaagggtagcttggtgagattatttttggcttgggtttgcatttctggaatattagaaaggagaaaaaagatactgcaacttgagtgtgatctttatcctcaattttgctgttgtgctggggattataagtccactacccaatggcctgggtttatttatacagtttttactggacttctgtgtatcacttatgataaaattaatatgcctttacactctgttcctgggtcagtacaaagtccaaatatttggggactcactacatcttacttgaaggattatgtgagtagatacagtctttgtttttgaaattgccattttaggattaaaaacatatctgggttccttcagtgacacattctttttatggaagaagaagaagaatctatgaatattttagctgtctgtctgtggtcctcttctttggtagccttgtgagatgaccagatttgccttctcagaatgtcttttttaactagattcattgattctgacaccagttttctttataagaagtgttttttacaccagagtcctggaagtgcccttttgacttagctgtttatatagtagcagggaatatgaatgtaattatggtcctgactatgatttttaggttcagctaacttactaccaaaggctatcagcttgttttaatacaaaacacaaaaacttggattggcactgacataggttgcttaatattgcatggtcctttcccagtatgttggtagtgagggtattaggaacttcagacttattgctgagagcatagtttctaagtcagagagatcaggaaattccaatggggatgggaaatagccctatgtgattacaccagctaggtactaggaagagatttaaaaggtagaaacaatatctccttcagaggcatttagttttcttaggaaagcatgcttatgtgcacacatctggaaaacttgaaaagcaaggtttcataaatggatgtagaccacactaattatgtgagctgaaggaattagaggaaaaggttcaatcagtttggcagggttaacctgggacagcttttcagaggctttttttgtgaagctaaatgttcaagaaacttagaatactaatttgccttttcataatgctattcttaagttccatgggcttgatagaatccacattgcacatccatctccagaccagtagctgtctcagtgttccaatgactttgagaatttggactctaaccataaaactccctgaaagagtggttccagggtcttagtggttcttgtggtcaggtagagcctttggtacagactgttaagttcttggctagttcaggggcacttttctagtaaatttggatttggaaggtcatgtcaccttcagagttgtgtgccctggacagctctgtagtaatggtggttcaactttgttggtgagtctgtcttggcagagttagttgacctttcttaaaacaagagccacgaagtaagtatctgttgggactcttaggctgctatttctgaggagctgggagctgtgttcaagtcaagttgcttgtgttagaccttatattgaggttgatgggttaggtaagcctgcacatatgcagtctgcccatttattcatagaaatggcctttaatactgtttttggccgggcgcggtagctcacacctataatcccagcactttgggaggccaaggtgggaggattgcccaagcccaggaccagccttgggaccaggctattaacatagggagaccccatctttacaagacacaaaaattgctggatgtggtggtacgtgcctgtagtcgcagtttacttagaaagctgaggcaggaggattgcttgagcccaggaggttgaggctgttgtaagccatgattacgccagtgcactccagcctgggcaatggagccaagaccttgtctcaaaaaaaaaaaaaaaatttgttttttattaggttactatggccaagcagctaacaaatgctgctcaccaatgcttaatccttgtggagcctctggaatatagtgattttggtttctttacctgctggtcgatctgtggttgggccttggcacttcaccggtcaaggatcatcagtggatgcttaacagctgaagatgcatggcatgtccagtgccaggccactgtaatgcttctacctggagaaggattggttacactgctccagtacagaagtactgcagacctttttttttttttgagatggagtcttactttgtcacccagactggagtacagtggtgcaatctggctcattgcaacctctgcctcccaggttcaagcgattctcatgcctcagcctcctgagtagctgggattataggcttccaccaccatgcccggctaatttttgtatttttagtagaggtggggtttcatcatgttggccaggctggtcttgaactcccaacctcgggtgtgatccacccaccttggccttccaaagtgctggaattacaggtgtgagccaccacgcccagccttttttttttttccccccccctcaagtaatggtccatgacctgctgaaagtactggagtcttggataaacattctggtttagaaataccttttccactttttttgccttgccattttggcattttgcaaaagtgggttttcagttactcagaattgggcaccatagttaacctcctatggattacaggtgtttaggggcttgaactctgatcattcccaggttttagaggaatccaagttcgggtgaatattgacttagtagccttgagtattcttcctgaaattacccctcctctccatttaaatggatgaaattagttttttactgaatgtgaagggacatctgaatgaacttctgtttgtttttgttagtcacttgtgcatagctggaatattatcttgggacaggttgagtctatttcccagtggcttctgcattttctaagggtggactggaatgggaagaagtctaatgccaagaatgcattccaacatgctgcagagtaggaaatttgatccctaaaatgttgacttagtgttggtcatggtacatattagaaatcacccagtaatccaggacagatttttgtcaccctccaggaagttatgttgatataaatactaaggggctttgggtactgagctaagtgctctgcaggcccaaagcgctgcttgaattgctacccatatgaagaggaaatgtgccatgtgcctttttttctctcttttgcatttgggcttccttatggctttgttgcttttatgttcccaagtctgcaaagttagatattagacttcctcctcccttggcactggcagattcatgattttccatggctcatcactagcagccaagatttttgtatgcttttctctcttaaacttgttcgttttcagcttgcttgtttataggcatctctgttaaaaggaacccttcttttccccttaagatctagcaccaggggtgct

SEQ ID NO: 52345 - DNA, 2529 bp, Homo sapiens
gcgggtggatcacaaggtcaagagatcgagaccatcctggccaacatggtgaaaccccgtctctattaaaagtacaaaaattagctaggcgtggtggcggatgcctgtagtcccagctacttgggaggttgaggcaggagaatcgcttgaacctgggaggcagaggttgcagtgagccgagatcacgcttgaacctgggaggcagaggttgcagtgagccgagatcacaccattgcactccagcctgggcgacagagcgagatgccatctcaaaaaataaaataatacatacacacacacacacacacacacacacacacacaccacttgttgttccagcttgagaagtggattagtgcagtggttctcagtgtggtccctagccaccagcatcagcattactaggtcctgttaagaagcacagacccttggccagtcctatcgaatccaaaactctgtcaatatgttctaacaagtcctctaggccattctgatgaacactgaagtttgagaactactagatttatacatttacactcaactgggctgcagagtatatccagattacctgaggggctgcttctaaattataccatagattgatgttttatgtctatgtgccctcctatgaaaaaagtattaatgaatggagaaaaggttaaaatgcttgaggctaggggagtgtgttagtttgcttggactgctgtcacaaaataccatagacgaggtggcttaaacaacaaacatttactacttgaagtcctggagggtgagaagtccaagatcaaaatgctggcagatcgggttcttggtgacagtcattttcctggcatgtaggcaactgtcttctgtcttcttgccggtctaccaccccaattaatgccctcttagcctcttatgtctcttgctcttttttttttttgagacagagtctcgctttgtcacccaggctggagtgcagtggtgcaatctcagctcattgcaacctccgcctcctgggttcaagcaattttcctgcctcagcctctcgtagctgggattacaggtccacgccaccacgcccggctaattttatttatttatttatatatattttttagtagagacgagatttcaccatgttggccatgcaagtctcaaactcctgacctcaagccatttgtccacctcagcctcccaaagtgttgggattacagacgtgagccagcgcccccggctcttgctcttataagggcactaagcccatcatgggggcacaccctcatgacttaatctaaccctaattacctcccaaaggccccacctcctattaataataccgtaacgttggaggttagggcttcaacattaatttcagggtttcataaacattcagccagtaacaggagaagaaagaaaatacttttgagatggacctttactagtgcagtgataagttctagtcacaaaacacgtctgcttgtttataggacttgggggctccctgccttccatttctctttctcttagttcttcggcaatatggcatgaagataatctggacctgtggtcctgggattttgatgaaggtgggaaaggtattttaagatcttgactggcagggcatggtggctcatgcctgtaatccaagcactttgggatgctgagctgggcggattgcttgagcccaggagttcgagaccagcctgagcaacatggcaaaaccctatctctacaaaaacaaaaaaatcagccaggcatggtgatgcgcgcctgtagtctcagctacgtgggggctgagatgggaggatcacttgagcaaggaaggctgaggctgcagtgagccatgatggcaccactgcactccagcctaggtgacacagcaagaccctgtctatatacagaaaaaaaaataggatcttgactgtggtggtctccaagtatggccaatacagtacacttttccaagaaagtgattcttgaaaatgccacttaaaggtcagtgttggagcactaattaaatgccatgatgtcccttttgcctgtgatggctgtctgatctgagaacagggcgttgggtgatttggtgttctcacagtaagcctttattgacctctctccctcaccccctacttcttagtggccagtctgagttttgctgtgaattcctttccttgtgtctcttcttgtgaagttttagtaaataaaccctgtaagtaggccgagagcagtggctcacacttgtaatccccgtgctttatgaggctgagatgagaagattgcttgagcccaggagttcgagaccagccttggcaacatagcaagaccttgtctctcttaaaaaaaattttttttaaattagctgggcctggtggcatgcacctattgtcccagttacttgagaggctgaggcaggaggatcacttgagcccaggagtttattggaggctgcagtgagacctgattgtgctattggactacatacagcctgggcaacagagcaagaccctgtctcaaataaaaataaaccctctaagtagattcctgaac

SEQ ID NO: 52346 - DNA, 1077 bp, Homo sapiens
ttttttttggcagagtcttgctttgttgcgcaggctggagtgcaatggcgtgatcttggctttctgcaacttctacttcctgggttcaagcaattctcttgcctcagcctcccgagtagctgggactacaggcgcccaccaccacacctggctatttttttgtatttttagtagagacagggtttcaccatgttggtcaggctggtcttgaactcctgacctcaagtaatctgcctgcctcggcctcccagagtgctgggattacaggcgtgcgcccagcctgtgaagatttttagtatctgctttcctttcttggaaaagcctggctaactagaggcaggaaatgtctatgtctgattaacaagttcctaaatggtctctacctcttctcatttcccactttattgtctttggtctggagacagattccttcatctgtttttggggttctgttgacccagtacagatttgtaacattgtttttctttacagtttgtgatttcaatcctctgctttcccaatgccactttgaattggcttctttaaaactccaacataaaacctcaagtgaccaatatgtggtctcattatggtattttgggttaaaatgaaattaagatagctgggctcacccagccaaacacatttaccaaagggaaattttgaggcatcatagactgtgaagtggttagggaaaaagagagttaaatgttggctagtttagaatgccaagtgtccatcccaacttggttatactggccagagatggcaaagaatagagacaataaggttctgaaaagacagctggtgactggtatggccctgtatactcctgggataaatcatgaagtgagggtctcctgtacatacttgtatagtttgtatagacagtggtgtagatgaggttggtatgtaccagcatacttttggaactttgagaagaactgtagaatttgtagtactctggttttccatccagggaattgctgaccttaaaacctgaggatttggatgcatctataatcttttttgtttgtttgtttgtttgtttgtttgtttttgagacggaatctcgtt

SEQ ID NO: 52347 - DNA, 1708 bp, Homo sapiens
tttataggaagttatccattgaggcatgctgggctagagttcattgttcctcagcaaggctcttctgttttgtttttgtttttgttttacggggagatggagtcttactctgtcactcagggtgaggtgcagtggtctcagctcactgcagccactgcctcccaggttcaaaccattctcctgcctcagcctcccgagtagctgagattacaggcatgcaccaccacacccaactaatttttgtatttttagtagagacagggttttcccatgttggccaggctggtcttgaactcctgatctcaggtgatctgcctgcctcgccctcccaaagtgctgagattacagggtgagccaactgtgcctggccaggaaggctcttctttttgtggtgctatattgcaggacattggcatcttgctccccgggtaataaatgccagtagcactatagagttgctgtgacaaccaaaaaaggcgctttcatacatttatttccaaacacttctcagtggttggtattgccccggttgaatactactggctgtactgtcaggattcttggaaggagctttgaacaaaatcctctgggagaacagactgaaagtaggtggtgcttgagacttggactggccaacccttttggtgtctgacttgtgtgttcatgttttttaagtaggtattttgaaactgctctcaaccccattttgccatttctcctattgagggtgcagagagagaagtattgtgtgtgtgctttatgaactggcactgtaacaagcatttcacatacttaccatttgaactgttttgtatctttgttaaacagtttttaatccctgtttacagatggttctggtgctaagagataaagtgacttgctcaaagtggtgtgaaactatacttttttttctttctcaaaaagtacagcctaaatttatttgattgtcagttaacctctagttgatgactttggacttctggtcttaagtgtatgggacagacattaattgttctacaaatttccaagctctactgccagaaacttagcacttgtgtaggatgatgatagctgccattctggatgctagaggatacagcagtgaattaaacatacacaggacatatagattgaacaagataaataagtgaatcatatatatagtatgctagtgatacatgcttgggagaaaaagttaatcaggaaccaagtataggagtgtgcagggttaaaatcttagaggagttcaccagggaaggccacactgaagtgatatttgacatgaaagtgagctatactaatatctgggtgaagaaagtattccaggtagaaggatctatgaatacaaaggctctgaggctagaggatgcccagctgatttgaggaacagtttttttgtttgtttttgttgttatttatttttgttgttgttgtttctgagatgaagtttgctctgttgctcaggctggagtgcaaaggtgcaatcttggctcaacgcaacctccgcttcccaggttcaagcagttctcctgcctcagcctcctgagtagctgggattacaggcatgcaccaccacgcccagctaatttttgtatttttagtagagacgcggtttctccatgttggccaggctggtctcgaactcccgacctcaggtgatccacctgcctccgcctcccaaagtgctgggattacaggcgtgagccac

SEQ ID NO: 52348 - DNA, 1148 bp, Homo sapiens
tactgctgccttttgagataaaaagttgtaaagaaggggacgtttaattttatgagatgacattttggttcttgtttcatagttttcttggggtcttactattgttttggtcaccctggtttgtttttgtttttgtttttgttttgagaccgagtctcactctgtcacccaggctggagtgcagtggtgcgatctcggctcactgtgacctccacctcccaggttcaagtgattctcctgcctcagcctcccaagtagctgggactacaggcgcgtgccatcacacccggctaatatttgtattttcagtagagaccaggtttcaccatattggccaggctggtctcgaactcatgatccgccctcctcggcctcccaaagtgctgggattacaggcgtgagccaccgcgcctggcaacccttggttttaagcagtacctgaaaggattttttccagagaagttacttggtttccttagtggcttttgtaatttgtttgaaatagggagaaattggttaagtttagtcttaggaaaaagtgatcttcatcattttaggaagagcattttctctggaaatgatgatagccacctgttatggaaaatgtggctaatgaaagtgccctggatgaagagagaaggacttatcatttgttgggattcattagtttgatgctgtagctgctttatttgaagggccctttctggtgccaaagaagtgaagaagcatcagtcacttggttgtggtttttctggcatgcctctttttggtagacagctgtgaggtggttattatggttgtttctcataatctgattgagttttgctacatgattcaatgactcttccccttttggtctccttcttctaaccttagtgagttttctcttatcttctggtctggaaggatagagatatggtagtctatatatctctaagcccagaagagaatgaggcctttgtcttgttttacatcactttctagatgttcttggtttgacatctggttgcaagcgccttcctggaggtttgatcaggctagtgcttcaggggatatcattggaatgggctaagtctgcaaaggggaatgtgtctgatcttctagaatggtttctgtaagcagaatggggtagatagaacttttcactg

SEQ ID NO: 52349 - DNA, 1441 bp, Homo sapiens
tgacctggggctgttttctgctggggtccttacccatctgttctctcggctctttctgggttatcaggcgccagtccaagtcctcccaggcagccagcttcatggccagagattacgagcactaaccttcctggcaggggcggtgtggcttcgagtttatgcagattagccatgtgtttctcacttcaaggcgttccacaggaaaagccttttcctgtgtttggctctcagtgggcggttcccagcttactgtactgggactcagcaagcagcaggcatgcaccagagggatcacagtacactggcccccctctccattccacctccaatgctacgtcaccacaacacaaccactcgcgctctcatactgttggtgtcattcattcggtgccaagattgctttaaaaaattcccttggccccagttcaaacaggagtacagctgggatgtgttagattttaggcagtctgccctcaatttgagatgagttataaatagcagtgccgacttccttaactaccgctctctgaggtaaaatgcaggttaattactgtgggaatcaattaggggggttcttttggttaaagagccagggatgcatttttttaattattattattaaaagtcatataacaaatctagccaggaataaattgaaagcacaaggagtaataatacttaaatgtccaaaagccaaggttatagctctaggtttacactagccccaactagttagcatttaggatgataaaatgagtagtggtcaagacttctcctctctgatggacacctttttggcagctcctggcccaaccctctctgttcttattcttgctggcccttggcactgttgagtactaaatttagctccttagggttgccgcctggtcacttctttctatttccttggattggaactggagctttcctcagttggacttttatttaaataaaattatgaagtttctctttcctggtgccactgccacgggtggtacatttttgtgaatggtatatctctgcttagaagttttgagttcttggctctgtcttctctgctctctcctcggtcatggtcagatggagaatttgcagctattttaatctgtgagtttcacaaagtggttactttgggttataagacattcagcccaggtctaccttaaaagtctagtctgttatttcagccgtttttgggggtcattttggttttccttgatgcaataagaagttgtaagaggttccagtagccagctagtctggagggtcttgtaattctattggcttggagcaggggaactccctatgcaaggggtctgtctgctagctgtttgttctgaatatattcggaaggacaagctgctaggcatccttgcctttgatgcccctaaactgcatcttttgatacatttcatttggcaggcagtttataacatggcca

SEQ ID NO: 52350 - DNA, 1169 bp, Homo sapiens
tggaaggaggtggtaagtggtagatggagatgaggagttttcttatggctctttcccccttttttatttttattttttatgaatgcaggagagtatatagcagggggcccgactttgctgatcaaggggcagcattttcctctcaattatgtgtctctgtggcagagcctttgcttttgaagtgtaatcacagtaatctactcctgtggtttcccattgaaaggatttcctctgtctttcccagagtggaatctctggctttttgcagctagggtttggagtttccatcccctgccttgtgcctgcagactgctgatactggcttttgtatcttgcatgtagggatttttctggtctgaaattgctactttccaataaaactgattagtgaatatttaaggccccttctctgttacgagagattgggagatggcatttcatctgtaactgcaaatcacaaatatttcacgatggttttaaatgtcataagtgtgagttatgtccctgctcacctccccttctgatttgagcagatgtctaacttttacatgagatcagaataatctgattgtttgaactgaatatatatttagtttgccaaataagctgcatattctgttgatcataagccttttgtgatgggagggagtcaaaaatctgacgaccagaaaaagaaagcatattaattttatttttagaataaaaatttctttgatgtacatttatttttggtctacaaagatttcctaaagttgaggtgggacattccttgaaccctttatagcccccatgtaagtagctgtactcaattgggagcgcaggcctccgtgtgagagaggaaaaggtgacttgtccttagccttttgtttttaagcagtgtatatgaggatgcccctgcagttctgaaattctctctggtataaaccttttttttttttttttttttgagacagagtcccactctgttgcccaggctggagtgcggtggcacaatctccgctcgctgcagcttctgccttctgggtttaagtggttcacctgcctcagcctgctgagtagctgggattaacaggcgtgcgccaccacgtccggctaatttttgtattttagtagagacggggtttcaccatattggccaggctggtctggaactcctgacctcaagtgat

SEQ ID NO: 52351 - DNA, 2051 bp, Homo sapiens
cattgtagagggctttagagccaggtaaaagcactgttttatcattactgataatcgctaccatttattggacatttaaataccaggcactgtgtgaagtgtgttatgtgcatttaaagaactgatgtgttcaaggtaggatggtgagagaggtaggatttggacccaagtctatcaaattactacactaccctctatgtaataatactgtgcaggatttagtagttaggaagtttggaactattattgaccagggagtggtggaagtgatttgggaacagcattgtcctagaactgctctaacataataagccactagccacatgtagttatgtgaatttaaattaattaaatgtaaataaaaataaaaatttagttcctttgtcatatttcaagtgttgaatagttacccatcacagaaaatgttattggccagtgcttctctagatcactggttcttagctaatagtatacaccagactcattcaaagatcttaaggaggttggagaagagcacaagcccttccagacccagtaaattggaatctctagggagaggcctagccatttgtgaagcttcacagaaaattctaatctgcagccctggttaatagctactgctctagaagctctatagtaaccatggtaatgactgcccctcatgttgtggggagacctagactgacagagatacccagagcaggctgatctctttgttcaacaaaatagtctctccagttggaggccacatggacagcagctgcagtctgtgatgagatgaggacctcagtgtgatatgtggcatgatatggccatgtaagcccccaagctctttacaggggagaatggtgatgttttggctccattgccaggtgtattggggaggaccgtatgctatttattaattgttgttaaattcgaacttcctaagtaaccctaaaatctatgtagctctaaaattatgatagggaacattattggagcttctgatatggatgaaagacttgggcaaaaattgtttagttaggattgttggcaacagtactttaataatattgacatgtagtagtgatttgggacacagttttactatgactttgtacagtttagaaacatgggggaggagtattcccatcatcactcaccaatttagctgagatttcagatatagcctaagaaataactctgcttctcttttttccctttgatattaagaagaacagcctctgtggcttattgtcttacctgttttctttcatgaaagctctacttcctctactataaaacacttaatagcattattaaaaaacaaacacgtacagagaacgaattgtttggatctccccttcctttattttggaggttttgttgttgtttaaggtcttaacagcttaaattatagaatagcttattaattattgaataatagaactggaaggaaccctagggataacctagaccagtcctgggaggtgggttctagcagtctgttttaacaagcctttcaagtgattctgatgcatgctaaaatcaatgaaccactgaactccttcatgtgacggttaatgataggcctagagtatcagtatctatttcacccccaatgtaagagctagtttttaagttttatatcagacccatgcctactctccatcttgtgtgtgtcttaaaggtgcttagagaaacttccccctccccgcacaccaccaatagatataggtagatatttctggcaggggaaagtgtgctctggagtgccagtaggataaaggcatatcaaaaagtgaatgagctggttgaacctgttgctccacaaagagctggaaagaaagctgttgcatcaaatacctgtgaattgaattttgagctttcattattggtgctagctgtacctctctgtcttcttgctcttttttttttaacttccatgacagcctaccattgaatcttcttgtctctcaaagagataaaagttctgttcttcttatatcttcaaactcttgaatattaaaggaaatgagcttttcagttgagatgcacaagactcttaa

SEQ ID NO: 52352 - DNA, 2020 bp, Homo sapiens
agctatagaatcagaatgtatccttggcttccaagcctcttgacaggaatgtagacctgttggctcagttaattacagagtgctactaacaaagccaaagctataggcaccgttccatgtgtgctccaaggaaaactacttactccctggtcacaggtacgtatctctttttctcttgacctgactggccagcttatacctagtgagtggtcatctctgaatgagatgggatgaaaggcagtggctgaacatgtaggcactgctactattaggaaaaccattcatatcatgtgccctggtgacggaagaggccctttatgcttctgaatacctttaacatatctgccttctggttcaaaatgaatgtgactgggagtagaagaaaaggggaagattaaacagaaaagatgttaacagcattgatacaaatgttaagatttccccttatccatctctttttgtcgaaccattcacatcattatctctttattgtcatttttgtattgacaaagttttctatcatttatctttgagtgatactcatactgaaaatagggagagaatataaaacaaattttacttctaagactttaaagcaaagtacgcctttaatatagaaaattgtctcttttttccaatagaggagagatgaggtaattttatttattttttttatttttttgcctgcttactaaatatatccccagtgcctaaaatagtgcctggtacaagtaattgagtaggctgtcaaatattttttttgaatgaaaactaaatgaaagagagaaccaaagtagcttagtgattttcacactgtctgaattactaaaccttaggttttcagttggttgagccaggctgctattgactattcattgtggttagggtacagattcctaacacttataaaaacagtctaggccgtgataaaaagagttaggctcactggtagaaacagctgctctcaaacttatgttgcccaaatagtaaatagtgtaaattttcagtggataaatgtagtccacttgtaaacaaaccacctaaaaacccagcttggccgtccttcctggctcagtttaggcagggtgagagaaaaaccctgggcctcctaagtatgaggccttgcatgcttgctttctatactcatcatcagtgcatagcttctcacaaaacacttcatctttcctcatgcaggagagtcagtgctaaaagtatattttcctttcctacagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggtaagatatccctgcctcctgcccttccctgtgtgtgactacagacagcttgggggttagtgtcatgagaactttgctgtacagagtggttctctaacgtgcacttaaagaccaattaaactctgggtaaacatgataactggattgattgaactaataaaggcataacctccttaactgcataaagacctgtagctctccttaatgatgaagaaatagggcaatggaaagttgcatagatggataagaaattaaagataatgggactggtttttttattttattttattttattttattttgtaaatcaacatcagaacttcagcatctaagtg

SEQ ID NO: 52353 - DNA, 1602 bp, Homo sapiens
aatctagtcatctagtaagatggtgggtagcaaacccaccatgacaaatcctgcttcagttaggaaatggaaattcagccacatacccagataagaatcttttggaattttgactctacttggatgtaaagcctgtgtcttcatttattctgacctgagagaaatggtttcaggatctctaagaaataggcagaaggcgggaactctcttcatcatgaagcctcccatggattcccctgaaggtctctgagacacctcaatagggcaaggtctgcagagtcccttagtacctggtgttcaggcttctgaggccagaatgcagataggacgtctgagattgttgactttctcaactgaggaattgggggaaggaagtgccttaataaagtgatcactctttgttcccttctcattagtgtctgttgcaatccttttctgcatcctgaacttcattggaatgtgctttttaacctgattcagtcagaatgtgtaaccactccctcatcatctgtggtctgtggctaaatctgggtgaggtgctattgtgtcaagaacccaaatcggtggatttctgtcagtgctgtaagttgcttcattccaaaaagtttttgcttgcttctggtgaccttttgatagatctgtatttggcttctttttttttttttttttttggtcctgagaaggcttgtatccagagatgctacatgccttgtaagggttgggaatcttaagaacttcttatctgacccactgaagtgaaggtgaaggtgttggcagccttttaggcccaggggatggttgttcctgggaaggctatcacaaggaacattcccacgtttgggctttttctaaagattcatccaaatgggtcatttgctcagtggtagaagctccatgtgggaggtaagctggctgggttattggcatcttgttttttgaattgctttttatccctttgctacttgggcaggcatcaaaaagtggttattctttgaaattttggtttgatgccagatttgcctacgcaggctaggaagcagccccatctgaagaaatgacaagttggattccctacaagagccctctcctttcttaaccagtcgtgttaaaggatccctaggtttgccagtgcattgcttcactaaacaaatgtttatgaggtacctattggcaccagagcagattccaggctggctggagagcagcccctcagatttcacattgctctccttactcattcacgttaccttcctggccctaaaggcattatgattgtgacccttgaatattacaaaaattaaattttgaggagtctgtgctcagttattgatgccaagccatttgggtgctattatcctgatcatgttatccctatatttaaacctctcaattatttttttgttaatcttagaataaaatccagaatttttttttttttttttttggggggagagagagtttcacactcttgttgcccaggctggagtgcaatggcacgatcttggttcactgcagcctccacctcctgggttcaagtgattcttctgcctcagtctcccgagtagctgggtttacaggtgctcgccactacgcccaactaat

SEQ ID NO: 52354 - DNA, 2349 bp, Homo sapiens
gctggagtacagtggtgccatctgggctcactgcaagctccgcctcccgggttcaagcaattctctgcctcagcctccctagtagctgggattacgggcacccaccaccacgcctggctaatttttttgtatttttagtagagatggggtttcaccatcttggccaggctggtcttgaactcctgaccttgtgatccacccaccttggcctcccaaagtgctgggattacaggcatgagccactgcgcccggcccagcttctgtaacttttcttactgagacacatttgtaaatttacattttggtcttgaaagtgtacctaggatagagtaatggaaaatggatacaggattgaaagctgtgatctgaagaggttagctagtgcttcacaaactttagcgtgtgttaagaatcacctgaattactgcctctacctgagaaattctgattcagtaggtgtgggctgggacctaagaatttgcatttctaacaagctctgaagtggtacagatgctgccagttcagaagaccacaattggaatgagactgaagtaggtagtcacctttaagggaaggaaaaaaaattactagactaggaagccacagcggtaactagaataatagtggtgatttacactgtagtttgactcttgattatttggaaggcacactgtgggttaagaatggtagaaagaaaagagacttgaaagaaactagacttcctgtagctgtggcctcagtgcagtttattcctgggtaacggagcccttgccctgccagtaccaccctgggagctcctctgctctatggtgctcatcactggatcccttcctttagtggggccaaacttagttggtcaccaaatcttagtctaccacagaaatggtttttgcttttgaatctggtttcccctctctttctccactgccttttgttttttcgggtccctgttatctctcacctggtgtcttgccacaaacttctgactgttctgtttcttttcttcctcttttccttccaagtctgtcctcagcataatcaccagagtgatcatcttaaaaaaaaaaaaaaagaaaaaaaaaacctggccaagttatgttaatgctttaaaacctggctacgtgttgtctgtagatttaagtccaagtgtgacatacaagtaagtttttttgggatctggaggatgaggagagatgtaggtaagtttcctgtccctggagtaaaacctggcacactttttgctatgggtgttatgtagaagacaaacagacatttgacaagggttgaacttgtgtgacttctgaggtcatttgaactcttgggtccatgattccgaatatgatacgatgattcctaaaggatcctcctgtgtttcattagtaaaatagacataaaacagaagaccatgtgcctgtatgttataatgagtgctgtcagagtttggtgaagtcactgatccatttatgtctcaatagttgaaggaagaagtcatgttgaagttcagtcagtatgagctagatgtggatgtatttaagtggttagttacaaagggaaagtccagcttgaacagaggccatgcagggatggggatgaggtgcagtatagatacttgggggctggtcagcttccaggggtgggaagtaacaggaaggaaagctagatcacagggatcctgctgagcttaagccatttagatctgatcttatgggcttgcagataggtaactggggcaatcatgtgataaaactaatgttttacaaaaatgatccattagtttgtagtatgctttgaaaacgggagagtcttaaagcagtggaataagttaaaccgtagaactacttctggcaagaggtatggagttctggtccttctgtctcatttgcatagccacctgctcccacatgtggaacatgcaggaaagaatacaggactgagaataagtgggttctgtgtggtggaatatttaaagattttgattgactggtgggcagggggagtctcatttttgaggaaaagttaaattccatatttattttgtggaatataatatagtaagatttctgaaaacaaatgtccagtttctagttggagataagaaactgaaacttgggtaagacctgagtctggatacaagtttgcgagttacctgtgtggtagttaatagttaaaccatagaatgaaacaggcctcctaaactggagtttagagatagaagccagatggagctctggacgatgccggaggccatcaggtagaagcagccaacagagagttggagagatcggagaaggaccaggattgtgtaatatttctggaagccaagggaggagggacgaagtcaaatttata

SEQ ID NO: 52355 - DNA, 7170 bp, Homo sapiens
gattcttgctacctagttgagctttgggagctgacgttttgttgtttaggtttattgagaggagtgacaaatcctctcaataaatgctttaaaaattagaacatttggctgggcacggtggctcacacctatagtcccagcactttgggaggctgaggcgggtcatcatgaggtcaagagttcaagaccagcctggacaacatggcgaaaccctgtctctactaaaaatacaaaaataggcaggtgtggtggcaggggcctgtagtcccagctactcgggaggctgaggcaagagaatcgcttgaacccgggaggcagaggatgcagtactccatctcaaaaaaaaaaaaaaaaaattaaaacatttgaaggattttaattttacacagtttctgttcccttttgttcatttcatgatagaaggagagagggcccacagtccttatctaggtttttgatggttgattttcaaaaagataacagaaatgtcactagcgattttggtaaccagagaagcagggtctttctgaggttggtgacctgttttctttatagctgaccatgtatctgtgcctgctccccttgaattatagcccaggtgctctctcagagtctcgaaaaggaaatccccaccccctctgtcatatctgcccagactgctaagagcagcatgtaccctgtgcatgtagccatcccttctctagaacgctggttctctgggctggactggccaatccgcttctccatcttagtcacactgttccaaccctgatactgcctgctgactgcctgagcctgtgctgcttgcagcagattactgtatgcttgttcctgggcccatttcctgtttctattctagtcgctggtggctcagctctgcttcctgcctgtgtgtctcacacagattcctcttgctggaaccttttgtttccttcggaacagcctcaatctttgaaaagcaactgagccttaactctagtatgatggctcttgagtcacttagtcctacagaggtctggctggaagtacctcttccccattaagcacaccgtttgaattttaccttgtttttcagtttgtcgtcagccctgctgtaggaagttaagttgggccaaacttgtcctcacttattagtacacagagctatcgggactggtatgtcctgattcttttgtacctggagcttttaaatgtatttcctactactcaagaagacacttggtatcctctctggcccaagcttccctgaagcccaggtgatacttattttgagttgggcaggttatgccatcctcagcagaataacaggctgcagaaaacatagggatggaaaagaaagcgtgtgctgactcaaccctccatcctgtgtgagcaattcaaaccccccacccaccccctcagagcttagggtgagagagagaaagtacagtgaggttgtaaaaagggaagaagtgaaggaggttgtcctggacaaatgtatttaaaggcctaaggctcccccctcttgcccatttcctacaaaaaatatgcttcgtgaataaatcttttttctcttcctttacagccactcttttgggatcatttgataatactgagtcagaggatttctgtactggaccctaggtctagctatgtttaaaagagagagatttaatatagggaatttgggcttacaactggaaggagtgagggagcttgctctaggcttggcctccaagaaaccagacccagatttaacctagatttgacctaccaggggaacgtctatctcggagctactattagattgattgctcttgaatcatacccctaaacctgtggtccagaatcagtaaactggaatcaagaagcagtagctgctgccgccagaaccagcacccagttaagtggaggatggaaccaaaatgctcctgcagaaacaagtaaaggagacagaaatatggtctctgcttactttgatctaatctcatgagtcagcttctcattagcagaagctgaattgtatccaaaaccaagggattcttggaaatttcgtttttaagctttttaacctctacaattagagaaagaatagaatggaggctgcatgaactagcccaacagaatatttacaatactgacaccccattcccgtctcccctcccacccccaactttacatatgacgaacctaaggcccagaaagggcaagagacttgtccagggtcattcagtaaatgagaacattggattctctgactgctagtccagtggttctactgttgcttttactgttaggaccaactcctgtacaagaccagcaaaaagatcctttaagaaaaggccgcaggcacggtagctcacacctgtaatcccagcactttgggaggttgaggcggtgagatcacctgaggttgggagttcaagaccagcctgaccaacattaagaaactccgtctctactaaaaatacaaaattagccgggcgtggtggcatgtgcttgtaatcccagctacttgggaggctgaggcaggagaatcgcttgaacctgggaggcggaggttgcggtgagtcaagattgtgccactgcactccagtctgggcaacaagagcaaaactctgtctcaaaaaaatagaaaaggaaaaatgccatattcagaaaatggactttgccttccgtattctctttggagaaagggaaggagttatgaacagatatgaggttgagatttctagatttctaggcaaagttaatgatactacagcttctggatttagttctgttctccagaaggatataagaagcatttactctgaaaggaagaattctcaaaaactagaatgtcctgatattccttagtcatcatggatgaactcagttgttgtagtgacagtggctcaccttcacctattcccccttgccttttcttttgctgttggtgcttttctgtccaaaaagatcaaccaaaatccagaaaaccagcccccagatgtttggttgcttagctgtttcatgtctgcccttggggagacttgggtcttttgaacagaaaatgagccaagtccacccagaaatactatctttgtagaaaccactagggtcctttaagccaaggtgagaatctgtttcttcaaacttggcccagaggggaggacctgtaggtgtggagctatgttaacatatctggccaggcgcagtggctcacgcctgtaatcccagcactttgggaggccgaggtaggtggatcacaaggtgaggagattaagaccatcctggacaacatggtgaaaccctgttttagtaaaatacaaaaaattagctgggtgtgggctgggtgcggtggctcacgcctgtaatcccagcagtttgggaggccaaggcgggcaaatcacctgaggtcaggagttcaaggctggccaatatggtaaaaccctatctctactaaataatataaaaataagctgggtgtggtggcaggcacctgtaataccagctacttgggaggctgaggctgaggcagggagagaattgcttgaacccgggaggcagaggttgcagtaagccaagatcgcgccactgcactccagcctggtgacagagtaagactccgtgtcaaaaaaacaaaacaaacaaacaaaaaaaacaacaccatacctgataaatcaagcgtagaattagccctattgtttttttctttgtgtctacgacatactagaaagctgtgatgaaatcgatatgtattctgttgccatccctctggggaccagtgcttggtctcctaatccccctactcgatggcctgaaagtgtttcatcttccctgcctgttatcagcatagaattggttggtattgtgacataatctgattgccttgaggcagagcttacctccaagctgctagcttccttcccatttgacctttcccaaagaagctaagaatccatgccttgttgaaggtgggaactaggggttgaaggcttaatcttgagagtcagcgaacctgtcccttaaggccagctttgatgtgggaagaatattgaatattgtttactgagatggagatgggtggaggtaatttttcctgacattttggggaaggtaagagaaaccaaatttagactgaaagggatcagtggccaggtgtggtggcttacacctgtaatcccagcagtgtgggaggctgaggcagtaggattgcttgaggccaggagctggagaccaccaccctgggcaacacagcaagatccccatctctaccaaaaaaaaaaaaaaaaatagttggccatggtggtgcatgcctgtagtcctggctacttgggaggctgaggcaggaggatcgcttgagcccaggagtttgaggctgcattgagctatgcttgcacgactgcactccagcctgggtgacagagcaagaccctatctgaaaaacaaacaaataatataggtcaatgttcagaggaaccattatcaagaatatttggatttttatccctcttattttctagaacttgattatagctcccttgtgttcagagttgttcttttcaaagtcctttgaggttgtattctggtttaagattctatccatttctcactctcagatctgtttgttccaccctctccccctaaatatttggattttatatagaccagtaggctaaggtagggaagaccactgacaagtataaatttaagagtttacaaaaccaaggaggccatccagcccctagttctaagccatgttcagcacagtgccaactttgccttccctggctgtccttgcttgctttctggttgctgtaattctgaggggcaaccaggcttgctgtagagaggagagccagatgatgtggaagcctaaggcaacaccccctccttattacacttctcatacccagaactctgcttgctttctgtgttcctttcctctcactcccctttcctgccctctttactcaagttctaagattatagctgatgatcttcataatagaacaaactctgtttggttgaccttcctaacagggaatgcttggctttgagaaagtagggggttcctaacttctttgccttctctagctttacagtgctcttacttcctgctgggattagaacagccctattccataaatatgcactgctcttggctgctgtaactcaggcccagctctgacccagattcttttttttttttttttttttgtcagatttgagtctattaactagtgaccctcaaaacacttcatacatttttggccaaaaagtggttactgactggataagacagaagcctttggggggcagggtgactggtcgggcaggtaacatggtattatacaggcctgatggggactgtgacaaactgaaaagcagggtttcaaccagttagcggcctatgggagttccagaatcatcatcatcatctttttttttatttttatttttggaaaactctcggccaggcgcagtggctcacgcctgtaatcccagcactttgggaggccgaggcaggcagatcacgaggtcaggagatggagaccatcctggctaacacggtgaaacctcatctctactaaaaaatacaaaaaattagctgggcatggtggcgggcacctgtagtcccagctactcgggaggctgaggcaggagaatggtgtgaacccgggaggcagagcttgcagtgagccaagatcgcgccactgcactccagcctcggtgacagagcgagactccgtctcaaaaaataataataataataattctctggggtctgtgggtctgtccctgcagtgtcttgtggactgccccgtgtagctttggctctctcttggatttactccctttgagctggtgcctagaatttctccgggggtaggggacagctgtgaggagcaccttctcatctatcctttgccagttctcattgtgtttggtgtttgttttatttgtttgttggggggcggcggggagcgacaggggaaatgttgagcagaagcactcgatgtgattaaacctccggctgagcagatctgtaggagtagaatatcgacccctggaaaatcaatggctgctgcagtgacccagccgctgtttgcaggggctaccaccacaggaatgcaagcagcccagcagtctttcttctccccacctttttacctcagcagtgccctcagcctccacccagagggtcagacctgcctcaagagattttgcagaggtgggttagaacagcacgttctcgtattttcacaattagattgaaatttctccagtgacacagagccctgcctctggcagcctcctttccagacattccttttctgcactgctgcagttctagcaacagctcttaccaagttgccaaaacccattcggggttgtacttctgagttttaaacaggagaatcaattctcttgataccagcacccaagagcccctcccttgtggaggtctagaattcaggtactggggtataggatgggggaatagagattaagggaaagaaagaggactaatagaggttgtgtctaaagaggatgcttttgagtagataattcattgagcaacatttatcaagcatcttgtcgtttgtgtgtctggcatctttctggtcactaatagcctgatcttgctctggtcccacaggctagtggagaaaaagggcggatagaacacagtgccatcagtcctgtaacactgcttctagaggagcctcagaggaactctgtgccctgcctatagggtgagagtagggaactagtcctgtgacttgggtcaaaatagatggtttaatagaatggctagcagatctctgcttggagcatggaggcttctgattcctcactgcctccacaaaactgttttcatcttggaagttcccaaggctaaaaaacaattttagcctttagttgttgtacctataatgccaattctactctggtggttgggaaaccagccagcctgatgtgtgtgaaaggagagctcagttgccctattgttggagcacctctgtggccagagggttgaagcttgcttggcttttaaagcctctagaaaggagccttcccgtcttgtagcttggagagtggggtccctaaacaaaacccaaacatcctgcagtttggaagggtggctgcagtgctgggtgaggaggaaagtgtgagggtttgaagtggcctaagaggaggcca

SEQ ID NO: 52356 - DNA, 1941 bp, Homo sapiens
gctgttccaaaccatggaggtagtccatgtaggtgatagggcttggtcctacactaaaagggtagtgtcaacctctgcatcttttcttcccgttccttagtacctgcttaattaacttctgacctggaattaccaccgggtgtgaaaggcagcctattctgtgtgttgattctttcttggcatttcagttaacatcagcaagcctgctctctatgcataggtggcagttaatctgttggattgagaccactccgtggaataatgtcacagcagttctgtaacttttggagtccctaccagtctggggtgggtcaaatttctctttcttacatttatagcaaagactaaggagaaaaaaagaacttatgactgaaactttattgtacaagtgttcagtagaggtagtcccttctcctctgctaccctcaacaagttgttgcttaaggaaggttttatgaaaagccaagtctcccaaaaacttatttgccttaagtaattaattttgtctcagtttttcttccttagagtttaaggctattgcctcctctcctaccttttccttttcttcatgggttatgtttcccagtctcttctgtgttcttcaggatttcctcccattcttcagcatgagagcagcctaggggcggggcggggataagggactgacaaattactagtgtagatttggtcattatggaattttttattcaagtattgtcatttaagtggggatggctgagctgcaaggttcccagtgcacacacttactacaggcatgtgcgtaggatttacctggttctcatgacgggtggtttacctgccagtatcagcacaactcagcaaaagcttttcccaactaaatgggtacaagaactccatctgggattccccaaggatttagccagatttatgggaaaaccctaaatctgagcattgccatgagcctattctttatacttaacctgttgccatttaacctgctcagcaaaatgaactgatgtcatcctcatgtggctctattgggagataatttaaacttccctcctctaaccctgatctggtgtcttcctgcttaaaaatattcttcagtgggcagccaattcatcttagaacttgcagttcttcctgtgagagtaccagcacccccaccgtccctaccccacaaaataaggtatggactgtgtgatttcaggcatggttttgttgtggtgtgaagagaaggtgtttagctgctgagttctgtttgttagcagagcctgacaaactcatgctggcactcactagggctgggcaaccaatcacagctgggacggttatcgtcatggagtccctatgggcttcctctatcaggtcacatcccaaaataacattgggcagtatttcaactgaagaaatgaaggctttcagggctgtagccagcctggagtgtgagattctgtgtgaaatagttggatctgctccagcgcttttgatctgcatggtagatgagcaataaaatgcacaaaacacattggaaacacgtgaggaaattctcctggccctgctgcttccttggaactggtagggcactgagtgggctgatcctcacctcccatctctcagcaggattatacttggaggagaacaaacccgggaaaagaaatcttcccattaaaggggcattgctacagttatttccgcagtccttccagaagatgcctgttaggtgtgctcttttgggagaattgagaacctgagagtcctgagatgccaagggcatccctcaccagggagaataggggcttggattgcagtggcgtgatctcggctcattgcaagctccgcctcctggattcatgccattctcctgcctcagcctcccgagtagctgggactacaggcacacgccaccacgcctggctaattttttgtattttttagtagagatggggtttcactgtg

SEQ ID NO: 52357 - DNA, 1019 bp, Homo sapiens
attgcttgagctcaggaatttgagaccagcctgggcaacatggtgaaaccccaccactacaaaaatacaaaaaaaattaaccaggtgtctgtagtcgcagctactctggaggttgaggtgggaggatggcttgaacccaggagacagaggttgcagtgagccaagattgtgccactgcactccagcctgggtaacagccagaccctgactcaaaaaaaaccaaaccaaaaccaaaatggtaatggtagtagtatctataaccaagacttgtagaaaattgggtaactttgctaagtgtctggcatatagtagatgcttaaatggtagctgtagttaatcgtaaatgatttacccctttctatgctaacattttggctcttaaaattatttgaaaccaactatctgatgctgaccagttgccatctaatgaaaatgacagtttgagaggttggcctcaagccaaccaaatcagagagataagaagattaatgctcttccttccctagtatttttctatacccaggcatcccagccaggtgggactactgttgacagtggtttatttagcactttttctccaagaagctcagggcactttaccaaaagtgacagctctcctgaagaaggggaagccacctctttgccagccacagatgcctccagagttctgagaccccagccccaagagctacagaggttttctttaggctcctaggatccctcaggtggaccaggggcattctccttttggatctatggtgagcctggttttttaactgaaagtgtggctgaaaggacctcctcagttcttgccctgagctgataggagtggttggtgggttttggttttttggttttttttttttgagatggagtctcgctctgttgcccaggctggagtgcagtggtgcgatctcggctcactgcaacctccgcctcccgggttcacgccattctcctgcctcagcctcccgagtaactgggactgcaggcacctgccaccacacctggctattttt

SEQ ID NO: 52358 - DNA, 1050 bp, Homo sapiens
ccacctcagcctcccaagtagctgggactacagctgcacaccaccacacctggcttatttttgggggtatttttagtagagacagggtttttgccacgttgcccaggctggtctcgaactcctgggctcaagtgatctgcccgcctcggcctcccaaaaggctgggactacaggcatgagccactgcgcgtggcccagtgtgtttctttaagagaactctttatttaccatttaagtatcagggttttcatcctttcttcaattacagttagttcccagcctgaagtaatgttgctagagaatgaacatggggcaggggatggagttagggtacattttctggggtgaatatttttcatattgagctcctgtttgctaatactggagtttgttgacctagagtgaactctttattgattaactgaagacaagcaaagcctacaaacaaataccaagttctcactgaaaaacataaaagctgggaaaaaaacagaatttgttcaattggcaaacatttgttgattactgttatagaccaggtgttaggagtgtagtcccagaccttcttggcagttaagaaattgtctttctcatccaatgtctctctttcttacctcctaccccttatgttgcaaagtatggtgacttggagtgagtccttggcaaatggaggctgtgataatctatagtaataatcatcattgtaatatataatagaaggagaggggatctataaatgtttcccaaacttgttaacattctcttgtagctcctggtgccatcctggcagcattttgtaaagttttgctattagaaaagaactaaagcctcactgaaatagttgctttcttatgactgtagaagttatgactgggaaagaagacaaaagtgctagatctgcttctgaggggatagaataggagtcagcaaaactcagtcacaccattgtttgtatattgtctgactactgttgcactatagtgtcagagttgagtagttttgaaggaggctttatggcccacaaaggtctaatatatattccacctggtc

SEQ ID NO: 52359 - DNA, 1051 bp, Homo sapiens
agtttgccatatgtaagttatagtatgatgactagggccgggcgcggtggctcacgcctataatcccagcactttgggaggccaaggagggtggatcacctgaggtcgggagttcaagaccagcctgaccaacatggagaaaacccgtctctactaaaaatacaaaaatttagccgggcgtggtggtgcttgcctgtaatcccagccactcgggaggctgaggcaggagaattgcttgaacccaggagtcagaggttgcgatgagccgagacgtgccattgcactccagcctgggcaacgagtgaaacactgtctcaaaaaaaaaaatttttttttttaataaaaatagtatcatgactaaagaacgtgtgtgatgtatttgctcttggttgtttaaggaaaatgctaagcaagtagtaggattattgaaagtagaatctttctgcctaatattactaatccatgttcttatatatatgttctaggatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggtaccctcaagtgctgggctttagggagagggaaaggtgactgcccccagtaatattaaggagccctagtcttccactggcagagaaagcatctctggctcatgcctgcatagtttccccttagcatttggagaaggagattggaacctgttggctggatctctttgtgtgtgatactgggaggtacttggcctcttcatgagccatttctagctctgaattaacttcctagttagaattcccaggcttagccatgatatgcttatgttgttctttgtctggagcaggcaaccagatgccacctcggccacccagtggccagtcg

SEQ ID NO: 52360 - DNA, 2052 bp, Homo sapiens
gctgagacccagcagcaaattgtgaagttagagtgggcttggccgtgttaatgtctccatttcacagtacttgtctgtgttttgatggttgcccccttacattttgcctcatttggtcggcagttgctgaagactcaatgttcggtcttcactcatcaagtcattcattttggtttttgtcattgttctttgtcttttcaaacctccatttagtagaaacagctggcatgccctggttaatggttcatgtcactctgaaggtgcctaaaatgacacaccactatatagaaaatcagatagagactccatgcaagtggctgctaaagaaaatgtagatggtaaagtcccaggataaggatggagagcatttgttcgcattgtataaagctaataactatatggatgctacccacaaataggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtcagtatactacccagttaggagtagatacgggtgagaggagaaaacagttccttgtctgatatgttgccatctagcttgtaaccttgtgagagaagggctgtcctttgcctttaatccacccagcccaggccctgaagtagggcaaggcaagattccatttgtctccacttattctgtcaccatgagaaagtctttcaatttcactgagcctctgtttcatttataaaaatggagattaggtgtttactccaccattgagcacagacaatttatacatggtagctcttggttattatttttttattaattatttttagtgaataagtcataatggaatagatctttgctcaaaattgcagccctaggctgatcaaaagttgagaatcttacacagagcatggaaatagaaaggaagttatcttcttctggaagttgaaatgcctgtgtggcagcaaagccagccttgctctgacctgcctttacatgcttctggaatccccccctttttctcatggcgataaaggctaccatgaagttgatctctttcctaaccaaaatattgaatgacattgtttggtgttctagagttgagagatattagtgagttgctagtgagtgactaaccaagtcttgtcttcctcccctcccaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggtaaggcctgggaagcagagagggtgtcagtgcaagaaaatgtattatagacccactcagattattgagatgcttctggacctaaaccagggggggaaaatgggtgtgtgtgtatgaagtgttaattcttacataccttagatgggtctgaaatttcacgtgactaaacatcatatgtaatgagctttataaaagacaggtttttggccgggcgtggcggctcatgcctgtaatcctagcactttgggaggccaaggcgggcagatcatgaggtcagaaatcaagaccagcctgatcaacatggtgaaaccccgtctgtactaaaaatacaaaaattagctgggtgtggtggcgcacgcctgtaatcccggctatcgggaggctgaggcaggagaatcacttgaacccaggaggaagaggttgcagtgagccaagactgcgccaccacactccagcctgggcgacagagcgagactgtcgaaaaaaggggttttgtggg

SEQ ID NO: 52361 - DNA, 3780 bp, Homo sapiens
tcattctcactagggatttcttcaagagtcacatcacagctaaacttactggacttgagaatttttttctcttttacagggatggcagccagcccagagatgatgggccttggggatgtaaagttaactccagccaccaaaatgaacaacaaggcagatgggacacccaagacagaatccaaatccaaggtagtgatttttgtcttgactcctttcaactttgtgtcctatctttttcagtgataggaaggaaaaagaaaagagagtgacaagatcccagccttttatgacaccggactagatagtctctgaaaaagctgctgttgcctcctcttatcatgaaaggtcccagaataatagctcagtgagttgggtctgggttggtctaagggatcctggtaaataacataatattctcacagctgtttgttatgggggaaatgccagacactgcagcatcaaactctctgtactgtttggctggtgccctctgtgaaaccgtgcctcctatactcaagcattgatagatggggtgtgccatgggcaactagttgctcttctcttcctgaaccttactcatagcagcaggaatggtaccctgtgttctgtaaagaaggagataaggcagatgaggcttgagtccttggcttcccttaggttggtcctgggtgtactgttaggctgtgcggtagtaaagggtcctactcagcatttgggtcatttgtaatatttctgtccttggccatacctcactttccctatctgtatacatagggaaaataaaaatcatagctgttaattcctgtgagtcttcacctctggctcccagcccttttgaccacgttcctgtcttgtacaggataatatccaaagcccttcaaccaggtgggaaacctttcctttgtttagaagaggcaaagagtttcttttcattttagtccatcccattgcctcaagatcatgttgtgagtttttcgatttctctaaaacatagtacctaagtatgttcaggctcctgggtagtagtgtgggagcagtagtggctttgatgtcaggtggacaaggatttgatactcagcctgccacttaaaagctgtgagatcttaggctttgcctcctggtgcctgcttccttatctttacaaatggggataattttataatacctaatatataaaggcatctagcacagcacccagtacataacatatatttagtgttagcttccttcctttataggaaaaaaaaatttggttctcttttggcccttcaaccttatgaaggtaggacaggtgttagtaaccaccccagagtaagaagctttaacactgctccagtcaagagacttctgagacccttagcacaggctttgaatctgacccattcctatgaattttgacctgaaccttccagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtgagtgggcgcctgacacttgactgcccctgtggtttccacaaacccctttctaggtactcactggcttcatgtggtaccatgcatcccacagggacatcatcccctctcccgctttctgagtctaatattgatagaccggggagcacaggtttcccagaagataaggcaggaagcagagacctccctggtagtatgaggtattagcagtaagtttaccgtgtatctatggtcccactgaggtgtaaagctagggaaagtctgtgggcattctgattccatgggaggcaatttggcatagtagcaaagacaggatttggagagatggacctggttttgaatcccttcttggccacttataacatatatgaccttaaggtgtgtaaccactctgaaccttaatttcattatttgtaaaatacaaacagtatgtaacagtatataacccactagactgtcaaaagttagaaataactttggctttcagcaaggtttctgccacataaatcggcctgcaagatggtacagaggcagccagagtagaagtagatcttcccattcctggaagcttcccagtagagataggatttcaggaactgcttagtagaaatagtttataataaaggaagaagtagtaggaaattatgtgtttagttattctgtatgggaaacttaaatgaaaacctgaattggacaccacccagagcttgtgcctactctgataccttacaattttgtagactcagcccaggaagcaaacaggtgaggcagcacagacagacagcagactgtgccttgcagacttccctcctgtgtatgttctgtagtcaccagaccagaagcctgctgttggatcagtttgtggctgagctcggggaggtgtggcagggagggatttattccaaaccttctaaatcagaagaggaaaacagctgtcaccagcagaaaagaaagtggttggaatgaagccagccaacagtcagttatgaattccttctcccttcaggctttattcccctcccccacaaaggaaaacaaaacaaaataagacacgtgcatactgccacataactggcatgagaagcaaagccacggaaggcttttgaggtgactccatgcatattcctgccattctccctgatactcagatctcatagtcaagccttccctgtctatagggaaagggagcattgggttaggtttcgctcacttctgattgggtgggcttcagggttcactgaacctaggatgaggtacagagagaattctaatgcctgagcctgtcttccagattggaaaaggatgcaaacctttaaaatgccgtgattgtaactgaacttttataaaggcagtgataattcaggggcaaaagagtgctatttataagttagtttgtgaaggctccaagaaagcaaagctgaatcttgagcttatctaaaggattagtagggtttaggtggaagagtggccaatccagtagactggcctagatgccacggagatgggagagagtctagatatttcccaccaaggccatctccaaccatgaagacttagctcaggtgttacccactctaagaagtattcctagtcacctctgcccctctaggttgtccccctctgtgcctctttaaactcttctttctagtatcataggtatcatatcagcagacattacaacctattgaacttcctttgtgtatagggacttgaaaacccttgttcccaggccttgggggaacaggcttaccatatggtagatgaataagcataagaatacatgaagaaggagacctgtccagctagagcagaaagactaattgtagggagcatctggggaatgggcttggtcagtgtgccctgaagctgagggaaggaggcagaactgtaggttggctgctcgggaggtacaaaagtcataataaggccccgggccaggcgcagtggctcacacctgtaatcccagcactttgggaggccgagacgggcggatcatctgaggtcaggagtttgagaccagcctggccaacatggccaaaccttgtctctactaaaaatataaaaatcagtggggtgtggtgacaggcacctgtggtcccactacttgggaggctaaggcaggagaatcacttgaacacgggaggcggaggttgcagtg

SEQ ID NO: 52362 - DNA, 1060 bp, Homo sapiens
cagctcagactagagccctgaattccccagggagctgagatggtaatgaatgggaaggagggagtggggaagggttatgaatggaactccctgatgggagtggctctgctcaccctcctttctgagaggaggctgaggcctagggtgagcctagagagggaagaaggccagggtgcctggaaggtgggtgtaaacacatgtgccctggtgttgacctctgagggtgtaatgagtgcctgagatgactcatcagctggggaggcctcagcagtgggatatctactgctgggaatggtaactattggaaacattaattactagtagttttgtactcatcagcttagaagaacatttgaagttgaggagtgacaccatgctggatgctttagaacaggagctcctagactcctaaaatgcatcccagatttgggacccccttcccacccaggacttgggaggctctgactggagctcatgcaccagcattacagggtttagtaggttagacaaggtcctttggcggagtgaagagaaatagccagggaagctggcaatgactcagggaatcaccagcatggtgatgtcatggccacatcactcctcttttctacacgtaaaacaaaaacaaagagctacaaaaccctcagattcccgtctttatgacctggccttgtagatcctctgctaagaagggtgatcaggctttaaaggccttaggaagaactttcccaaagagattctgggtcgttcgtgtgtttgtgtgagagttaaacactgtcatgccaagcaaactactcaacttgtatctctgtccacagcgggatcaggatctatgcaggggccccagactccccagtcaaccagcagttccatggcagaaggaggagacttaaagccaccaactccagcatccacaccacacagtcagatccccccattgccaggcatgaggtaaggccaagagcaggggcagatggttgggaggatggctgaagataagtgcatgggaactccttgcagcccaaggtggtccttgcctctgccttcccagccagtgact

SEQ ID NO: 52363 - DNA, 1050 bp, Homo sapiens
gtctaagaagctcactttagatattttggcattcttctctcacctgactggccagtcctgcctgaagagccacgtcctcaatctcttctctatttggagttggaaggggctagaaatagaccttattttgatttttaggttttgtatatttttctacttaagcaagggaagggaagaaagagtggtggttgcttttggaaacaacttcaaaagacaatttgttaaggtgattcccatgttttcttggagtctgtgtccaccaagcatctggttgtagccatcttggcatctgtgggctttatgtccctgagtgcagagtattaacttcccctctgcttgtctctgccttagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctct

SEQ ID NO: 52364 - DNA, 3477 bp, Homo sapiens
caacagagcgggactctgtctcaaaaaaaaaaaaaaaaaaatacacacacacacactctcacacactagcccgatgtggtggcaggcgcctgtaatcccagctacttgggaggctaaggcaggagaaaaatcgcttgaacccaggaggcggaggctgcagccaactgagatcacaccactgtactccagcctggatgacagagtgagacttcatctcaaaaaaaaaaaaaagtgttgggattacaggtgtgagccactgcttccagcccctagatctaattcgaaagcccttatttttttttccatctgctctactgttcagccaaagattgtgactggagaggagtgttttcttctagaggtaaataaatggcctatatattatccaaggtggaatttgggtctctgtagcaccagcttggaccagtgtttggagagctgaagcctcgtcccactccttatgctgcaagatccatggagttccagccccctggacttgtggggagcttggagaagagagccatgaacatctgcccacatggcattctcttctcttagcttaagtcaccatgcctaagcttgggttccacttggcagtgagatggagagagtgtcctaaaagagataatggcaatgaccaccaggttgaaaactggcctggtgaagaaaagcagaagattaattgggaaaagagaaggctaagagatgattggccctggtgggtgaggtgcaaagctgttggctagtgttcctggagataggcttacgtgaaggtaggttgggcagaagaaagaactttgtgttgggcatagaagagattaagatgaacaatttgctctgtggagaacctttgggaaaggagcaactctgcctctcccaactgatacagaagacttggggaggtctctcaagtcaataattctgttcttaggccacttttctcccttaatttatttcctgttctttctctttttagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttc

SEQ ID NO: 52365 - DNA, 1018 bp, Homo sapiens
tctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctgtaagtgtcctgccagttaagagtctgtgatttggcaaaggggttgttgggaagtgaggtgggcaattagctgagagggagaattgactagctttgtttttacttggtttacctgtaagcaaagtgtgggctacacacatctgtagtcgctgaggctagagcttgactcgagagaggaaaggaagaatgcaagcatggtcaagtggcagaggtgggttaggtgcttttctgatcccagcttctcttctgcatgcgcgtgggaagccaaggaagaggaaaaaagagtgaattcgccctaggatagggaaggagtagccgcgtgaggttgagtatgcccatttccgtgatttctctcgattcagcgagtcatacgttggaaacgtttagattcacaaactatcgttactgtctggggctttcagaagcttgcctttgaaccgaattttcgtgagccaaccggtgtggaattgggggcccctcccttcctccaggcctcctggcgatggagtaagcagcaggcgcccccttgtgccaaggaaagagtactgttgccattggccaacttggctccctttctggggaaattttattttcctgtggcttctgtgactttgtcgtcttgctcttgacatgagatatgatgggaagaatacttggggcactgatttcatatctaga

SEQ ID NO: 52366 - DNA, 1053 bp, Homo sapiens
gatttctgtgaccttagctttccagctacttgcttagctgtatggaactttaccaacgacagttcagggcttcacagtgacacctactgaacccatttgctgtcaagatgctttcccctcatctgggaagttaggtggttggttaagtttgtcatagtaattctgagaggggaggttccagtgacgaatgctttcaagaatttgctttcactcgatgtgtgacattttcctcctttggggtttagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggtcagtctcccatcctttgtcctgaatgtgctattgctacatgactggactaggcagtaagaagtgtccccatctcctttccacctctcaggtgtgcccctccatgtggttggaaccacagagacatagactttagagctgaaaagttgtcaggaatcttagaaacacggtctgttgatcttgttttacccatgaagcagcagaggcccagaaaggttaagtgacatccccaaagccacatagcaagatagagaagggctggagtttgaccccatgtttcctaactcctgagctagtggtctctccaacagactgtgatgttccgtaaccagagatgcttatagggtgggacagctcaaagtattgccctgtgtccccttactaggagactgagcattgtgtcagttgagtgggagaaacgtggcaatgtgcaagtcctaaaaccatctggatatgtaatagttcctcctattcccccgagtgcctgcccttcctgcctcacccacacacaactctcagtgcacttgcccgtttgcagctcccttttccctccgaggctccccttgatacacattttaataaaatatcacgtatatatgaattatttgctgcctagcacagtgcttggtgcctagctcagtatgttcataaatgaatgaatgttgttgaatgt

SEQ ID NO: 52367 - DNA, 1008 bp, Homo sapiens
gttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggtgaggtggattcctgactgggataaggatgtgaatacaggcaaaaccccttggccaaggacagggaaggcagctaacatctcccgtttgagtgatccatactgaatttattcattcaatgactatttagggttattctttatgccagactctgggtcagacctctaaggatgaaacataaataagacaaaattgcggccaggcgcggtggctcacaccc

SEQ ID NO: 52368 - DNA, 1084 bp, Homo sapiens
ggagacagatgatcaacaagtgagcaaataagtaagcaagaaatgctggccagccagcaaaggccccgatggcagccagcgtggagctgagtagttcctgggggctaggcactgttttaagctctttatatgcatgatcttatttaatcccccagtaatcctatgaggtaggtactgttgtcattctccttttactgattaattaaatcaaggcaaaagagggtccaagatcacaaagtaagtagaagagctgagatgagacctcagtctagagcacctgctcttaaacattcatatacacttattcattcactcatcaaacatttattgaccccctactatgtgccaggcacttttctagatgtgatacagcagtgaacaaaactgacaatagtccctgtcctcatggagcttgacagttgaggaggaggaaagagacaataaataacaaataattaaatatctaggatatcagacagagaagaaaggagggaaggaggatgaaggctacagggagggtgtgtgattttacatagggtggccagggaacatcttgtgaaggaggtgacatctgagcaaagaagcaccggcctgaacagatgagggcttgacggtggggttatctagggaagagcccagtaggtgttggggagtgggctagtttaggtcaggtggtcaggggagacctctaggaggaggcggcactggagatgagtgtggtagaaatacggggatctgggaaaagtaaggccaaagcccagagtggcaaacagcctgggcgtgtgtgaggaacggcagtggctggaaagaccctgtgctcccaggcagcccaggtggcccttgattcctttcagactgctgtgtgggttccggggtggcggggtactgggccaggtccctaatctcagcttgctgcaccccagctcttcctgctgagaagtgacgtggctacttgcacacctcgggggtttccggtccgtggttagctccttcccctaacagcatggtgttcacacaggcttttaaacacccagctggccctgaagacatctagtggcctgtaaatgtcagagccctgctgcat

SEQ ID NO: 52369 - DNA, 1062 bp, Homo sapiens
aaggctggtctcgaactcctgacctcagacaggtgatccacctgccttggcctcccaaaatgttgggattacaggtgtaagccaccacgcccagcccacatccagctaatttttaaaaattattatttttatagagatggggtctcacactatgttacccaggctgatctcaaactcctggcctcaagcaatcctcctgcttcagcctcccaacgtgctgggattacaggcatgagccactatgcttggccttccattttatttatttagcagatgatggcacagagaagttgagtgatttgacccacctcactcagccagtaagtgattggagtgagatttatacctacatgtgtttctggctccaaagcctatgtccaagtcagcaaggaagcagtgagtggggagccaaaagctgggactctggggcctgtgggacaggattaggggtttggtttggagtagtatcaccagctttggaaagagctgctgctgggggttctgcatcctggagggtcatggcatgaacagttggtcaggagcaatgtcagtggctcctgggaggctagcactgtgctcagggctgtggaagcatctcattcagccctcaccacaatcctatgaaggtatgacttgacccatctctattttacagataaagaaactgaggtggccaggcgcggtggctcacgcctgtaatcccagcactttgggaggccaaggtgggtggatcatgaggtcaggagttcaagaccagcctggccaacatagtgaaaccctgtctctactaacaatacaaaaaattagccaggcatggttgcgggcacctgtaatcccagctacccaggaggctgaggcagagaattgctttgacctgcaaggtggaggttgcagtgagccaagatcgcgccactgcactccagcctgggcaacagagcgagactccatctcaaaaaaaaaaaaaaaaagagagagagagagacagggtccgcctttattgcccaggcaggtctcaaactcttggcttcaagcaatcttcctgcctcagcctcccaaagtgct

SEQ ID NO: 52370 - DNA, 1022 bp, Homo sapiens
ttttcctcattgtgttactcactttgttcctccatctcctgaacctcctgtaaactgggacataggtctaggcttgatgagatgcaaataaacctcactggctgggcgcggtgcatcactcctataatcctggctgtttgggaagccaaggtgggcagatcacctgaggtcaggagttcagaccagcctggccaacgtggtgaaactctgtctctactaaaaatacaaaaattagctgggcgtggtggcacactcctgtaatcccagctactcgggaggctgaggcatgagaatcgcttgaacctgcgaggtggaggttgcagtgagctgagattcacgccactgtactccagcctgggcgacagagtgagactctgcctcaggaaaaaaaaaaaaaccctcactaagctttctgggagtctccttctctgacagcccttcttagagtgggtaaggccggcaggtgtatgaacagaggcagtctcagtacatggtggcagttcctaatatttgtccctgccttaggccagacattttactccaatgtttgttcctgggaacctgttaccctgaggcttctcctggactggccaggcagcagtagctttcccctgctggggatccgggccctgggctgccttgggcattccccatctttctctcctccttccctcagacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtgggtgagtaggaggcagcagggagggatgcagggattcctgagagagactgagtcgtggggatggggggcatcaagcatggggatggcgtgggcagggtctgaaatacccagggctgggcagggggtctggttcacccagatttgccctgactcaggagggcccaggggaggggccctcagcataaccaggagtgttt

SEQ ID NO: 52371 - DNA, 1399 bp, Homo sapiens
tgtgagtctttgtgccggcactgctctggatcctggggagtcagcatggtgtaagaccagcacagcccccctcgcccatggagcttacagtcaagtagggctgattggccaatccagttattataaataagcataaaaacacacatgggcagagtgtgacaaaagagaagtgatggggcagataacaggggccccctcccctagtctgggattggaagagactttcttaaggaggtggctttgcagctgagacgcgaaggagaagttccagttaaccaggtaaagagacgagagaatgtatcaggcagtgggaactggtacacaaaggaccagaggcaggtgtgtccaaggcctgggagccagctggtgctgcgagagtgaacggggtaggaaagccccagccatgggtgaggccgccaaatgcctgtgctggctgcaggccagcccacactaacccatcgccccttgcccttgtccagaacgatttgaccatcactgcccctgggtgggcaactgtgtggggagacggaactatcgcttcttctacgcgtttattctctccctctcattcctgacggccttcatcttcgcctgtgtggtcacccacctgacgttgcgtgagttgtgggtgagggcagtggggagtggaaggggtcagccagcaagctcaagggtcagcaagcttcagcagtcactgtccctctgagcttgtcctctcctgtttctttctccccaggcgctcagggaagcaacttcctctccactctgaaggagacaccagcaagatatcctttgtcagctagaggacactccagtgggaactgaggtcccttcactgggtgggtgccctgcctcatcctctaatcagaagggaacagcgtacagctcacatgtgtcctccagaatccaacatgccagctcttctgttcacacccaggcaagagctgatcctaaatggggcattgtggggccgggggttcctcgtcttcaggggcctggaaaagagtatgtcccttaagatgccaagctccctggaccgtgtcgtgcccaaggctctttgtgattggaaccctcagttttctctgccgtccatcaccctgaccttgtctggctcttgagtggggtcctgacccttccgaggggcccaggaggtgatcctgctaagaagtggggactgggccacaggaaggttccaaaacttctcagctctctggggaaacagctccatggaaggataggtgagacaggccaggtgtggctgggaggctccccaccctccacccattgaagtccttaactgccctcaccgtgctggagttggtgatctgcttcttctccatctggtccattctgggcctctcagggtttcacacgtacctcgtcgcctccaacctgacta

SEQ ID NO: 52372 - DNA, 1031 bp, Homo sapiens
ctgccgtccaacccctggcctagagcctcagtgttgggcagagccctcatgtgtctcccttgtgttttggaagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccaggggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaa

SEQ ID NO: 52373 - DNA, 1123 bp, Homo sapiens
atgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataagagttgctttgctttggtttggtttttgtttgcttttcctttgctgaggccccaactgggagccctctgttctttcagacaaatttggttctttcctggggagactgtgagaaggcaggcagcccagtgatctggctacattttccctcacctggctggagctctgtccgctggaggaagagcagagagggctgcggctgagcccccatgggcacgtgaaaagaggccatcctgtcccctctttgtcccctccaccttcccctgcctcaggg

SEQ ID NO: 52374 - DNA, 1042 bp, Homo sapiens
ctcttatgtcctggctttctgtccccgctgagctttctctcacccgcccgttttctctcctgcttcattgcctgctgcctaagccttggcccttctctcgggcagaggcaggtgctgtggcagcacctctccccaccaccggggcccctgcaggccgcctccctcctcccaggcctgctaaccctctctcttctccttctttgctgtcctgccggggatctccagtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccattcccgctccatgccggccagagtgtagaaagccataacgcagccatcagcacaataatgtgactctacgctgatatgctccctctctcctccactgacttccccttcccggatttgtgaggtgtcaagactaggaatctggccttagagcctgcccctccaccccctcagatcaggcatagccatagtcaagcccagcaggtttcctcaggagctgtctggggtgttgatggtggatgacgctgctgaacaagtttggtgactgttctaagcacaactggcttgatactgttcccacggcctgtccacctcccacccccaaccctccaccagagtaggtaggatgtagggagggtgcgtgcctcctttgctctaggcactgagggaccaagctagccgtgcacagccccatacacttcaggggactaaaggaaagagctgagccaaggaaaatcagctgagcccagggctgggggctgcttgtctgctatcctgtaccttttttttttttaaccaaaataaagattcccctcttcttgccataccattggctgtctggtggcgcctttactttggggcccagggatgggacctgcagtgggcgtgt

SEQ ID NO: 52375 - DNA, 1013 bp, Homo sapiens
aggtccaaagtcagggtctctaagtcagattccagtcccactcccagcccatcgccaagaactggaagagagacaggaggagtgtcacaggggaactttattgagaggaaacatggtcacacccagcagacatgctttccctcaatctcggtcttgcactggcgcgcgcgcacacacacacacacacacacacacacacacacacccatctccagcccctgccactgtccagttctcagccacaaggcgggacactcctcaattcctacgatcagaggcagcaggggcaggagggaggcaagaggaggggagaagtagcctggtcctggggtcgggaggaagcgggtgcggagagcaggggtgggggcatgaccagtggttaggtgcgctcaacagctgcaagaagagtgggatccccagccccaggtggcctcagctctgccagtccctctccacggagccctttggagcaagaacagcgcctaggggagaagggtggggcctcccaccccatactagtcctctcggcagggtgggggactggagggggcagggcggggcggtggcgggcaacactcagctctggggctcctggggagcctcgcccccctcttccccggcgttgtcggccgtccacagtgtcaggttgtctcgcagcagctgcatgatgagggtgctgtctttgtaggagtcctcgctgagggtgtgcagatcagccatggcctcgtcgaaagtggtcttggccagagagatggcctcctcggggctgttggcgatctcgtagtggaagacggaaaagttcagggccaggcccaggcggatggggttggtgggcggcatctccttcttgctgatgtccatggcctcctggtaggctgaccgggctgagtcaatgatgcgcttcttgtcgtcaccggtggccacctcggccaggtagcggtagtagtcacccttcatcttcaggtagaagacccggctctcggcgtccccggcctccttgatgaggtggctgt

SEQ ID NO: 52376 - DNA, 1054 bp, Homo sapiens
gttacagtgagctgagattgcaccactgcactccagcctggtgacagagcgagactttgtctcaaaaaaaaggtgtacttcaaaaatgaaatacaaggctgggcgtgttcactcatgcctgtaagcccagcactttgggaggctgaggcgggcggatcacctgaggtcaggagttcgagaccagcctggccaacatggtgaaacccctctctactaaaaacataaaaattagctgggcatggtgttgcacgcctataatcccagctattggggaggctgaggcagaagaattgcttgaacccaggaggcggaggttgcagtgagccaagattgtgcctacattccaacctgggcgacagagcaagactctgtctcaaaaaaaaatagtaagttgtgtaaagaaaaatattaattatataatatggcagttcctatgagagtgtggcaaaaatcaagagggcttggaagttttttctttgctcttgcaactggctggatgcagttcatatatttttcaaccagtaggtggcaccccaacctaattttttgcagttgtaacctggtggcagaaggggcaggactgatggcttgggcaagactgttatgccaagttttatttgcatgtatttggactttctttttttggagacaaagtctctctctgtcgcccaggctggagtccagtggcacaatctcggctcactgcaacctccgcctcccaggttcaagcaattctctgcctcagcctcccgagtagctgggattacaggcgcctaccacatgcccggctaatttttgtatttttagtaaagacggggtttcaccatgttgttcaggctggtcttgaactactgacctcatgatttacccgccttggcctcccaaagtgctgggattacaggcgtgagccactgcacccggccacatttggacttattaacacatatgaagtgcttggtattttagagtgcttccacacacacaatcctcattagagatagacaggatggggagaattaataagccattgcccgtgttacagtgaggaagcaga

SEQ ID NO: 52377 - DNA, 1030 bp, Homo sapiens
ttttggacagagccttcatcctttcttggaggaggaggagggatagatagcccttaggggctctaggtctgatggtcaggccctggtagggtgggctggtcagaagctcaggctctagtaagggtttagattttagaagaggaaatgacccgggtgggggaaatagccaagtaggggagggaagacctgggttctaatcctctctctgtcatttgttggctctgttacttttctgcaccacaatcttctcatctgtatgattggggagagccatggttcctacttttggggagctcccagtctaatgagagagatacagaacactattaaaatgaataagtcaatcttacgagggggtcctagaaacctgattcttcccccttctttgagagggacgcttccataaactgagctctgtttcctcagatggtggagacaaggatgcccgagactctgtccaaatgcgtctggaacagagactccgagatggacaggaagatggctctgtgatcgaacgccaggtgggcacctttgagcgccacaccaaggtgagttagcactgtgcccaccccatggacccctctcttttccttctctactttaattccttctcccatccccattctccctgctcccagcaggagccccatttcttgagtcttgtcccttcactctgcagggcattgggcggaaggtgatggagcggcagggctgggctgagggccagggcctgggctgcaggtgctcaggggtgcctgaggccctggatagtgatggccaacaccccagatgcaagcgtggattggggtaagtgtgactgagggacttccctgggggcccaagcctttcagctatgccctggtttccctcttcccactggttttggcatggctgctgggtactcgtgcgggatgaaattcaaaacagttaagaggaaaaagtggatctgggccaggcacggtggctcaagcctgtaatcctagcgctttgggaggctgaagtggtaggattccttgagcccagtttgaaa

SEQ ID NO: 52378 - DNA, 1104 bp, Homo sapiens
gtcctggctggaatgcagtagtgcaatctcagctcactgcaacctccaactccctgggctcaagccatcctcacctcagcttccctagtagctaggactacactcacacatcaccacacttggctaatttttgtattttttgtagagatagggttttgacttgttgcctagactggtcttgaacctctgagctcaagggatcctcccaccttggcctcccaaagtgctgggattacaggcgtgagccactgcgtctggccccatcctgacttttcttcagcacttgaaggcctacagggtttcaagctaggagtcattgtatcattccacaagtcccgtcaagccaagggctagtgtaggattccaaaggcattctaagacccatttcctgccctcaaagagcctaaaatctccctgaagagaaagaaccagcatctggagatgctgcacctggatgtggccacccgggtttgcattgctggctctgctgctccctcagtgtactcttttggacaaagaactttttactcccctgaacctaggttttgtcatctgtagaatgggaataatggtacttatctcatagggttgttgcagtggttaaaggagctaagctatgggaagggcctgacacaccagagacaataagcattattgtccattctttctttgtgatatgacataaaaaggcctaaccagtgtgtactgattagcattgggagttcagagactggtatgagagctgtgggcctaaatgtggggggcttcatgtaggctgtatgacttgagggatgaggaggatttaatcaagtggagaagagaagggtgtgggagaggaaagtgggtatttcaggcagggaacaacatggccaaacgcgcagaggtgagtcaggcttgtggggacaggagcaaactgttgagaattatcgggctggagacgtgttggtcaggggccaaatatgtgctgcttcttggagaaatctgaaggaatggcgctgaggctagccacacatgcctcctgtgccctgagcttccctccctcggggcatgaggtcaggaagctcaggcaaatcacctctccctgccttttaggacgatgaccgg

SEQ ID NO: 52379 - DNA, 1135 bp, Homo sapiens
actcccatgaagctggccctagtcaagtacgcagtgaggtcgatgaggaggaggctgtcctgtggtaagtcccttctaggattggaagagatgagtaaggctactttcagcttcactgctctacaagctgggggggtcgctagcaagggagaggggcaaaacttgtccctttttaacttccaaccctgccagatttgagtccagggctttctagaagtctccacggcatcgggtgaccatagcaactcatgccaaactctcgggcccacggctccgcctaccgcttcgtggacgcgcttgttgattggctccgaatgtcgaccaatggtcggcgaagcgggttgcttgccgcacggtcaatggccgcaaaccgggaggaaggcgggaagagaggaggtggaggcgggcctgggcagccgcgcgcgtgcgtgtttccggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggaggtaacggcccgcgcggcgtcggcccacccggcggccttggccacgctccttccgcccttctctgccttcgagggctgagacccaccccagcggctcgcgggcttctgggatgcccctacattctcactgcgcccagcttccggcctggccacccgccagcaggtctcacccggttcgcatcagtcccgggcccccggcgcccctcagtagtagcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacatctctccaagcc

SEQ ID NO: 52380 - DNA, 1015 bp, Homo sapiens
cctcccaagtagctgggattacaggtgcccaccacctgtaatctagctaatttttgtgtttttagtagagacggggtttcaccatgttggccaggctggtcttgaactcctgacctcaagtgacccgcccacctgagcctcctgaagtactgggattataggtgtgagccagtgtcttgatgggctttttactttctggagaggaaagctgggcccaggcttttcatgccctggatgcagaggagtgttccatacgcttaggctgcttctagcatcacaaggaaagtgaaaggcgcacacacacacaggatatgagaaatctgcttcatggtggaagtgactaagagaacctgctggggagataatctcctcagttgggaagctcagaggaaaaatagtcaagtcccaagttccctcctagacaaaacaagttgacttgtgtgcagttgaagggctcccaaatgcagctctactactttaatcttctccccctctttcagcttgtgaacaccttcttcagcttccttcgacgcaaaacagactttttcattggaggagaagaagggatggcagagaaggtaagtgttggaaaccactgtcctttgggcggctctgtctcttcagaagaaaagctcacctggcctttctttggcataatagtaactttcagcagaagcgaaatgccaaaggtgaggaattggggaagggaaggaagctgtcatttcttcaagctccactccttgctcagccctctatctaccttatttcccatgacttttgcagttctacaagaggggcaggtgttaactatccccattgaggaaattggctcaagagaattttgcaccttatccaaagtcttgagctgagctgtgggagaaccagggttgaaaccagtctgttgtaaacctgtcctctgccccgacacagtgcctctcagttccttttccaatgaggaggttttatttatttatttattttctgagacagagtcttgctttgtcacccaagctga

SEQ ID NO: 52381 - DNA, 2175 bp, Homo sapiens
gtgctttgcaggtattgtcattacaaccctatgagatagatgtattttcctcattttgcacatgaggaaaccgagtttctgggtgcagtgctttgcccttgcacccagcaggtagagagtggggctggactccaggctgtgggacactgtcccctgctctgatgcctcatggcctttcttccctctccagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccaggtgaagggtgggcttcccttctccacccctcagatcccccctggcactgagcagtggggtcctgttgccaactgctgtgctctttgccccagaaaaaggatgcagagaatcatgaggcccagctcaagaacggcagccttgactccccagggaagcaggtgagatggactgcagggacttgggatgagccaggagcttggaacttacaggaaatctcctgcctactgctttctctggaatacccttccttatcctatcccctcccctcctggctttgggaatcttccccatactttaagatcacactcagagacattgaaccaaaggatccaggttaaaaaaataaaaacctgccaggcgcagtggctcacacctgtaatcccagcactttgggaggccgaggtgggtaaatcacgaggtctggagttcaagaccaacttggccaagatggtgaaaccccatctctactaaaaatacaaaaattagccaggcatggtggtgggcgcccgtaatcccagctactcgggaggctgaggcagagaattgcttgaacccgggaggcggaggttgccatgagccgagatcacgccactgcactccagcctgggcgacagagcaagactccgtcccaaaaaaataaaataaaaaccgactgaccttaacctgtttatggcaagaaaacccaatagccagagagggcagtgcctattacaggtcccatctgaggttggctgggttctgtgggcccagccatatcctttgtcacatggtataatattaatagtctgagctcctctcagactgagatcagaaccaagttttacctggttcccagtggaccaaggcttgggggtctgcccctctgtggagtgggcagggaccaggtctgttttcttttgtggctgtatgcccagtgctagccctgggcttggcccagtgagggttcaatctgtgtcttgtctgtcaagtaagtagctgagtgtccctgattgtaagcaggatactgaggaagatgaggaggaagatgagaaggacaaaggaaaactgaagcccaacctaggcaacggggcagacctgcccaattaccgctggacccagaccctgtcggagctggacgtgagtgtcagggaccagaggtaaagcttagggggccagcctggggtaccagcagcacttagtggcctcttctgactgcctctgccctatgcagctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaaggtatgtgaggcccagcccttctagcctggggtgttgatggaagtagaagggaggatgtgtgcttagtttactcaggagccatgctgggggcattgtgggattatcttaatccccatgacaacactctttaaagtagatctgtctctattttattttcttaaagacaaggtctcactctgttgcccaggctgaagtgcagtaacaccttcttagctcactgcagccttgaacccttgggcccaagcaattctctcgcctcgtcctcctgagtagctaagactacaggtgtacaccaccacgctcggctaatttttgttattaaatttttttgtagagaccggggggtctcactatatttcccaggctggtcttgaac

SEQ ID NO: 52382 - DNA, 1072 bp, Homo sapiens
gtgattcctggtgcacagagcaggccacctcccaccctctggttgttctcttcacagatcaataagatggagtggtggagccgcttggtgtccagtgaccctgagatcaacaccaagaagattaaccctgagaattccaaggtgagccctggctggttgggggagcttcagcaggaaggtgaggggcctcgttgtttccagagcttcaccgattcctgtcactgcctgccctcagctgtcagacctggacagtgagactcgcagcatggtggaaaagatgatgtatgaccagcgacagaagtccatggggctgccaacttcagacgaacagaagaaacaggagattctgaagaagtgagcaattcagagacggggttgggggaccgtgggtgcctgggggcttagacttcggtgacagcagtgagtggatcactgcgctgcctcaggagctgccctgccccctttccagccatgtttatggctttatggctttggcttgcctactcttgtcatttgctgaggtcatcttgagggcaaggccggctcatggtgcatgataggagggaaggggtaacaggcggtcattgccacctacaggaaaacaatgccagtgttggtgcctcagcttccagcctcgggactcaaatgcgtctcagataccctgggccctgctcctgcccagcctggcttggtgttgctgaggtctaaagagattagacttgacacgggggtgctgggagaagggacagctttagaagagaaggatgagctgtttcatcttgcttccgtttctccaggttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgt

SEQ ID NO: 52383 - DNA, 1082 bp, Homo sapiens
atgtgactaggactcagcctccatcccttcaggtgctcctagccagatgggggagactccaggtcaatagaagctaactttacaatgcaatggtggtgccatgtccttctagacctgggtcagagatagcacagaacagggagctgtcggcgatggtgaggaagggcagcagagacttcagagctgggctgggaagttggacttctggattcaggccctggactgtttgttgtcaattctctttgctgggctcagtgtccccatctgttcaactgggatggatagattaggctgctgctctccaacaccctctctggttccagactccaaaggggacaggtgccttcacctggtctgtacagctgcctccacagcgaagaaagtttcttggaagaaatccacagctggcagcttctaaagctgttgggatgtgtgcagggatgggggcggggagagggggagggtggtgtcggttgttgccttggggcttttcactgctgctgagttgtcctatggctcaaaaattggaacctttctccctctacccccctgcaaggctttgcctgtagtggcaatctgagtggctagagattctgttcttgcttgtacctgtactaaagggactcaccctactgtaaggagccttcccagagctacaggcagggaggccttttattggttgtgtaaccttggacaagtcctttgccttctctgggcccagaggattgaactagacaatctgatttctccagctgcagccagagggcctgcatcaggcggcagagcatgtgagttttgtaagcctgctggctgacggcgtctgtcagtctccctgcaggtctcagcagcagcctggagcagagtggttgtggggagggccttggcatgggagaaaggagggtgcagccactgccccctccatggctggaaagtctgattcaggaggcaccaagctgccctgcagtacttgggtgtggtggtatctggtgaccgtctgccaaactggctgtagtcacacctgggaaggagacaacagcgactggctggctgacacagctggccccatggccctgacgcagggg

SEQ ID NO: 52384 - DNA, 1216 bp, Homo sapiens
agtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagtttttaatagagtcaagggctgctttctggggacgagggtctttaggagggagggtggcctgagggcgtgaagtacttagttcaaa

SEQ ID NO: 52385 - DNA, 1258 bp, Homo sapiens
agagatccacacacaggtactggagtgcgggctgggcccttggttgcagaaggaggaacagggagatagggagcagctgggcctcaagtctctgccccccatcagccccttctccctgtgccagtgcccaggggctccctctgccccaggaggccgccagggtctagccataggaaggtgtggtgtgagcagctgggagcctgaggagggggcatcatgccatctctgcctccatttgaaacctatcccaggcataggtcccaggtgggattagagaagggggctcagccggacacaggcaaggcttcgagatacccagagtcagggccgctgggttcgatgagtggagtgtgggcgccacctcctggctgctcatggaaccacagggctggacccagcagggctgcagctacgggagggagtggggctagtcagaggtcttggtagggaaggcgccccacagcgaggcttgacttggccctgggcccctttcagttcctggaccaccttctgacaggcatcgaagacatctgtggccactacggtcaccaccactggaaggacaagtaggtggcaggcctggtgggcaggcagggaggggcaggcaagggtctcctgggcctgggcatctccccactcctggaagctggcgccatccgtctccctcctcctcccaccaggctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagtgagtgctggggcaaccaggcagcttctgctcccacacaccggcccctcaagcccggttggaggtggccacctggggggcggggtcttctgttgtcctgttggggcggacaagagagctgtgggctcgcaccaaggacctgaggctttggcgcccacctgggtcatccctagggtgacttccttctggccaaacctgggaggcaccaggatcccaagaatcttggggacctaaccgatgccctattgccccaggaacatccaccccaagtccctgccttccgagcgcatcctgccagcactgtccaaggacaaggaggaggagatccgcaaaatcctgaggaacaacttgcagaagaccaggcagcgggtgagggcctgctccccagcccgacccccagggta

SEQ ID NO: 52386 - DNA, 1050 bp, Homo sapiens
agtgatgggcatgacgtgcccaaggtcaggcagtgagaggcagacttgatagcaccagatgtggctaacactgcatcaggtaaggctccgagcacttgattcgctgatttagtcctcacagcagtcctaagatttggtattattatcctcattttatagacaggaaaactgaaacacagggagatgaatttgcttcctgtacacaactcaggagtggcagagccaggattccagtccaggcagtttggcttcagggtcttcacagagcttcccagggcccacccttcaccagtggggcacgtggctggcccagagcaagcccctcagccccaggctgaggttttgagcacctgcttggcactagggtttctctgctaccgtgtggcctcttcttgtggccatggttaacggaggggacaggattgccctgggtggaccccagggaaccgtggggccagggccctctcctcccacccaccagcctgcacaccctccccaggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgtgagtctgcgtgcagcaggcagtgggcttggcggggtgggggcgggggctgccagcttggattccccaggctcgtaggttcacggagctcccagggcccagccttgagctccagggatgagacatgaactccaggctccagacctgcttggtagccatttaaatggccaagggcatcagtggcttcctagaagaggagcacttctgcagcgccccctggggtccaggaatcgggagagggcatttcaggctatgagcagatgaagcaagaatgacctgcatgaaggcaagcccagggta

SEQ ID NO: 52387 - DNA, 1034 bp, Homo sapiens
gtgggatctgggtgttggggttcaggtgagcactgctgtggagcttggggcatggttgcatcaagcaggtaacagacccagccatttgtggacccatggtcatgtctcccaaaggcagtggcagcggtggtagtgattgctggtgttcattgggtgcttcctgtctgaatgtgtattgcctcatttttatttatttatttagagacagagtctcctgtcacacagacagtgtcactcaggagtgcagtagcacaatcatagctcactgcaccctcaaactcctcaaatgatcatcccctcttagcctcccaagtagctgggactgcaggtgctggccatcacacccagctaatttatttatttatttatttatttattttgtagatatggggtctcattatgttgcctgggctggtctcaagctcccgggcacaagcgatgctccctctttggcctcccaaagtgctgagattacaggcgtgagccactgtgtctggcctatgttgcctcatttaatctatacagtaactccatgaggttgacacagttatattccagtttttttgcgatgaggaaactgaggaacggagaggttacataagcctgatatatgatatagctgaggttcaaatccgtagtctgagtccaaagcccaagtgcttaccactgtgttactctgtttctctatagttccaggggtaatagcaccaggccagaaaggaggactttcccctctgtgccgactccatgggcccatgtggtagaccatgaggacccatgaatcccctcaggccaggaatgagtttagcccacggctgagtacgcacctgctaagaggctgtctgccgctggagccctgtcctatcccccagacagctggggccaggccgcaccaggcctggccagtgctctgcatctccccttgctgcctggcccaagtcaggtctttctggagctcttggcataggtgtgagtgccccatttcccagagagtaaagccagaggctgaccctgagctgcctggtctcaggtct

SEQ ID NO: 52388 - DNA, 1104 bp, Homo sapiens
ccattttacaggcgaggaagcggaggctcagagagttaacagagcagccctctgagacccagcctgtgcacctctcaccaactgcgctcctcatccccggcccatccccaaccttctattctcctggctcctccgaaagcccatggcctcccgttctctcgccctccgcaggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtgaggaggccaggggccatgcccatgtccaaacggtacaaacccaaatccaggcccaccagtgaatccctcatccacccgctaataacagtaataaaaacagctgaggcacattcccgcttcccgtatgccaggcaccatgctgagcccttcggcatggattatctcatttaagtcctcatggctgccttaagaggtgcttattattctcattttccaggggagacacaggcccaaagaagttaaataacctgttggagtatgaaccagtttgtgattgaaccaggtctgactgactccagggcctaagctcttggttttgctaggttatatgctccctccttgacttgacttgctttttgttttttaagagacagggtcttgccctgtcttctaggctggtgaactggtacggtcataactcactgcagcctcaaatacctgggcctgagatcctcctgcctcagccttc

SEQ ID NO: 52389 - DNA, 1113 bp, Homo sapiens
cttgtggtgcagagcagccgcagggggctgggagcctccatcaattggaagtttggtgaggtgtctgctcagcaagagtgtgtgtgtgtgtgtgtgtgtgtgtgtgtgtgtgtgtgtgtgttcgttccagctaccacctacactagatagaatgaaaaacacttctcccatcccccagcctcttctaaaaggagcgccaactctgaactgtgtcagagggtttggcctgtggctgtgcttggagatgttgaattccacactttcgtgcctccttgttctgggaggactggacgtcctcgaagaaggctgtgtggcttggagtgtcacagactgctggggtagaactggacatgtgatcattgacaggtcactggctgtctctgtctccatttccctgactatataatggagaatttagatgctctccaagatccattccagctcttacgactctggttcttactctaactgcctcttcccatccctgatttcaccctggtgacatcactgctgctgcatgtttgggccctgaaagttttgcctcatctcttggcatcctgggatcttgcctccatgcagggcttttgtcagggtaccaggggccgcagccatccttctgtgcccctttcaccacaccgggtgtcagcaagcatcctgctctttgtggggactctgcagggatgcagagtgagcgcagttggtggagtcagggcgttaggagagggacaagccagcgcaggtccaggggctgcttcccacttccctgagccgttgctcctgaaggagcctcctcttgatgacagaatcccttcctcccccagccctagaagtgctttccaataatgtgccacctacccacaggcagggagccaaaagtggatctcagacctttctcctcagcctggcccggcccggccctcccctcaggcccagagagcccatcagggcctagagctccttcagctcactgagcgccagagacaaaacaggaaagccagggaaaccagctccaggaacatggctccagccccaggtactctggagctggctgaaggagaaggaggtcgctgtgctgtagtcaggaggcccgggacccagtcctggttggcctgg

SEQ ID NO: 52390 - DNA, 1046 bp, Homo sapiens
ctgaggtcaggagtttgagaccagcctggccaacatggcgaaacccctcctctattaaaaatacaaaaattagccaggcgccatggtgggtgcctgtaatcccagcccctggagaggttaaggcaggagaatcacttgaacccgggaggcagacgctgtagtgagccgaaatcgcgccactgtacaacaagagtgagactccgcccccccaaaacaaaacaaaacaaaacaaaacaaaaaaaacctcccatccccacagcagaaactcaatgaataatactttttttttttgaggtggagtcttgctctgtcaccaggctggagtgcagtggtgcaatcttggctcactgcaaccttcccctcctggctgagttaacttaggagagcttcctggagagggcagcctttgaagataggaaggatttcatgaagtctttactaggccactagagtagaagcagtgggagacttcctggagaagagctcatggaaagaaaaacctaccgctggccctttgggaactgctttgggcctctttagtcctaggctcacacgccccttagaaacaaagtaagaataaagccagggataatacagtgagtggccaagaacacagactctggagccagactacctgggtttgaatcccagttaccagccatgtgactttgatcaagttgcttaacctttgtgtgcttcagtttcctcatctgtaaaataaggggatggtaattgtgacttcccagaactatggtggagagcaaatgggttaagagtgtgccgctgtaaactgtagagtgctgggctttcattgggaagtattacctttcattgctgcagttgagactggttgctggggcagttgaagagggagttaaagaaatggaatcattgtgcaactaggaatcccttgggacctggccgagttgcagccccagagcagtcctcaggcctggaagtagggcgacagagccctcagtgtgcccctgggtccctggtgacctggcactatgggccaaagagacccctcttcccagcactcccct

SEQ ID NO: 52391 - DNA, 1053 bp, Homo sapiens
tgtaacccagtgccagggttgctgaggctgtgatcctctatcacaacatgcctgcctccggaacagcctctcttgccaggtctctaaggcagttgctgctggctcaatcgctgcttattactccaggggccgcccaggccccccagcctgcctgacctctcttttctcagtcgtttcagtgcacaaggtgctcctgtgtctagtccctgttctcacttgtttacagacaagaaaatggaggttattccatggtatagtgatttacgcaaagctcatggttactaaagggcagagtggggtctggacctggggttttggcctccttgcacggtcttctcttttccatgactcagatagtccagtgtatgctgcttgtgttttctgacagctttttacctgctttcccatccagacctgatgttcccagagggtgagaccctttctctccaacatagtaggaccccctgaaatgtggattgaaacaagcaagaaatagaagtgctgtttggaagaatgatggggaaaaacacagagagagactgattgcccgggtatggggaaggatgcttgcccaggtacttggaacagatttatttatggctgtttttgtgggggaggcatatttattgcagacttgaattctcttcctggtgatcctgacaagctgttttctttgaagcagcatggcccaaagaactagcagttcagagaactgggttctaataatgaccctgccacttcccagctaggtagccttggacaagttacctctctgaacctggatttcttcatctgtcaaattgggggtcaggatgtgagatgaaatgagagggggtgtgtataagccccctgcacagagccttgcatcagattctccaagtgtccagtgtttgtctcctgggtgctggagagtttatcttttttttttgaaatggaattttgctctattgcccaggctggagtgccatggtgtgatctcggctcactgcaacctctgcctaacaggttcaagtgattctcctgcctcagcctcctgagtagctgtgattagag

SEQ ID NO: 52392 - DNA, 1224 bp, Homo sapiens
ggaaaggcactttagaaaatgtccagggctcaggccgggcgcggtagctcatgcctgtaatcctagcactttgggaggctgaggtgggtaggtcacgaggtcaggagttcaagaccagcctggccaagatggtgaaactccgtctctactaaaaatacaaaaattagcagggtgtggtggcaggcacctgtaattccagctactcgggaggctgcggcaggagaattgcttgaactggggcagcagaggttgcagtgagccgagatcgcgccactgcactccagcctaggcaacagactgagattctgtcccaaaaaaaaaaaaaaaaattaccagggctccagttcttctctccccttccctagctgagggacttccaggcagtgaagtatgcccaacatcctctggtctaagaaggcagtggagtggccatttggatggggcgggagatgctgacccaatagggcacatagcacccttcccgtcctaactacctctaaacctgggcctcagttccctgctcccaccaggctcactcccatccccaagaagtcaagccaggaccccactccctcacctcttagtcagatgaagtcctggctttgagtagtctcttacacttcttctagctcagtgtttgggtctcctcagcttcaggaaaataaagagggggcccccatacttatgagattacaacctaggttgacgtcaagaatcaggaaatgggccaggtgtgatggctcatgcctgtaatcacagcactttgggaggccaagcacaggtgggtcgcttgaggtcaggagtttgagaccagcctggccaacatgatgaaaccacatctctactaaaaaatacagaaattagccgggcgtggtggtgcatgcctgtaatcccagctgctggggaggctggggcacaagaatcgcttgaacccaggagacggaggttgcagtgagctgagatcacaccactgcactccagcctgggcaagagagtgagactccgtctcaaaaaaaaaaaaagaatcaggaaacaaaaccctgacgggcttgggctaggcctttgcctcacccaccctgctccctcccaggaagcatttggcatgataagatttccatggtacggggccaggtgggtcccactctcccgggtgtttagctaccacgtcacagtgcagtaccaggtaccaggcagtggaaatggctcctggtgctccagcgtccg

SEQ ID NO: 52393 - DNA, 1134 bp, Homo sapiens
aaaaaaaaaaaacaatgagtgtgcttagctcacatagaggggagaactggagaagggcacagagatgtgaatgacacagagccacagatcatgcagaaccattgacctttgcttctaaaactcattgggatgtttccaacccttccacctcacccccaaacacgcctcactcacctgttttgctgggcagagaagctaactgcacctgtggggcactgagcacctgtgatggctgtcgccctggtataggcagtgaggacagagctacctaccacttactgagaccctgccagtgcctggctttgtgctcagggcttcgcatagtgcatcattgccttctgcactatgtgacggccccgaagggtgcgagtcatggtatctagctttatttagcttacagctactttaggaaagtgaaacagggaataattaagtgctcgaggattgctgtgctgttgcctcaaagaacaggagacctttaggaaggggagaaatgtggctggaatgaacatggagcagagatctttgtgcagacaccttcaccagacccttctaagagggagggaaggtgaccaatcaggcaatggccgtgacaccggttaaggctctttgcaggctctgagtactaggtatgggcaggcacctgttggggagcccagccagctgcaggaaaagtctgggtgaggagtcagtgagaaataagacagtaggtgggcggggctggatgaagcatctggaactccagaggggtgtagacttggccagggctcctcagactggtggcaaacacaaccacacctgtcaaaggcttgcctcttcactccatcttctccaacccgggtgattcccgggcctcctgaatggtcttgcggctccactgctgtctgcctgcaggcagctctccccagagcagccgcagggagctttgagacctgtaaaccagagcatggtgtttcccctgctgaaaacctttcaaatgcttcctgatgaacttgggagaaaatgcaaggaaagtgtggcccacccctttctccacttcatgccccactaccctttccctgttccagtcgcaccggccttcctgtgtccctaacgcacatctgccttgccaggcctgttcctccatacagctgt

SEQ ID NO: 52394 - DNA, 1052 bp, Homo sapiens
gagaaagcacaggtgggaaattgtgtggttcaggctggatgcttgggggaatcagaggagaggagagatgagggaagcttcttgaaggaggcggccttgagaggtgggccaggggtagaagaggaacatcattcaggaggggttgctaagggattctggtgtaggtgagaggatggactggatgatctgttgttctaggatctaggtttctaagattgtttctgagtccatgataaagtttgtggagctcccaaaatagtctgcagacagttgtatatatgtgattttatcaagggagaaggcccatgatagactcagattttttttttttttttttttttttacacagttgattgtcagtgtgtaagccacagattctgaaggttaagagcttctgccttttgtgtggtgggaacttgaagaagggtagaggactaactggtctgggatgaatccttggaggaggtggtacttaattctgggatgagtggggtttgcctgtgggactgcagaataccttccaggcaaggagaaggaccccagagtgagtaagctgtgtcctgagagaagggaaggggaaatgagtccttaaagtagagaaaaacttttctaagttggaaatcaaagcagatgcaacatgctccgcctacactgtgcagcagggaaggtactggcttctttatgccctctgggtctgctgggttgccatggtgagcccagctcacacacagtaggtgactcaggccacctgcccatttccctaaagcggctagggcccaggcacacctctgaggctctgctagtggggaagcaaccacctttgaggcagcagacgcaagagaaagcctctgaaggtggacaggctttgaggatgcagctaggaagccctgactggcctctgctgtttcctggactgaaggtccctgttctctgttctcactctgcttctaggaatgaaagtatagaatattctaattctagaatgttagagatggaaaaatccttatcatagcttgtaacccccaggcccaaagggaaatggagatgttttg

SEQ ID NO: 52395 - DNA, 1011 bp, Homo sapiens
tctagaactcctgacctcaggtgatccacccaccttggcctcccaaagtgcggagattaaaggcgtgagccaccacgcctggcctgttcactttcttatctgtgcctggcacagagtaaaggctccataaatatttggggaaggaatacatgaatgaatatgtgattgacttcagtgtaaagataggatccctgcaaagccctggggcagacaagaaaccagtttgactgctcagagaggagggagagcaaaggttgcagaggctccttggcaccagactgccaagccaaggagtttaactgagctcgctgggagcgacactcacagaatgatgccttaggcgccagccagtgtttaagtggtgctgccttggccacctccctcggcttggctctaatggagggtctgcaagggcatcttctctgggccgggtggggtctctctgggaagatctggatctgtttggtctgccctcaatttgtgtaagtaaaagtaagataccagagcttccttggggagctgccgagagccctaattgaattaagcttttcctgggaagattcctcaagccgtaaactgcactgtgactgtgaattaatgagaccagtggctttaaaccatacaagaaggcaatcttgttaatttatagttgtacctggacagatttacttatggcttctctttgctttaatgtgtgttgggaatgggtgggctgggccagaatctcctttctatggcagatttatttttataatatgaataaataaaacatgtcaatggtaaaaacaaaacaacaaaaataaaacccaacagtacagagggtattgaggtgaaagggaaaagtccccctcattacttctctgaccacccccactgtcatacattccagaggttaccactgttaactgtcttgtccatcttttttagaaattctccatgtatatattgagtatgtgagtgtgtgtgcatgcaaggcaaatttagttttcataaagccattgcataaaggaa

SEQ ID NO: 52396 - DNA, 1250 bp, Homo sapiens
ttttgtttatttttgagacaggatttcgctctgtctcccaggctggagtgcagtggcgcaaagacggctcactgcagcttcaacctccctggctccaggcaatccccccacctcagcctcctgagtagctgggaccacaggtacaggtcaccacatccagctaagctgccacttattcatatctagtttagaggttgtgaaaggtacttgcacagctagaaaacattggggtttaagcccagatttgtctgacttcagagcctgtgttcttttcatcctcatgccctgattccaagggccttttcagtttagaaattcaatttttcccataatcattttgaattgggggagatttaaagactttagtattttgagccttggctgctttctgtggatcacttcttgggtttggggaaaaagctgacccactccaagtcccactgtgaagcaaataacctttctcagaggtggcagcatgcagaaaaatacaggagtgacggggaactagagctgggggcctgaggctgtctctgggaatgccagcccatacacagcctcctttcctcctcaccgcctctcccacctgccccctttcctcctgaggcagggagagaaggctcgctcagcacacccaggacctgggttattcctgagtcatccatcgcctgtgtgggcctcattttgcagcactcgctccccctgcaaatgtctgagtcaggcatgtctccccaaggttgtctgcacacactgcactgggccaaactgtctctttagatgccgataaacatcaactgatactttaaagcagcccgtgattatatgttggtattttaatcttatgggctaatctaattttaactgaactaagttttgggttgggcctggatcagtgggctgcccgccttccctgggatcatgctgacttcattttcttccccctaaagctcatctaatatacagagccgattttggggtctattaggccagacctgagccctgagtttttatactacttgccaagaatccagagttccccccaaattaccccagcaaattctttcctgaaaagatatgtccttaagcagttctaactgagattcaggatgaaaagctctgttccttcccaggcccccttccctgtcccttgggaagcacttacccctaagcccagactggccttgccacagtgctgagcctgtttgagaccaggccacagaaggcggaggagtgatatcacagctgtgtgttag

SEQ ID NO: 52397 - DNA, 1259 bp, Homo sapiens
agaagcccagataggactctaaaaaggaagcgatgacctttttctctttgggaaaatagcagactgactgcagaacagtgggagggaggtcagctggggactgggaggaaggcttcaggtaggacatgtgtctctaggagtgccaaggcacttagagggcttagttggtcagattgcccagacttcattcagctgagcaccctcgaagtttgcctttcctctccttccaagccagccccatggcgtccagccctggtacaaaggaaagacgtagtcagaagccctgggttctgctcctgatgctgcctctcagtacctgtgtgaccatgaaccttgaggttcatgcacctcattctctgaacctgacttgcctcatccttaagaccaacgtagaggctgaacgtgggaatgcctggtagagtgcccagctcactgtagtaactttcagggccgtgcagattcttccccttttgggaggtcttcccagcccacagcagtcactttctctttctctcccaaacccttttcccttattgtttatccataacagtggcattaggccttgcctgccctgtgacatctcctgtgttgaacgggtgtgtgtgttttaataatagttgccacttagtatctacagagtagtgtcaggcactttataaaagcaatcttatttaatccctactcaaatcacatgagataaaagctgtctctgttttgcagatgaggaaatggctcagagaggttatcttcagtgatgtcaaattgctatttattgtctgttcgagtcttggcatagcctgctagaggggtgcagctgcatctcctgcctctggcattcccgcagcagatgcacatggccctgcactgagaagcgcccagctcactgcacctgcactcaggaattgtaggactccctctaggagttgggcacatgtcgttggtgggagccctgtccctgccttgagaaagctgtaggtgttctgtgtccagctgtgcacctgtcctttgtttttgtgagtcttcttggatgcacctgaatcctgcattcaggaggcctatcccttgttctctgctagcaaccctgcctgctatctctcttccggtgccctctcagccatcagaccagagcttgcttcttccctgcttgggcagggaagtgccaggtaaagggtggtctcctttagccacaaggggtggctgaccttatgacctcccgcctctgagcagaaaggtgacaggctgcttttggttaccctcag

SEQ ID NO: 52398 - DNA, 1061 bp, Homo sapiens
caggaagtgttcaatgagtgacagctgcccctgttaatattttaaccacctacagcaaatgcatccctacctcagcctcctacaaccttcctctgagctgaaggattacaaatctctcaaacctaggctgccaccaatgtccttccttagggtatcagggtttccatgtgtcctatactgttcacttgagctggtcatggcgggagggaagatgacaccagctgccttgtagggataagggtggggggctgaggccatgctccctctgcactctcagatacccaagagcctgggagctgattttggggtcttgcctattctctcaacacccctgcgtgggtaggagttccgttggagccctcattctgtcatctatggcagctgcttcccttgcaggttacccctcctataagaatagaaagtgctttgcagttctccttcctaccctaaccatggagcagagcctcgggtagactcttgcagagactggggtgggaggagcagggtgggagctgaagttctagaatagttgcttctgggttctagtctacctctgactcagtgggtgacattaggtaagtcaccttccctctctggaccttttttctctccccagcagtcaggaattcttgcttgtccttggtggggaggggccagtggtgtgaagaggatttaggctattgggaaaactgtgggaatgactccaagccttaggagttaggtgcattccccaccccacattgtgctgtggaccccgcatgaactctgctttgttccatgttcacctgactcccaggctagtacttattccagaggagagcctcactgtaactcagctcaccactggcatctcctgcaattgtttacccatgttcctgacccagaatgcctggcagaggcccgggagcccataaagcaggtattcatcttgtctcctgaccagggacacaaaaggcttcttttgtccctttatatcttatagctttttttggttttggtctttgcaaggcgaatcctgccatctcctctgtagattaagtctgtgaataggggagatgggg

SEQ ID NO: 52399 - DNA, 1038 bp, Homo sapiens
aacagacaacttatttgctctcagagtattggtctccctgctaggcctgagcactctgttctgctgagtgattgggggagcttactggagcctacattgcccagaagtccctgaaagtggtgttcagggggactttgacaactgcctttgcattttcagcttgcccccagctggctgtggaaggcatgaggtcctgggactctgctgtcccctctgcctgagatttgggtttgggaatttggcaggaaaccttccagctctcccaaggacatgcaggagctgagcggtgctgccgggctggtgtgaggcaggctctgggacatgcagcgggagggaagtggtgcctctaatttgacagatccaggagctgggttcctggtgcagggctcttgtgccaagctggtcacagtagcagagccttacatggaactaagccatcagcacctataccttgatggcagttagcttcctggagagaaatcaaggactggacaaggggaaccatgtgtactgattctgacataaatgcatgaccttgaatagctgaggcctttttctgcaggtctccctcacctgtgaaatggttaagactctcaatttgaccacaccaattgagtcatgaaatgtcgtctgatttgctgtaagaagctgaagtgacagtgatgtcatttgactgtgtgagaccaggaggagacctcacaagtgcaatctataaattgcctcctgtccccgatcccctcacctgcccaccacacctggcattacattagggcattcagggctggcagacacactttgagtgtcagtggctgctggtgggatgacagcatgactgcagagaccccactctaggcagtcagaagtttgtccctgcaggcctggtatctctagtgctaatgaggtcagcttggcctggcctgctttgtcaccacccaagtgctgtgcccgggaccctgggcagctggagagcagagatggtgtcatggcaacaatatcagtctagaagtcaggaaaacctggcttctcttcctacctccc

SEQ ID NO: 52400 - DNA, 1619 bp, Homo sapiens
gttgctgctggcccaccgcgagccgcccccagcccgcgccgaggcgccttcccgccaggccgcctgccttccgcctctttccatttccccggaatctcagcccggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtaagtcccgtttgctccgatgctgcggccgccaccagactggtgagcttcttgcctcatctcgcaccatttgaggctgtccaggagtaaggatctgaactacccccataaagtaggcagtctccatcctgccaccttggtccttctcaggctccagttctgtggcttctgatctgtgatctgaggcttcccaagattggagccagcactgtgcacagaagagagcaggattagagaatgggatgcctctgatcctaggtcccttcagtaaggcttccacgactggcaagtctcctctggctgggccagacccccaggggagccaggcaccccgctgtgtgtgagacagaaaggagtgtcttctggcgagtggcacattctgctctgtcaacagcaaccagtgcaatttatgacaggcttcactggagcgtgttccaggatggagtatatttctacttggcctgcttgaggagtttaagcatagtggagacctgggcacaggaaacttacaagtgtggtggaacacaggggatccccatattcccacctttccttcatctccagaatgttatctgtcagctttgcttgt

SEQ ID NO: 52401 - DNA, 1027 bp, Homo sapiens
acatgccacacctggtaagggctggcaccattccaccgacccagcacagagacctcttgggcagggagttgcagggtggagccttatgcaaaattccacaagttctaggttgagtcatttcttccaccacacccactctgctcactctctcctcccccagtgagataagtccagtacatcggtggaggaagggggctcagcagcagaagatggggaagacggggcttcaaggctaaaccagaatattgtgccaccaggagaattgtcaattctctcttcaacgagccttcttgaaaccacacatatgcccaggtcagaagctgggaaaaggaagttggatagaaaaaggagttgaaggggaataaatgtatttgtgtagttttttcctgccagcaatagcagcaatgagagttcaaggctagaattaattagactctcacaccccaattaagccagttttctccatcctggttgttaacaaaaggctaacattattaaacaatctgttctgtgccaggcactgtatgtataacttcatttgttccttatggcaaatttgtattagtatacccattttataaatgagaaaactgaggcttggagaaggtaatgatgtgtccaggtttacgcaactagtatgtgatggagctggcaaagagcaaaaccaattcaagtcttcagaagactgcatgggtttaaaagtgctctgggggaatttcatctttcaggggagaaggaaatggttttatagtaaaatccttattcctttcagggtattcagtgcctatttctgacccctgccgtgactggagtggtcacagcatggagagaatctctgacctcaaagccatgcccttctttttgcccagaagggtgcgtcgccatatctgcatgtgtccctcctcacttcattcaggtctctgcctaaaaatcagagaagccttctctgatcaccctatccaaatgacaacctccatgtgtagcctcataatcagtctaatttgtcttcatagcacctaccacgcct

SEQ ID NO: 52402 - DNA, 1121 bp, Homo sapiens
gtcttgaactcctgacctcaggtgatcctcccgcctcggcctcccgaagtgctgggattacaggcgtgagccaccgcacccagccaggaggagacttttaaaatgaaaattaagatacagctccacccaaagcactgtcacaaagtcctggttctgtgaatgtagagtgtgacaggtggtcaggaaaagccctgcgacatcttctagctgtgtcagcactgaagtgatgcccacatcttacacatggaaagtagatcggagtgggatctgttagccagatcactcacagtaagggaatggtccgctattacaagggtttctatcctctatgacaaagattttaatttaggaagagaagatgcagggttcatagtgagccacaaggtggcactgtgagaggagggcacacaaagtaccgaattagaacctctggacgtgaaggattagaagagattttacagcagagaaatacaaagtaaacgcctccttttacagaagagatatgaggtccagagaagttatccaagttgtagagttttgtggttaagccagtaccagagacccaggtctgtctgtttctaagtgtggtgcacttaacctgtaatgctcaccaaatcacatctacagattcccacccattgcatggtgtgatcttactcaagtcactgatgtatttctgggtctcagtcttcctgaccatagaatgtaggactagtctagatctggttttctttttctttttccttttttttgagacggagttttgctcttgttgcccagactggagtacaatgacgtgatctcagctcactgcaacctccgcctcctgggttcaagcgatttttctgcctcagcctcccgagtagttgggactatgggcgcatgtcaccacgcccagctaatttttgtattattaatagagacgggggtttcaccatattggccacgctggtctcgaactcctgacctcaggtgatgtgcccacctcggtttcccaaagtgctgggattacaggcgtgagccaccgcgcctggcctcatttttatatttttctttttttgtttgagatggagtctcactctgtcacccaggctagagtgcagtggcatgatcttggttca

SEQ ID NO: 52403 - DNA, 1951 bp, Homo sapiens
aaaccccatctctactaacaatacaaaattagctcagcatggtggtgcaggcctgtaatcccagctacttgggaggctgaggcaggagaatcatttgaacctgggaggtggaggttgctgtgagccgagattatactactgtactcccgcctgggtcagagaggaagatcctgcctcaaagtaaaataaaataaaatataataaaataaactggaggctgagagccccaaaatgaaaggacagagttggagtctgctcctctactcactgtttttttttttttttttgccagtctttgtcagaaaatatatttattattgatagtgagtgaagtaaagatgtgagtattcactatagaggttatatcagccaaggttgccttcatattgataaaaataccttatctcacttgtaatcataaacattattccagtagaagaggtacattttctctcctttttgtcttcttgcctgtataatcaccataataagttacaatgaaatagcttttatataatcaaaggagaaaagaaagagagacaaaaccaacatgccacagcctagacaattccatccagcactgctgcctccagatctgttttctggctttctccacccagcactgctgcctccagatctatgttttgtggctctctcctcaccctactccaattaatttagcccccgaccccatctactttgttagggtggaggttcaccaaatgatggggcttgttcagaagagaaacattttatggtcagtggaagttgagtagaaagtaccaaaatgtggagagggctgcccttctcttttaatcatcataagagggtttgctaatactgaagagtgtcctttaatgactgatccctgatcaaggctttggcccttcaaattgctgctgttcaaaatgtgaaatgattctgctgaatccattcttggtgtctctctttagtggtcttctcattagtggtcttctcttcaaatgggttgttttctcactaggaaaaacaatgttccatctctggaattaacgttgatggtgttttgctcattctgaaagtttttatcctcccttctcaagcatggccactctgggtggccagagtggagcatttgaaggtctggtgggtgttctcacggtaacactgaagaattttggcctgcagatcagcacagactggatgagactcataccgcttgaactttgcttccacctcttcagcagctttctgatattgttcagtggtgactctgaagaactctgagttcctcttctccagtctagccagctgttcgttgtagaatgcatcctgcttctttagcactcggtctttctcttccagctgcctagccaggtgctttgccttagcgcgttcctcctcgctagatatcctctcccgaaggatggctctggttaactgctcattggcagcaaccctctctcggtccagctctttggctgctttagtcgtttctcatcttcagattctttcttggcttgctccaatgccagctcctcagctactcttcttttcaattcttcatcagaaactgaggcaccataagcaccagaataccgctgagacttcgaaccagatggagaggattccttcattcgatcaatcacattttctgaaagccggatgcccttcaccacggtaatgttctcattctcgtccgcctcgaaggtgacccggcgggtgctggtggtcccacccatggctccggttcctgccccagcggagacctagcgcggaaccacgagcacttcggggcccccgcgcccacacgcgcatggaagggcctggattcttttcccgcacggcgggagcaaggccacggcccctactcactgtttcaatgaattatgtaccttggtatcctggacaaggtccccaatatgaagcaactatgttgtctgggtaagtacccagggttcatcatctcaca

SEQ ID NO: 52404 - DNA, 1074 bp, Homo sapiens
tctctctttctgtttttctctctctctttctgtgtgtgtgtgtgtgtgtgtgtgtgtgtgtgtgtgtgtgtgtccacagcagatgccttcagtggcccatcctggcaccaaacaactctgccaaggtgtttccaccaggcgactgtagcaccccgtatacaaagggcctctgcttgggaacgggctattcagtacccacttcaaagggtaaataggaagtgaggagatagaagagagactgcgaaccagcaggatccacttcttggactgaaagccgcagtgggacgcccctttgccagattggttgactttgcttggtggcttgggctctctctcctctgcgggtgtactcccagggtttctagaggagaggtacaggggcctgtaactaatgtcttaatagccgaatttgactgttttccccagagttcttttcttctgtgactttctttaacctcctgaagtactggtagagcaacgttatagtttttctctcaagttggtgattttaggagcctggtagggtggctgaagcttccccattcattccaaggatggggtagatgatctgggtaaagtggcagtgaagtcttccctttctaacaaagcctgaaaccgttttgagaagaaactattttgagggcagcttctgactcaaagacgttacgaaatccccacctaggacaccggtatgcccagtggtccctactaagcttttctgtgtcttttagagtcgttgagtggccagcttctgctcactgtactgaaggaactacttaatgctatttctgtcttgagttctggcttattcttccttgtgattcttatatctttagcgggattgaattgaatttttgctgttgagtgtaatagccagatcctctgtaacagaccagggagtaactagttgggctcctttgggccaagtctgagacttactgaggtttcttcattgtaggttgttgtatttcgttggcaggtgggaaatgaccttttccgtcatagtttgtgatcatgctgctttaaggctggagtcctgctctcctttccttttttgacctatatgggagcact

SEQ ID NO: 52405 - DNA, 1027 bp, Homo sapiens
taaaagttcagacgagctgccacagatgcctactgagcaagtgaaacttgatgtctttctagctttgccttgttctaactttaaggatatgctaccattatccttcatacttatacacaacctgccattttccgatgaagcataacatatttcttccgtgtttgttccaatgcttgttgggatgtgctactgttctccccacccacttcacccattccagaggtttttcaacactatggagcagggccagcccaccatgccacaaatgacaggcaagggccacttcactgggtgggctgttttaggggtggaattaggtcttgggagtcactttattatccatcctccaaagtttgatgatttttttcccccaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggtaagcagcccagacttctgcaccagatcatgagatcttttctttcccacagattgattttacagatgaaaaaactgaaatctatagtctgtgacttgcctaaagtcacgtagctagttagtggcagacccaggactagaatcaaggtctctttctctccatcttgtattgtctaagaacatggatttcatggagactctgtccacatacttgtgcctgggctgctgagattaatgcaggctggcaagggaggggagctgtcaatgtgttgtgcagatacatacacatccttgtgttgggcaggtggtgcacaagagcaaatataacttcttcatgttgctccagctgccaagttgtatatgtaagagatcctgggagagtattagtcccagttcagcttgtattctctttgaggctctcctgtgctaaagcctgtcctctgcagtttgtatgtagaagacactctgatacctgtgagataaatggatgactgggcagtcaagttc

SEQ ID NO: 52406 - DNA, 1080 bp, Homo sapiens
gtactgggattacaggcataagccaccatgcccagcccctgaatccttttagctttgtccatttgtggaagttttttgtgtgtgatttcattagactgagtggtcctcaaagacaggggccatttcctagaggcatggaatcagcaggggttttttttccctttgtgtgcaatatgtgtcctaaagatgatgcccaccctgtccaacctaaatatggaactattccccattgtttccaatttttcttctttcctttttaaaaattttttgctttctttaaaaaaaaaaatgaacggcacaacttagtgcttaattatatactactgtcttctattcttctctaatccttgccccagaataatacaaagtcctgtaggccagttccttgttgtcttctttagctcctgtggtgcccaggaaagagctggatatataataggcacataataaatcatatttaattgaatcaatgaaatcacgaatttgtttctgtcccctaggagcggggtgccctgagctttgagcggcgctaccatgtcactgacccctttatccggcggctgggcctggaagcagagctgcaggtaagagatccagtttgcaccttagatgcagatggcctgctgtccattctctgcctgcagaaatcctcttggccttatcaaggcataaacaagtgtttctctgcaggccatatctgacagttacttctccttcagtagacaactaaatctgaatcaagatcagcaattgacatagtcacatataaattattatttttttattttattttattttttgagatgaagtctcgctctgtcacccagtctggagtgcggtggcacgatctctgcttactgcaagctctgcctcccgggttcacaccattctcctgcctcagcctcccgagtagctgggactacaggcgcccatcaccatgcccagctaatttttttgtatttttagtagagacggggtttcaccatgttagccaggatggtctcgatctcctgacctcgtgatccgcccgccttggactcccactgggattacaggcgtgagccaccgcgcctggcctta

SEQ ID NO: 52407 - DNA, 1068 bp, Homo sapiens
ggtggtagccaaacccaggagatgactgttttggatgaatcgtgagttgattcacctctctgtccaacaaacagttgggtagaactcagtggtcctcatccaggctgtaggctaagagctcagcttcactcctgcattcttgctaagagaggttggtgatttcctaatccatatgtgccctcagcatgttctctgagctcctactatgtgctaggtactaggaacacaaagttctatcactctgagttcctgtgctccagaggagcctctccagacagtgggtaaagtggtggacatagttcagcattaaagagataggaagcagtgagtcttgtgaatggtcaggtaaagggctgtgggcatcaagaaaagttgggtcgctttagctggggagcagggaagcatcagaaagacatggcgtctgaatgggctttaagtgtaggcaggcttagacaggagatgaaggagaggaggggcctgtgggggaaggacattccagggagatgaaatggtgtgaacaaaggcatgggggtgggggactgactgaagagcttgtttgcagaacagcaaatccatttggctggagcagagggttcggaaagggactggcaggagatgagtctgtgaggtagcctggggccggcctagggagagcttggaatgcagagcggtgacgttggcctcgattcagtgcatgatgggcagctactggagagttctgagcaggagagggatgtgccgagggctgtcctttcagggagattgatctggcagtgagtctaggaagggtgagccctggggccagcctgctctctacccccatccccacatgcctgccagtgacccctagaatgtcacattctgtcctgggccagtctccccagggctgccatctgctcctggatgcagtgggagctgtcaccctctggctcctggctggtctctggtctggctctccccaggagctcagaggggcaccttgcaggcagtaattgggtttccaaacagtgcctgctccttcgtcagagccactcatcctgacgcaggccacgccattgaagcagctct

SEQ ID NO: 52408 - DNA, 1013 bp, Homo sapiens
tctttaaaaataaaatattgggacaggcgcggtggctcatgcctgtaatcccagcactctgggaggcagtggagggtggatcggtaggtagttcgagaccaacctggccatcgtggcgaaacccgtctctactaaaaatacaaaaattagctgggcatagtggcacgtgcctgtaatcccagctactctggaagctgaggcaggagaatcgcctcaacccgggaagtggagtttgcagtgagccgagattgcaccactgcacttcagcatgggcaacacagtgaaactccgtctcaaaataaatagtgaaataaaatcttaggaaaatgtgcacattaattcattcagtgttcttctaacacatgtgctaagtgacccctgtgttcccagatagttctaggtgatgcgaatatacagtgatgaataaaggagatatggtctttagacttttgagagtttaagtcatagtggaaggagatagacagtaaacaagtaagctaataaaagagcacctgatagtgatgagtgctgtgaagaaaataaaatattagtgtgaaaataacaggggccgggcgtggtggctcaggcctgtaatcccagcactttgggaggcccaggcgggcgaatcacctgaggtcaggagttcaagacaagcctgaccaacatggagaaaccccatctctactaaaaatacaaaattagccggggtggtggcacatgcctgtaatcccagctactcaggaggccgaggcaggagaatcacttgaacccgggaggtggaggttgcggtgagccaagatcgtgcttttgcactccagcctggacaacaagagcaaaactccgtttcaaaaaaaaagaaaataactgggagggatactcaggaaatgtattggttttcttaaaacctgtcttgtgatcctaaactctctttagcctttcttattctcaaaaacaccatctgtggcgtggtcctctgcggagaatggtagcagcgtgaggtggaggcaccacaa

SEQ ID NO: 52409 - DNA, 1050 bp, Homo sapiens
aaggccccacctcctcataccatcaccttgagggttaagatttcaacatatgaacttggggacacagactttcagagcatagcacccccaatttcattccatatccccccaggatcccccatggcaccagccacctcaccctgtgtcacagttgactgccacataacacttgccccagatctggcttactgtacatctcagcacccagctcaggcccgggcacagggcaggcctcagaggacgtgcgtagagctgagggcacaaaggagccaagcaagtgtccagagcccttctctccccccaggtactggaagttggaccctgctcaggtctatgctagcgggcccaacgcatgggacacggctgtgcacgacgcctctgaggagtacaagcaccgcatggtaggtgggccagggcggcaccggcactccccaggtggggaccaggggggaggctcccctgcagcccatcctgaccagcccttctggtgcctccagcacaatctctgctgtgacaactgccactcgcacgtggcattggccctgaatctgatgcgctacaacaacagcaccaactggaatatggtgacgctctgcttcttctgcctgctctacgggaagtacgtcaggtgagctgccctcctgcctgcccacccacacactgcccagaggctgctctcccaaggatcctagaaagaccattcctagcgtccttcagtcagccaggacagttggaacagatgccagttggagccgtggtggttctagagtgacgagctgagggcctgatggagagggaggtggctgtgctgaagtccagctccacctgggccccaaatgcagctctggctcttgcctgctgtgagaccatgggcaactgccttggtctctcttagccacagctgtctctggtgaaatgcaggcaatgattccggctcctcagggaggcttctacggatccctgtgctccggtaaagtgagcagatagatcctctcataatgactgccccacaggtcccttcctaggcagagagattgagtgagtcgccca

SEQ ID NO: 52410 - DNA, 1240 bp, Homo sapiens
gtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagccacctctggtgtttgtggtattgttttaatgggacaagagattagaaggaaatgacactaacagccacaggtggtggccagagctcaggaggggctccagtgtgggtgggcctaaagggcaggaggcttttgggtgtggaaagtgcattgtgtgcagaggtggagaaggctggaaaccatttcagtttaggaggagacccaggttggaggacctgcagacccagatacccagtccccttctcaccatgagaaagggggtgtgctggggcctcaggagacaatctgctggcaactgtttgcatcaggcaggagaggagtacaggctgaatgctgatgctgcgcccaacatctggccggcatcttgtctgcctctcagacccaagcaacttacctta

SEQ ID NO: 52411 - DNA, 2670 bp, Homo sapiens
gaatgtggtggctgctccccacttcaaagccttatgagaagtcctcaccagcctgaaagtgtgtaaaccagaaaggacagcaggctgcctttcagacacacctgtgacatcagggccatcaatttcataaactcatcttcttctgcttttccataacaaccttctttttctctatcctttccaataccacttacccattggtggccactccctcttacccagttccagatggattccaaggctgaggacacgccttcctcacccttctgtctctttgccactaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcct

SEQ ID NO: 52412 - DNA, 1400 bp, Homo sapiens
cccgggttcatgccattctcttgccttagcttctcgagtagctgggactacaggcacccaccaccacgcccagctaattttttgtatttttagtagagacagggtttcaccatgttagccaggatggtctcgatctcctgacctcgtgatccgcccacctcggcctcccaaagtgctgggattacaggcatgagccaccatgcccagccttttccttagctttaactcatcatgaaatgaagtggtacaatctgctgtccatgatatagttagcagttaccttgcccagttgtctaggaacctagcatagagtcacttcctcttagtgcttctggttagtttcactgctgtgtcaaatctccagaaacaatgaaacaaagggaaaagggggatgaaactccaaattcgtccattttgatatttgtgcatgtccctggcagaggtgtacagtggaagtgttaggcagtaatgactgaaaagagatctgagaattgttcagattgcactgttttctccgttacttttgtcctttctgatgcctgataaatgagagctttgaaaggtgcacttttctccttgggtacttcttaattagaaattgagtatgttgaggacccctcggatggagacctaaagctgtgctgtcctccttctctcccctcattcttcttggccctagaaaccattaatcccaaatctccttctgcttcccaaatcacttcctgctggtggccctgtcagatgcagctaaggctggaaggtctgtggaaaattccaaaatggctgcttttctaaggagtagctgttagtgcagggtagatacaaaggtggaaaaagaaaaccttcagcttcacacatggcctgagaccttgcagctgcagccgagcaaatctgatcccaggagaggtgtagctttaatcctctttcaggcctgggtcaggagtctggtggcacattcatttcccatctctgcagattctcggattgagattcattctctctcaagatttccccacatgagcactgaagatgcattcacctaaatctatatcccactcaggtgtggtcagcctggcttgggtttcctgccctctccaatgctggtgaatgttaatagcctgagaaacagagcctagtgtgtgggtggtgtttgaatttttattccagttctttcttgcatgcacccttaaactggctccaggattaaactagcaactgccatggaccatccttcttagggaaggggagggagggtgccttccccttagagctggaaaggcagagggggccgaagagatgtctcagctagcctgtacctgatagaggaatctcaagtccacttcttgcaggtagttttactcaatctgtctatcctcctctactggtgggaagctcattac

SEQ ID NO: 52413 - DNA, 1136 bp, Homo sapiens
gcatgaatgtcgccctggttttttctctaaatacactgcatcatggctgtcagagaaccatgccagcccatgctgggtgtctaggaatgataaaaggaaagagttgagttgttcttgcttttagaaataactctaccatgaaaatcttgacttttaaaaatcttgacacttctgacacttgttcttcgtggattaagagctctgctttaaagagtgatgaagatggtgaaaggaaaaaatgaacctttttctctactgggaaatcagccctgagggtaccttcattaccttcacctcccagtaaagggggacattttgttccacggaccaatcctgttcagacaggcacttgtcataggttcaatgactctaaggccagaagcttatgtgttcagaatgccagctacccatgtgtgtcttctttttgtggagtaggaagatgaggatttgccttccattttcctgttgtccaggcggtttggagttggggcttcatggttagtctatctggacatgcctgttggtgaacctataaagagacgtgccaaggctccagggctccaggccttggggattttccacatcagagcatcttttgattcagttagttttctccaactctgttctccctgaggtctgttttagatgagttctttagaccccaacaatggtggaaagagggggaggtggagcagagcaggccagattttgctagctgatgcttggtgtatttgtgcttgtttgaagttttgttgttgttcacccagaacaaattcacccaaggcccagtgcactgagggacaggttttcatgagacaagccctagcacgctactttaatcgtcagctcatttggtttgataagagacctggcagaaagaccacatttactaccacatagcaccctgcattcatcctcagcttgattttgcaatccagtgcctccttggccttcgagctctccagaggcttgctgacctcaaaatcagtctgtgtgccagtcacgtgtttgcagctcactagcctctgagacttggcttcacatttgtcacaggacagactttgggattcaggtatatctgcacctgacactggggagagaatttaaaagaactgctgggtttgacaaggccaaca

SEQ ID NO: 52414 - DNA, 1002 bp, Homo sapiens
tagcaattagagcttttcaaaaatgtgaatgagttatccaaagaggaagtggggttcccgttgctggaggcatttgagtgtgggattgagcaaatgtttcacccggggatggtttggattagatggcctctgggtcacttcaaacccagtaattctgtaagttctgtagttattgtatgttgtctaggcagattatctcttagatacgcatccatgaagatgggtagaattttaatgaagaacttggaaaatgttctacaaagaccttcctgttccttttcattatagaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtaggtaatgcctttgtactgttggtagcattctttgaaggggctggggacaacagtctgacagctctggtgtgacacctttcacaccccctgaagtctgtctctgtggcttagatcaataccactgttaatcagctactttaaagtgcatccatctggtgatgaaaatttgctaaataaatcaagagattcagcgatttaaatgaggtgattggagtggtctggaaaagaaagcccatggctcctagtgcccttactctgcgagatacacatctaagggccccagaggaaagattggaaagggaagaaaagtggtcttgggaatcctttgcctccagagcattgatttgaaggtcatgcctaagaactgggcatttcactctcagggctggggagggctaggcaagaaagctgttcacatcaccaaagcaacttttcagtcagcctttgtcagtcatgggagagaagctagccaagggactgaatgcagacctcatagacagtgtgggaaaggttgcttggccagtattgaggctatatatctctgtggagaaataagaggtgtcagtctgaccccatttcc

SEQ ID NO: 52415 - DNA, 1050 bp, Homo sapiens
catacacatgaactcccacatgtgcacacaggtttccggtgggtgggaagctactgatgctttctagagagtccttggggaactggtgggaaaagaggaaccagtggtagaaatcccctctgatgtaccaggaaatccgaatatcctcagggagatctctgtggccatgcagatcatcagaagtaatcaggatccctgctgctatcacctgtacttgccctgacaatgcacattcatctaccaggaattgaaagtaaggctaaggttcttaaaaagtctgataagtagagaggtgccattcgggggcattgaaatgctggtatgggagaggaggtatgcaatcgattcaaatgacttcttgattccttggtgtaaaaactgctaactggtaggtgtttggaatattggatttggttgggagctcatctgtctactgacagctacttgtcttcatttctatcccagggacgatggaaaagaggcactcaaattctacacagacccttcatacttctttgatctttggaaggagaagatgctgcaggacaccaaggatatcatgaaagagaagagaaagcatagggtgaggggaaaggggcctctgttctccacatcagtaggcacgattgtggagggggataaaaaggaagccagtgttatgtgaagtaatcatttcaagtggctgcttgcttggatgccaggtgaaactcttaaaaaaatgtgtccacaccaagcacaaccaagatgaaagtacaaatcataccaaaaatgtgtttgttccccccagtgctattaacaattgagtatattcaggctgagttttagaaattgacttttctattcaccatttatttctcttgcaatttgcacctgactctgctggacactcaagctaggctagtcccttctccactagttttgcagctcatttctcagagatcagcacaaggttctgcagtgtttgatttgcaacaggagcagtttaatgccttcgctacgggctgggcggggctagggtggggggatatatgtaggttttgaagattctcc

SEQ ID NO: 52416 - DNA, 1050 bp, Homo sapiens
tttcatataagccaggtccatcttggattccatccaaggaatttagttattatagaaccaaaaggactttgttacaaggcggtcctacagcatggatcatggatcccaggggcaacattctagcaaggctcccacttacttggaaaccactagattaccagatgtttgggtgtgttagtggggccagcctcttggcctggctgctctgggcccaaaggggtctttccaaagcttaaggagtaattcgcattcttccaaatgagcatcgttcactttgttttgaacatcctttggacatttccttctgtaaggacctactctgctgtgcctggacttgaaaaagaaggtagccttatagacaaagcccctctcctctagtggtttggtagttttgtcatcctgcaaaaaaccactgaagaggggcagaaggtgaatatttatcttgcttacacccatatatatctttggagcaggtaaaaagtaattacagatagctggaggcagatgtcttctatcagacatgtgtacactgcaaggtagagtgtgtgtgtgtgtgtacccacgtgaaattcaaggacaccagtcagattcagggagccttctcacacagatataaagtacatggcatctgtccttcattttacttgtaaaattatgtttgccccttggctttcaaagggaccagcatagcaggacagaggtttgactctgcagcctccgttattgagtctagttgggtttgggcagaggggttgtggggcagaaaggggtcatacaactgataatattgtagcgagtataacatagggtttgtgtggtgggattgcataaacaaatgatattaggagaattttattcttcagttaatggtatttttctttttagcatacagtgtcagaattagcgtggcctctcagttatctgaacttggcctaacagaaatgagtggtggtgtatctaactcaggagaagatttaatatagaaattattaatgtttgatttggaagtgctttctgtgttgtgataggattggagggtagggaatagaa

SEQ ID NO: 52417 - DNA, 1673 bp, Homo sapiens
acttggttcctgagatgtagatttgaaggattgtaacctagagcagactttgaaagttataggttacaagccgggcatggtggctagaacacctgtaatcccagcacttcgggaggccaaggtgggcggatcacttgaggccaggagtttgagaccagcctgggcaacctggcaaatccccatctctaccaaaaatacaaaaattagtttggcatggtggtgcgcatctgtaatcccagttactcgggaggctaatacatgagaatcgcttgagcccaggagatggaggttgcagtgagccgagatcacgccactgtactgcagcctgggtgacagagggaaactctgtctccaaaaaaagaaaaaaaaattataagttataaaacataaaggaaccttcccacctcttaaaagaagttgtatatctctgctatggcttgttgataagctcagggcccctcaaagataacacaactgatcatagttgttcactgtattttcaaggctccattgaggaactaatttcctatttttcatgttaattttagatacgtagaacgtcctctgaactcccaatctgtttttcagaaccgttttataaggtacttttacagaacagcaagaggctaagggctataggcaaatgtgtagtgtttattttatttggagtctcgctccgtcacccaggatggggtgcagtggctcggtcttggctcactgcaacctccgcctcccgaggtcaagcaattctcctgcctcaacctccccagtagctgggattataggtgcctgccagcacgcctgtctaatttttgtatttttagtagagacggggtttccccatgttgcccaggctggaaatgtgtagaaatattatcttttcttccaggcttaattttttgcattacacctttcagttttattcagcctgttttgagtctcatgactgttcacgtctgtcaagaagactctattagttatagaacatatgcaggcttcctaaactatgaagagtatttctctgtctctaagagcagtcatctgcatatagcccaaaccgtcttagggtatgtgtgtgtatatgtatgtgtttgggggttagggaacacgatctttagtagccagtttttgtgaccatttacgttacttctatgcactagtgacttggtttctttgctctttccaggtaaatatgcagaggacatttttggagagctctttactcaggcaaatacctttgcctctcgggtaagctcccttgctgagagggtcgaccgactacaggttaaagtcactcagctggatcccaaggaagaagaaggtaagaaagctgagctcagcatttgcaggctctgctgagcagttttgtagaattttttttccctgatttatttaaaaaaaaaaaaacgtgaggagagaaatcacagagacctatagagttctgctttgaaatcacacaagcctgagtgctggaaagaacctttttagctccaccacacccccatgcactcctttctcccattcccccaattccttctttctcaaatttcccctccctcaatcgtattttgctaccataaaagtacttggaagattcattcctcctaaggagaggcctgctagatctggccacatagtaaacctttgtgttgcctcattttgttcagtcgtga

SEQ ID NO: 52418 - DNA, 1059 bp, Homo sapiens
acctacctcagggatcatctcagttgatccagggcttagagaaacctagatggggcatcatgaagaagtgaaaccctgccagtgcctgtcttacacaaaggaacactgacagtagcacaacagcagtgcagctgacgaggaagcacatcaaggctgcagagacctcactgctttttaaaggcataatttctgcctctctctgtctctctctgagaaggccaaatgggtggaagtcaatcaatcacacactggttccttcttcataggacaaagaacatctagctaatgatgcttcttatttccacttactgaagttacgctctctctcagctatttttccagggtggtgttgatggatgccattgctcacactcccacttgtgatcagaccactcctatcttggggaagctgatctgagggccaaagtcaccttatgcccaaggaaacaagattttcttacattgtgggggctaactgatcctttattcatccaataaacttgtgttgaacatattttatgtaccagctgctgaggggatactcaacaagaataagaataagaggcaataataagaaattgtctctgccctccaggactcataatctacaaggggaggcagaaataaataattcctaagaggagagaatgggaagagagtgagaagggaacccacatttgttgattgcctactttatgccaggtttggataagatcttgacatagattatctcatttaatcttctcagtaatcctatgagattaggtggtggtattcccatttttcagataaagaaaataaggctcagaaaaataaggtaacttggccaggcacagtggctcatgcctgtaatcccagcactttgggaggctgaagggtgtggatcacttgaggtcaggagttctagaccagcctggccaacatggtgaaacccgtctctacaaaaaatacaaaaattagccaggtatgttgtcacacacctgtaatcccagctactcgggaggctaaggcacgagaatcgcttgaatccgggaggcggaggttgtagtaagctgagat

SEQ ID NO: 52419 - DNA, 1576 bp, Homo sapiens
aatgtgtaaaatttttactttatattctctcgttcagtcaatttacaaactaaacttaagagatactggcattagtagttagctatacttttttttttttttttgagacggagtcttgctcttgtcacccaggctggagtgcaatggcgcaatctcagctcactgcaacctctgctttccgggttcaagcaattttcctgcctcagcctcctcagtaactgggattacaggcacccgcgacacgcctggccaattttttgtatttttactaaagacagggtttcaccatcttggccaggctgctctcgaactcctggccttaggtgatccacctgcctcagcctcccaaagtgctgggattacaggcgtgagccaccatgcccggcctagtggttagctatacattaacagccatttaccaaggaaggactggaaaagttaatcctgatgtatatcaatcactattggcagcttgatttcattgtggagattatcaggtgacagtgttcttttttgatctttataattggtggcctagaatctgatctgtcctggttatgaacaccccagggataggatctgtaccgtccagtgtctgctgaatgggctgttttctaaccatgcctccttgcctctggagactcttgttggttggagcagtagttggcactttaatgtttctatgctgcctatgtacctcaggcagcagtcaccagtccataatttctaaacttacatagcagatcttctaatagcaaaccttaaaaagggcaagggagagaggacttaaaaatgaaagaaaaaaaaagatagggagaatgaagattttttttaaagctgttttagatcagggtaagaccaaaaaaaaaaaaaaaaaagattcacacagccctagtgtgcctggaatttgtggttgagtaatactttcctgttatttcttttttaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtgagtgcctcagagagcctgtgctttgccctcaggggtcgttggtgctctttatttagtttccttctcctcccgcgttcctatttctcccccatctgccttccctaggtaatgcgaaaatgtatcctccctctcctccccaaagagaggctcccttttggtgtagcttcttctcttcaaccttctttatctaccaccaccctctaggttccctcctccctccccctccacctgcttcaacagaaatctgtgggaagggtggcaggaagggctgcagcaaaaactgcagacggaatgacagagcagaattctgtgtgtgtaaagtgggaggttcacagagcagtatcttgggtcggggaatgtgcctgtaattacacgagctgttcgatgtagcctgactttgttgaagcctcaaatgtgccaatagtttttatctacccaacacccccaccccttt

SEQ ID NO: 52420 - DNA, 1029 bp, Homo sapiens
gctcttttctgacgcttttgataaagaaacatacattttatcacttagtgagtataactgtataaaactaaagagagcagccggtggggctgaggggctggactcacccctgcaactgccacctgtctagtttctcagttcatatttgctagctgtggtagggtgggcctttacatttctactttctccttctcagcctgtgaagaatttcccaattggtcttcttacttccagccttctgcccaaatataactcctgtgcttatgcagaatgatttgtctaaaatgcaaatgtgaccctgttgtccttccataattcagtggttccccaacatccagtgcactataccagtaaggtgctactgatgatagaggagcctttctcaactggagttccatgaaagaattaaatcttaatgtcattaggcattcattatatgtaatatattaacttttctccagtacgcgtagaatggtgctagttatgtacagtcttgaggggaattgagaaaactgtcactctaatcatcctttttgttctgtggttcagatgaggaatccagttatgaaagactggaagaaagagatagtatatgttcttcaggaggtccaggatcacagctggaagcagcctccaggaaaaacctgccaaattcctttgaaggctagagttttgtctttaaatttttagtgtaaatattgcattccaccatataatatgtctatggttaaaagtatttttaaatatttatcaatgaggggcccgggtatggtggcttacacctgtaatcccagcactttgggaggccaaggtgggaagattgcttgaggctaaaagttagagaccagcctggacagcatagcaaggccccatctctataaaagataataaattagccaggcatggtggcatgtgcctgtagtcctggctacttgtgaggctgaggtgggagcatcacttgagctcaggtgtttgaggttgcagtgagctatgatcatgccactgcactccaacctgggcaacagagtg

SEQ ID NO: 52421 - DNA, 1036 bp, Homo sapiens
agtgctgcttgcaagagccaagaaagaaaggttgcagtctagccccatcttctccatcgcatagtatgatagtaaaatggggttagacccttccataaaaccaagctgtgtattggacttttggctgtttgtctgggagaatacatgcccaggtttggcttcctcccaggtacttggagaggaatgcattttgtatctgtcctcttatctcaaatttctgggtaccatcaactggagagcactctcttctgtcattggctataaatttaaaaagaatcgtttaaatatgaagggtattttattggggcttgtgtgagttattgacatatttctagtaatctagtgaatgatttgaactgatttgttgaggtttgatactttttttgttttgtgtgtgggtgttgttttttcagaacagcttagttgtttttcatgttaaactcctgtgtaaatttaatgttcagttgatgacaatggctgaaagaaatctgataccttattaggagtaaagggtaagatttctccatttataagtacaattattcataatctatatttatccaatcaaagtaaaagcccatttagatgggtagtttgaagtatttcaaaccatacaattttggtgatatgggttttactagaaattggcattagattgggaaagtaaaatgaactttgtctgtaactgaaagtcatcagtgaccacattgtagatcctgtgtaatttaagtggatccataacaaggaattgggccaagatggagatacaagaaatactttatgcgggtaaatcttttcctcagagctcagaatactttgcatacaaaatctctgtttcatatagcatctttcaagcattttttagtgtagtttacagctggactagagggatgaattgaaattttatccccgattgcctgtcatcattagattgaaagctagaatccaggtttccaactcacagtttaaatgtattttcttttggacaaccagatggatcctgctaaaaagagagtctaattttggccatttaaaa

SEQ ID NO: 52422 - DNA, 1066 bp, Homo sapiens
tatttcattgaaatccttgagagttgctgaaaacacatgatatgtcttagtactttaaatagaactgttctaatttggagggaaactgctgtacaaacatggcccattgataccttcacagcttatctattcatgccgctcttgccatttctgaattttggaaaaagttctgtgttaatgtaaatataattttatttttctaaatactcatatcttaaaataatactcattaatagattttggtaggaaaactccatcttcttaatttttcatttatataagcttcttccctgcattctggaagacattcttcagtgtatatactgtgtcaaagcccattttcaaggcagttgatagagatttagctatgcaatttatttaccattggtcaccaagaaaataaaaatggaagaaccagaaggccactgagggaaaatgttataacagcatactccaggggctagagaccagagagcaagaagaatgctcacgggtggtcccagggaactatgattgatagtaacagaatagcaattaggtaatggaaagttccggctactgtaccaaagacattcttcatcttttttttttttttttggagacaggctctcaccctgtcacccaggctggagtgtggtggcacaatcttggcgcactgcaatctccacctcccaggctcaagcgatccacccacctcagcctcttgagtagctgggactaccagtgtgcaccaccacgcctggctaatttttgtgttttttgtagagatggggttttgccatgttaccaaggctggcctccaactcctgggctcaagtgatctgcctgcctcagcctcccaaagtgctggttgggattataggcgtttcttctaacaaattttgtcttggagttgtctttacaagtgaagcttttgtgatttttggaatgctatagaattcatctctaggcttcttgtcccactaaagcattagaatttaaaacagaccctttaacatgatttatagcagacaagaaataccagttcagtttgggcaggtggtatttaattgcccctctttgcggt

SEQ ID NO: 52423 - DNA, 1125 bp, Homo sapiens
ccattctcctgcctcagcctgccgagtagttgggactacaggcgcccacaaacacccccagataattttttgtatatttaatagagacgggatttcagagtttcactgtgttagccaggatggtctcgatctcctgacctcgtaatccacccacctcggcctcccaaagtgctgggattacaggcgtgagccactgcgcctggccaaaaacttttctaaggttatacagctgaagagtatatttagcagagctgagatttgaacccaggtcatttggtttcagaattcatgttctgaattataggactattttgctctattcacagtgttagataaatgaggtatatctgtactccattttggctatgggactatgattggacgctgaacatggggctatgttaatagctctgcctcctggttcttcaaggatagggtgatcatataatgtgtaaactggttcacttttaagagtgagagaaaatacttttaataatcactctgggatgattgatgtaaaccaaggtgaatggacaccctgaaaggatacctcttggcagagtttagttttcacaaatgtgacaggacatgataattgcttcattataattgaatcttgtttaccatggattcttatttacataatacaggtgcattttttctttcgccaacagaactcaggcctttacctgattcattttcatattctctcgattttgctaattcttttacttccctccagaccactcaggaaatattctttgtcaaacttcatttcctccaagtctgaaaaataccagcaggaatttctataacacttgtcccattaaaaaaaaaattggcatttaaaaccataaatcccaaaatatctttattaacaggatttctacaaggagaggagctggtaaatgcatctgcattactggactggcagagaaatattactgtcatcaacttcctatagatacttggaaataaccttattgtatggtactagaggctgtgttaatgtttgttaaaaaggattataccagtctagaatcaaagcatatgtgttatctcattgatctgttatacttatttgcagtaacactgttctgaagctgcgtccaattagaggttgtc

SEQ ID NO: 52424 - DNA, 1037 bp, Homo sapiens
ctgggattacaggcatgtgccaccatgcctggctaatttttgcatttttagtagagatggggtttcaccgtgttggtcaggctggtctaaaactcctgacctcaggtgatctacccgcctcagcctcccaaattgctgggattatggatgtgagccaccacgcccggcctaattttgtatttttagtagagatggggtttcaccatgttggccaggctgatctcgaactcttgacctcaagtgatttgcccacctcggccttccaaagtactgggattacaggcgtgagatactaatactgctttaattatggcctttgtattctgcttcattcttgtgtgctcctcttccatttcatggtccgaccaggaatacttaagcagcatccctggttgccaatagcaccccctctgccccagttgtgataaccagaaatgtctccagatattgttacttttatcctggggggatagatttctccctgttgtgagctactgtatcaataggggtaggagtggtggagcaatagaggaaagtgattatagatgtcctcaggtgcatgttctcctttttctccttctttctggttatgcagttcctgtccctgactttggataagaaaatgagaaaaatcaggaggtgaccatttaaaaatagccccattatttttattctgttcaagttttattttatttggtttaaatatattagagcaggacagatagctgaattatttatgcagatctatgtaaatttaatttctaccactgattaagattacatagagtaaagaactactggactattactacctaccttgcatgaaagactgtttctaagaaaagctcatagctgaaaagtttaacacttaaaggataaccagcattgcttatataaagaacttgccagaacttgtcaggattcttgctaatttttgagcttcatggctaagatgtatctcttgatgtccccgcataaacacttcataactccaaaaaacatgtttagaatgggcatgcttttctaagctcagtatt

SEQ ID NO: 52425 - DNA, 1053 bp, Homo sapiens
tccatttgaatcctggtagggttgcctgtagaaaaagttcagcagctattggtgtatatagactagactttggttcagagtggtgccagcccattcgcttcttctcctccatcagagggccacattttcttgggatgggagaaatttcccatttgttcaaatttctttggatttcttgggtgaaaggttcaatagcccacctctgattaagcttaatatccctttctttgtgcaacctgttttttgacttctaatgagtgaagattgtggatttggggtaggcggtagttgggtgcaataacttgctgcccttaatttttccaaacctcagagcttttggttaatcagaatagtagggacggctatgggtattgttctcatatgtcagtagtggagaagaaaattggaagaggaagttactgagaaagagggcgtttcttagcagtggagccagtatgtatttctttgtttgaaattctaaaaccagaaaagcagcaactacaggaggaaggaaggaaagaactgtgaaactttttcctgttcagatatctttaagagctgttcctgtctctatccatgtcccaggctctactttcatagaaaaagtcaattgtaatttgttcagttttcttctagaatgaaataattttaaatcttaaaccctctgagaatagttgtttaaaaatcagagcattttattgagtaaattatttacaatggattattctttttctcagcatattactaatttggtcttatatataaaatatatgtataacataataagaatataaaataaatatataatatataatatacattatataatatgatatacattatataatataatgatatacattatatattgtataaaatatatattatatattatataaaatatatataatatatattatataatatataatatatattatatattgtataaaatatatataatatatattatatattatataaaatatatataatatatattatatattgtataaaatatatataatatatattatatattgtataaaatat

SEQ ID NO: 52426 - DNA, 1058 bp, Homo sapiens
aggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggtgagcaacaagtccccttgggtagaccccgctgggaggcgcgggccccggccgggccgctcttcccgagccgtgcagggtctcgggggactgggtgccgggactcctactgcggactggcagaggccgggcgagcggtcagcgcggggtggcgtcttagtccaccccaccccctcagggagggagggagtgacccgaagtccccttcggaaacttggaggggtccacaagtctgagggactatgagtgtcccggcctgacctggttctgccatcagctcgctgtgtgatcttgagcaagtcactttcctctctaggccttagtttaccccctgtgtaaaacgagggtttcgtcggcagatgtatgtacaggagttgggtcccagctgttgtctgagatcttggacaagttcttccccaggctgagcctcagtttccatctctggaccatgaagtaattgaggtgctcgttgaggccccggcctgctaaattgaggaggacactgtgtgtgtgtgtgtgtgtgtgtgtgtgtacgtaccatgaagtaattgaggtgctcgttgaggccccggcctgctaaattgaggaggacactgtgtgtgtgtgtgtgtgtgtgtgtgtgtgtgtgtgtgtgtgtaccatgaagtaattgaggtgctcgttgaggccccggcctgctaaattgaggaggacactgtgtgtgtgtgtgtgtgtgtgtgtgtgtgtgtgtgtgcgcgcgtacaggatagtctgcagagtaaggaggagagttgtctaaaggggctgttccaaggaggacgtgggtgctacccagaccatgatggggtgagctggggtcctcttggttctccaggaatcctagagcctctgagagggaaagttttaatatggttgtccatagaaccggag

SEQ ID NO: 52427 - DNA, 1037 bp, Homo sapiens
agggctcacagtggcatcacggcccccctctgagcctctgcgtcctcgtttgagattctgtgtaggttctcaacccatctgtcacccccttttcacgtcctgactcctaggaccccagaaacagcctgggcacacccctagtgtcacttttcctcaggaaccctggtggttaacaatagctggggggtggtctgtgcccaagtctacattgatcagagagatgagggactgacctggcacccttaagacctttcctggaatgctaaggggatgggtgagggaagagtggaggggaggggagggaagtcattctcatatgataccaggcctgaaagggagaaatacaggaatggaaaccaaaagaaacaggtttgagttccggggctgtttcaaagtccctgaaggaccctgggtaagtcatgcaacttcagaaagactcagttttctcttctgcaaaaatgagggtaatacctgccatacagggttgccctagagaattaagtgaggtatctttgctaacatgttaatttgtcacatttctatctagctgtggcatttttttttttctttttgagactcgctctgtctcccaggctggagtgcagtggcatgatcttggctcactgcaacatccaccaaccaggttcaagcgattctcctgcctcccaagtagctgggattacaggcgcgcaccaccacgcccagctaatttttgtgtttttaatagaggcggggtttcttttttcttttttggagacagagttttgcccttgttgcccaggctagagtgcaatggcgcgatctcggctcaccgcaacctctgcctccgaggttgaagcgattctcttgcttcagcctctggagtagctgggattacaggcatgtgccaccatgcccggctaattttttgtatttttagtagagatggggtttcaccatgttggccaggctggtttcaaacacctgacctcaggtgatccgcctagaagcggggtttcacttggccagactggtcttcaactcctgacctcaagtaa

SEQ ID NO: 52428 - DNA, 1042 bp, Homo sapiens
cctgtaattccagcactttgggaggctgaggtgctgagtccaggagtcctagaccagcctgggcaacacagcaagaccccatttctattttttttttgagacaaagtctcactctgttgcccaggctggagtgtagtgctgcgatctcggctcactgcaacctctgcctcctgggtctacgccattctcctgcctcagcctcctgagtagctgggactacaggtgccggccaccatgcgcggctaattttttgtatttttagtagagacggggtttcaccgtgttagccaggatgatctcgatctcctgacctcgtgatctgcccgcctcggcctcccaaagtgctgggattacaggtgtgagccactgcgcctggccgaccccatctctattttctaaaattattaaataaaaacaattatgattttcattttatcgataaggaaattgaggctcagagaggtgaagtcacctgcccaaagtcacacagctaggaagtggtataatagtgattcaaatccaggtttgtctggctccaaagtctcgtatgacaattcaggccgggcacagtggctcatgcctgtaatcctagtactttgggagactgaggtgggaggatcgtttgagcccaggagtttgagaccaagctgggcaacatagggagacttcatctctaaaaaacaaaacaaaaaaaatcagccgggcatagtggcatgcacctgtagtcccagctatttggggggctgaggtggaaggactgcttgagcccaggagttcaaggctgcaatgagccatgattgcaccactgcaagccagcctgggtgacagattaaaatcctgtccaaaaaaaaaaaaaaaaaattaagttcagatgacaacttgtccagttcatggatgtctgtatcagcttgaacccaaaccatctgctccaactgctgcctcaggctcacttccctccatgctgggaagaccaagcattgtttaccgagcgacttttatatgccagacaatttacatatatttcccattaaatcctcacccc

SEQ ID NO: 52429 - DNA, 1011 bp, Homo sapiens
ctggctggctgactctgccagacaggagggagcgagccagccggtggagggagggaacaagggctgagccagcccccagccttcccagcccttccccaccctcgccggccaagggaaggaggcaggaagctggggttgggggccaggggactgcagtgtctgagaatgaggttccgatagctgggtctgtctgtgggagcatgcacacatatgtgtgtgcatggaagagcacgttggggtggtttgtgagtctgtgtttgcctcaatgtgcacaggtgatgatgctatgtgtgtgggtttgtgccgacatcgggggccactgtgtgtttgtgtaagcacaagggaaagctgtatgccctgagtttgaacgcaggcctgtgtacagagacgtgcgagatctagcagtgtgtgcacatggtagcagatgggcaccacgtcagtgccaataaatctttgtatgcacaaaagagtcggtacatgtgcctgagtttgtgtatgtcacatctgggtgtgttgggagcccctgtgattttatggtgtacaagaggataacagcataactgtgggtttgagcttgtctgtgtatgtgcaagggacagtgtgtgtgcagaagggaactctgcaggtggctgggattttgtgcatgtcttgtgcccaggaaggcacagtactggtggtgtgggctagtccaaatgtccagaggatgggtatgggcgcctctgtgcccaacagactttgtctgtgtggttgttgagagtgactcaggggaacactgtgtgactgtatatgcttggctgtgtgtacagggaacaggcagcacaggcattgtgtttctgtggttgcatttacacagggcggtggcggcggcggtggtggtgatggtgacggtgctgtgctacaggtttgcacttgtttctctatgtggcaaggccctgcgtgtgactgcgtttgtgcgtgtctgtgagcacggtgcgctggaaactgcgtgcttgggtctgtggcaggctgaat

SEQ ID NO: 52430 - DNA, 1043 bp, Homo sapiens
agaggggtggacatctgaccctcacaccttaggacggggagagactttctggtgtggctgtgtatgctgggtcttctggccctgtgtggatgagattgagagagggaggcccagggcatgtttctgggcttgaatgagtgtggctggctgtgtggcatgtgtgtaaaggtgtgcatgatttgggcctgtgaaaatgtggacggtggtggtggggagaggaggttttgaatggaggggggctgtgtacaaggtaggcactagcccagtgcgtcacacagatgcgcacatgcatgtacacgtgtccacacacacacagccagctgtgaggaggaggctggcttccagtcccagggccaggagaactctgctttgggtatgtgggggaggcacagctggggctggaaactctagagtgggagggagggagagaggaagggaggctgaggagccgcatccttgatctcttctgtttctgcagttccggacgccgtgctctgggtctctgtgtgcctctgagtctccctctctctaatgtccggatcttggcatctctgtgcctctcttctccgtcttgggctttgaggctgatcacgtgactggatctccacctctccagcctacttggctgtgtctccctccatgtctctgtctctgcctccatgtctgcctctgcctctgcctccgtgtccttccctgtccttgccaggtggggggaagggggcccagtgctcagggagcaggtgtcggctcactcaggcagcagggagtgaagccgaggagggcaaagagccagcagcccctggacacacagccacactccaggagacgtggggcactcacaggaacacacagtgatatgcatggagagaggggctcctgagggcacttacagggacatagacgtacaaaagtccacacacagccacacccgaaacactcagggatgccagacagatatccacgggccacacacagacacaaaggcgcacacacaggtactcattctggcacacacggacatccagagtcgccgacacacccag

SEQ ID NO: 52431 - DNA, 1023 bp, Homo sapiens
gggagagggaagtgatggtaggaaggcttggtgagaacaggggctccaggagatgggaacggaggggcagcaagagaatgggcgctcaggaaggggaggggtttcagcctagggcctgctgcttagtaaggggtgaggcaggctgtggtgtattttggagaccagactcgggagatggaccagggcctctgggatggaaggttctctgtgcccttagttaagggcagcaaagaccctgcacagtgtatggtgcaggtttggggcacaccctgttttgatccgttcttttcagaggtcagggccctaccaccgccccagtgccacacctgatcccagaatgcatcaaggcaatgtggctctcagatacgtgggtttcgccatcatttattaaacacttccctgaggcgtttattcttcagaacaatctttgaggtagagaaagatgctcacttggtttacagatgagaagacaggttcccagacacagagtaagggactggtccaaagctcacgtggaaagtggcagaagtaggctggcctaggctttaggcccttcctttatttttttccccctttttgtatttttcttctatttctgctttttagagatggtgtcttgccatgttccccaggctggtctcaaacccctgacctcaagcaattctccagcctttgcctcccaaagtgctgggattacaggtgcgagccaccacgcccagcctttttttctttgttaaatttttttcctgcctggtgcggtggctcacgcctgtaatcccagcactttgggaggccgaggcgggcagatcacctgaggtcaggagatcgagaccatcctggctaacatggtgaaaccccgtcactactaaaaacacaaaaaattagccgggcgtaggcgcaggcgcctgtagtcccagctactcaggaggctgaggcaggagaatggtgtgaacccgggaggcggagcttgcagtgagccaagagggcgccactgcactccagcctgagcaacagagcgaaact

SEQ ID NO: 52432 - DNA, 2879 bp, Homo sapiens
ttccactgcctggaaccccacctcctcacccagcacctgcttcaccctgtgttttggggcttggacacgcatattttacagatggggaaactgggctcagagaaggcaggtctgagtttttgtgagaaagaacagtggttagctttccccctcaccctgctgaatcctgggaggagctgggtgggggtctccctcttcacttccctgatctcagagcacagtcgatgcgtgccgctcactcctgcctcttctcttgtgtttctttgcagctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaacaaaaaaaaaaaaccaaccttgtgtcttgtgaaagggggagtgagggtggagggaatggaagggacaccgctgggttttgtcaccagctactggttctccagaggagttgaaatacctacacgtgttcctggccactgagttttcccttctgcctgagatctgggttccccctcatttcactccaggccctgcgtctcccctgcctctgagctccccactctgctgccgaggacatcctggcccttgatcatgcgttcagtcccaggtccagggattctgcctcttggacctccattttgtcctaggtcctgggtctcctctgactctccctatattctatcccaagtccaaggtctccccaaatgctgggtttcctctccctgaggaacctccatcatggggctcctgcttctggacccccttattccatccaaggtcccaggtctctgcctcgagtccctttgtgtgtcctgtgtattcatggcctttgggcctcacagttctactctggttcagggacatctctcttggcgacactcattccgtcctaagtcccggaaccctcatggggcctccctttcccactaggattggagtgccccccgtctatgtatctcccatttgccccaggtcatcagtcttctctgcttccaggcccctcattttaccccaacacccccacatctgcttatgcagaacctgggatatgacgaggccagtcaccccagtgttgctctgccctcccctttctgtctaccctgaactccaaatgtttcctccctgctttggtaaactttggaaaaagaaaactcctaaccctgtgcctgcgtctggtgggcctggaagagctgagctgtttcctgatccctgactttggggacctcttgggtgtccttgcccaaatgatgcccactttggcctccctggtctttgggaagcagtttttcccatagacccattttatgtttaagttctgctgagtgtggcttcacgtccctcctcagtgaagctcagggagatgccaagggatcgtgccacggggcctgccctccctgacccagccagctaggccctggcctcaggagagtcagaggagcccgtggtctgaggaggaaacacaccttctgggcacacctgtctggaagaggcaggaggactcaggtcacagtcccctgaaactgttgcctctgtgctagatgcaaaaagctcatccacccaccaagccccctccctacatcccccagactcagagatgaagacattaccccacgcttcctgactgctgacggggaagacaacactacactcaagctaacgatgcaatatgagctggaagtgggggcaagaagcagtgagaccccctgagagttagggaggagggcttctctgaggagaaagcttctacagagccaagcctaaggtgctgggcagaaaagtgagggagttcctggaggaggaagaggatgtgcaaaggcctagagatgcgaaagggtaacaggaggcaggagccacaagcagttagctctgttgggcacacgctgtgtttagggaggggagagggctttggcaaggtcactctgggtaaggtggaggctggttggagcgggtgggcagcatcagagaaagcagtggatgaggctcagataggccaaccgcagagaaacctgtgttcagcctcaagaatcacccgcagggagaaaatgcctgtgttcagcggctgctgaggaagaagaagagactcggggaggctgtccaggtggggcaggccgggcccagttggcttcaagggaatcagagtggggcctggtgagtccggctgagggctcagaggagtggcggcccagaggaggtttcggggaggggaggagacagtggtggattgctcagtggaagggactggggctcaacatgagataggtcttgagaaggggaggaagggcagtgaagggttgtg

SEQ ID NO: 52433 - DNA, 1006 bp, Homo sapiens
aaatcaaggcccagcttcccagcatggtattcaaggtattccaggcttccgtcctggcacccaacctttttttcagccccgatcttcctcacacacaccctcccttaacagccaggagcatgtgtggaaacaggagggagctctgggagggctggctcccaaaggtgccccgtgcttttgctgttcctggcctgggtggccctttcctaccccatctcccacctgtcagttcctatctttcactcagacatcacttcctccaagaagcattccagggtccttctcaggtccaattaatctctcaccctctctgcatccgtgacagcccttcctgggaatgccctccttgccacgccaccaactcctttagggcaattactcatctctgggcaccgtcctcccctcccccacccagtgtctcatcatgcctgggacatttcaggtttttttgtttttttttttttaacttgagttgaagaaaagcatgtagaatagggagaattctaagaggaaaggttaagccctggggaacgggatgggacaatttcaccctgtcatcaggaagtgctcctaatagaagggcagggacagggtgtgtaaataaaccagttcaaattctcagagctcactgggcctgtggacctctccaagcacaatccatccagtttacaaagagggaaaggtcctcgcctgaggactcagagccacctggtcattgaagcacagaaggtagagccaggaagggcccctggggattgcctggttccatggttcttgctctttcctcagcctccacttcagttgcatgtccgacacaaacccatcaggaatgcctgtctttacatatggcatctccagctggagggtggagagtgggggagagagagagagagagagatggaggaggtgaggctagcctcctcccaggacaggtaaggaatgtgaggctctgagaggtggtagagacacagggtcacacaaggctggggaaccccatttggtccta

SEQ ID NO: 52434 - DNA, 1800 bp, Homo sapiens
ttttagtagagatggggtttcaccacattggtcaggctgttctcgaactcctgaccttgtgaatcacctgcctcagcctcccaaagtgctgggattacaggtgtgagccaccgcacccgccccagtccccacaactcttgctgggtctgacatcttaaatggattttgaggttctgtggaagaagctgcactggagctcaaccttcaagaataggcaaggtttgcacacatggagaccgggggaagggcattctgggcagagggaactgtgggcaaaggcaggtcacatcccaatgtggattagaagataaaagctcagaggagacagaatggggaatgtggagcctgactgatctgagagctgtggctgatgggacggggaacagaacgggtcaagcaaggagggggccttggccctgtgcagacatcttctctgggcctctagatggaaagtagagccagacagactggctccacgttgggccctgtgggctaaagatcgaccctatcagaccctggggacaggggtgggagggtatgaagggccctccaaggtgttcaggattctcgagtccctctcccctccctactccctctcaggcctgacctgaggccaagagaaatgtcacaggtcctccaaggttacgcggctagggcctgactgaagcaggaagcagtttccaaggccaccatccagccggggtcagcaggcatgcccgggcctggaccaggccgcagctgctctgggctttgtctcttcgtgtcttgaaacctcgagaggtcacttgatcttgcctgtgactctgagcaagaggccttacgtcagggcccagccagtcctgccctgactcttctgggcacaagttcttccccacactctctgaggccatcctccctctgatcctatctcttgccactcctgcagccatgtttaggccaggccttgttctgagccctcatttcctgaaaatgtaatctctccacgaccataccgactcacccttcttctttcttatcttcccacgtcccagagcagggccacggaactggagggtggtggctgggagcctgcctgtggacacagataggcctctatgcacaacccagttccatcccttaccagctaggtgacctggtgagtcatgtcacctgatgagtcacgtcacctctctgcatctcttgtgagaattaaatgagattacacgtgaagcccttggccaggtccctggtacacagtgagcacgtagtcagcggctggtgatgggtaggtaaatacccgacagaggctgaactccggggcctctgaccagcctgtgtgagtcacacacctccaaccctcgcctcttgtaccttcatgcaggaccatagagccggccctccctcgcctgtgctcctcctaggaaggaggttgtattctagtgtggatttggggccttgggggaggctttgtgatagcacctagttctttgcgttagcaattgggccgagtcctccctggaggacccaaggacaaaatgacccggctcagctagaaatgctgtcatcacagttatgcacaccagtcctctcccccactgcaaatatgaaaaatattttcttgtgactgtaatatgtcatgatttttcccctggcagttgtgccatctttgtcagcataacctttgctgccatagtgcactgcgtttgtgctggaaggctgggggaagtagataaattctgtgttcacacacatgagctagtgacctgcttggggccaggcattgtatccagtgctgcaggtatcactgagcaagacacacag

SEQ ID NO: 52435 - DNA, 1522 bp, Homo sapiens
ttccattccccatgcgtctcattgcaaccagcagagcctcagatctgaagcaggccagggagaaactgcttagggtttaaaatgtcaaactcttgatccttctcactggcggggagatgtctcatggataatccagaaatgtgaaataatccaaaaaccgttcctcccaggctctgggtgggaaaatggacgggtgtgggggctgggtgtttgggcaggtcacagctcagtgaagtacataatggaaccacccagtgaggcctgaacgcaggaggaactgggatgccatccagccccacattctggccctgctccccactcagggctgtgagttaactgcgctgtcctcaaaccaatgcattccattgttctagagacatctgtccagcacccactagaagccaggcattgggggcaccacagtgaacaccacaaatgaggtactggtcctcagggggcttcccatttagagggaaagacagcaaacagtggcattaagcatgtgttgattccagctgtgggaagcactgtacaagagaaaaaagctagaagcttgtgagcgcacacagcatgctgaccggaccttgaagctgaggcctgaggaatgatggggctgaacagctggcggggagggggaagaacattctgggcagagggaacagcagtgtggaaagcctggaggcaggaagggactcagctttaagaaactgcctatgggaaggcagtaaagctaagtgaggggatgaggcaagcgaggccagatcatgcggggcattagaaggagtctgaatttcattcccagacacgtggggatccactgaagagttccctgctggaattccccaggccaccgtggagcagggctagtgttgaagcagggagaccagctgcagtagtccacacatgcagtgatgatggcccaggccaaggtggtgggacggctgccccctctctctatctaagatgacccacaggctctagggcaaccccccagtgccaggggatgatcaaaatcaccacgggaatgagaaagagttggagatacagagaaggagagtggcaaggaaaaagttcatagagggagttgccactctcaacagagggcttaagcagagaggacaaggacacgctcattcaccaatagcagtgagcagttttgacgccaggcactggagaagcagcagttgagcttagtttcccaacctgagcccctgtgtgtccatccagtgctgggtactggggagacaaagcaggcatgacccctgtcctccagttcagcctccaccccaggaaactaaaacaagtacacaaaaaacctgaaaacacctggcagagagtggcaggtgcccagaggcagtgagaaacaaagatttgctggacagctgggtgttgtggtcagaagtcagccctctgcccccttgatgagaaaagggacatttgtgctgggccctttatgtaacgctgcctcactgacccttcacagcagactatgaggtggggtgtgtctccccaccacaacccc

SEQ ID NO: 52436 - DNA, 1059 bp, Homo sapiens
tccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctgggtgagtctggggatgtgggcgcagtgggcagaggcctgggggtgggaagaggacatcagagcttaggcaaggacagaggtatggagtgcaggaagcaaatgcaggatttaagggcaaggctggggactgagagcagggtgtagggattcaggattcgctgttgcggacagtctcaggaggagatggggtgcttgggctgggaactcagcagggggcttgaacgttcgggggggtcttgtgaattgaaatggccagaggactacacactggatggggccctgtagtttggtttattaagctttcaattatttgttcatgctatgtcttgggcaggaagtgagtatttcccaggaaatacgctgataagggtgggcatttgtatcgccctgtgtgagacaggtgaagggagaagcaggttggacggtcgtctacccagggcctatccagaggaccagccctgctggcacccccatttccctgggagcttca

SEQ ID NO: 52437 - DNA, 2685 bp, Homo sapiens
ctgcttcactctagcctgggcgacagagtgagactctcttccaaaaaaaaaaaaaaaagtgaaactgggcccatgaggggctcactatacacatggtggtttgagaaaggctgggagtcagcaaggggatggggcttggggtggggaggggagcttggtaaggagatgagacctcaggagggaggggtccaggagctcatcaaggatatgggaagctgatgaggatgtaggtgttcagtaagggacctcctgctcttcctgcctggcaggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggcccgggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgg

SEQ ID NO: 52438 - DNA, 1314 bp, Homo sapiens
ggctagcctgaccctcagtaagggagggagggagggggcttctggtgggcatctccaagtgggtgccaggagccacggcccaaccacactgttggaaattggacttggaggttccagagtctgagccccttttctcgtttgtgagggtgtcacccactgtcctccctgtgagggcaacagtgctccaagttcttggactagagagatcctgacctgggaggggccaggtccacagccaggcctgggagagagcaaagtaggtgggaccagtaggtgggacaacgaggagcagctgagtcctggagcctgcagagagagaaggaacagtggatagagggatgttccacctgggtgggcaaccaaagggccccttcctgtgccattttgtgacctcggacaaagtctctttccctcttcaagtctcagtttcctcatctgtaaaatgggaggggcatgagatggcactagaaagtgtccccactggggtagctggttaaaaatacagattcccagatgtcccttcacatctatgagtcacattcccctggactagggcctgggtatctggaatgttacacagctcccccaggcccaggctttggaagccaatgggttagataattttaaggttcctcccagccttaaattagaccacggcgctagaaggagcattttcagaagtggctgaaggattgttacaggagctgggagtggaaggaggctttggacttaaggcagaattagaaatcctgcctcttagcagctatgtgacttcaggcaagttacacatacactctgagccagtttcccctgtaacatggggataataaatcatgcctcccaggctgctgtgaggattcagtgggtcacagatgtgtaggtgctttgtagattgcaaatcgctgtcccccaaaggggagtagagaagtgtctctttctactttatcctgtccccgagtcagctctgcagtcttcctgtggggtgacagcatgggtaggtggggagaatctacatgggtctgtggcacataggtcccagggatccagtactaggtcagagccaaacattaggcagtgaacaaggtcagtctttaagaccctcacagtgttggggtccattcagctccctgctccctgagatcccggctcctgggatcagccatggccctgagtcctcaggcttctttgggagtcagacatgcctggatctaaatcccagctctgccctgaccagctcagggagtcagtcggtaaatatttatgtagcattcatagcccaggccccagggtcaggtgatacagcgataaacaaga

SEQ ID NO: 52439 - DNA, 1031 bp, Homo sapiens
tgtggctccatttgtgctttggaggtgggttgggcaagccttgagctgagctgggctcagcagtgcccagccttgtggccaaattgctgaagtcacttcctttccagcagcaactttccaggaggaggagttcttcagacctgggcggggagcgggggggcgtggaacaaggagctctctggggaaggaggtgggcgggggtgagaggctgcagggaaggcctagtggggctggaggaggggagtcctccgggagacagaaggaaagacaaggacgggagtctggaagggccaagggcaggaggggaggggggcggagcagggcgggaagcttagtccctgggtgacctcggagggaggaagggagggccgccggcagggtgaccctcgggtccagccagagctggcggtggcgcccacacacctggcacccagggcagggggctggcagggggcggttctggggcagacctgcttgccaggtgccctgttccagggaggaagggggtgggcgagggttgcacaaaggagctctgtgtggctgggggtagggtggggtggggtgtgcactgctgtgctgtgctgtgggggggccctgatggccccagggggcggggcagggccagctccccttgggggcatcagtggctccaaggggacacctagtggcgagggagagtagtgcatctagttggatggctgttggtgggaggtggtgactagaagctgagaggaggatagattagaagtcaaaaattagaactgatggttgggactaggaccgttgtaggaggctgcaggggagggcgctgaatctctggacaccaaagaagtttgatttacagaagcccaacctaaattcagacaccagcttaattgaatgagatggctgtttgttcttaagggcataacttaacctctctgtgcctctatttaaatgatgccaaatgagtgacagctgccattattattgccatcattgttatttgtattatgatattgtgcctgggatcaggttgaaagaagatattc

SEQ ID NO: 52440 - DNA, 1575 bp, Homo sapiens
ccgtcgcaggctgttgtggggagtggcatgtgtgattctctcatgctgttgggaagttgtcagtaacttgggagctcgtgtctcactctaaagagacgacatgttttctggtgatacggggctggcagctggtggggccttcccatgcagaccacagagccccaaagggctggccagaggaaatgcttagggccctgagcagagggacaagtgggagctggggggtgctcagtcccgcatgatctaccctctcacccatatgtcagcccgtgggactgttccccagggggagggacccagcattcttcagatggtgtggagaagggcctttagggccagggcaggtgtgtgtctgtgaggtggggcaccaaggcagggtttgcatgggaggcagggggctgtgtccctgagggcctggggaccctatttcctgcctctcctgcccctgaaactgttaaactaattaaggctctggagccacaggattaatcggggcagctctgcgcgggccgggagctcaggtagtcagtcgatcagtgcaccggggaggatattggatttctgaaccgcaagtcagcactattcgggcctgttatctctcccaggctcgggggtcaggaggcgggaggcttggcgcactggccgcccccgccgagccagcttgggcgcgtccactccccctgcccacacatcccagctctggcctgtctactgcccacacaggcctcccctcggcccttctccccggcccaccctgcctctgcttcgctgcctctttctcaggctcctgcagaaacccctggtccctgctctctcctgcctttcccatctctgcctggctcgcttcccccgtgcctctctcccctctggggctcttccttggtccttactggcctcagactcactctgggcctgagctaccccctcccctcagcctctgacaaggtctcacccgcctctctctaccttcctctccatctcccttcttccatgagcccctcatcaccagtccgtctctgcttttgtgtttgtgcgtgcccgtcttccagtttctgtctttctctgtctctctgtctctgtttctctccccatgtctctgtgtctccctgtgtatctttctccctcttcctctctgtcttttcctctctccctctggcacgctctctctctctgtcttttcctctctctctcttgtgtggtctcggctggtgtctgcaaccagaacaaatctcccccagccaacaccccctgaacaaggaggccagagcagctaatgggaaacatgtgattctgccttgcgcctggagcaccgtgaagggagccttagtcccagcccagcccctgcacccctccttgctgtgttccccccaccacactgtcctctgcctcccagcagctcccccagcctgtgtgggcactgttggaagttcatttacactgggtgggggcctgacgtttatctgctggggagtatcaggttgtggaggggctaagggcagctttgctcctgaagttcccccccaacactcagggccaggcagaccccatgcagactcctcccacccaccaccacca

SEQ ID NO: 52441 - DNA, 1034 bp, Homo sapiens
gctaaactggcccaagaagctctctagagaacaggcctcactgattcttgggatttgtcccttcccttgctaaaatgatggcaagttcagactgtgcctcagtttccccagatggtatagggatactatccttgcttcatgtctgacttctttaaagtgctttgagttcctggaacaaactcaaagttatgaggaacaaggaaagactagagtgactcccgccccttgctcaccagcgccgggggacaccagacagaatgtttgtccagggcatgggtggaatcagggtcctgtctccttaagggttgggtggaggacagtgcctcgcctcccttcaagactggcagcccctgctgtctggcccgccctcccagtctgggcagtggcctctgtccttcctctctcgcccctcttcatggaatgagcttggagtcgtgggcaaacaggccctggggtaggggagtcaggcctcacctctgggtgtggtgaggcctggtcaggcagaccgttctaggatcctggggtctgggcactactcaccaaggggccaggcgggggagtaggggtgcctgggggaggcaggttgcacgcaaggcatgctgggccccctcggcgggtgggtggggggaacaaagctggcatcgaggcctcagctaaaattagccgcttccctgcgcgggagcgagcatgcctgccagccgcccagatcgccgctgcctcggcaggccatctgtcgccacgctttactcagtcccccagggccccccagctccagccacccccaggggctagggggactctgctctgaggctgtccgtggccaggactctaggctcttgtgctgtcgtgctgtgtgacctcaggctaggcctttccctctctgggctcctgtaaaacgaggggccctagacactgacatctcaggtcctctagtccttccaagcaccaggtgctgctgctggtcatgatggggtgggaggtggggtgcctccctccccttagagccactcctcttgtccaagctttgggccaag

SEQ ID NO: 52442 - DNA, 1032 bp, Homo sapiens
caacaggcccccctccctcgacagctctgctccttcttccccccaccctagcagccaactgccccagctgaaaccagagccgatgcatctgtgagcctcatgcccagacccacattccatttctgtcctctgtccccccccagttctggcaatgacatccctcctcctcctcctcctccacccccctccctcctcacctctgcctactgctgttccccccacactctaacacttagtagtgtcaccccctcttcccaccccatctgagtgtgtctcaccctccgactgtcgctgtggggctctgggtgtgtcagtccctctgtctgtctccagctcccgggtcgctggtgctctgtgcctccgcctgtctgtgcagactcctcaggttccttctccatctcttcccccctgtgcgtgtgtctttgtctctgcatcatcctgcctgtctctctcttttgtctttttctttctccttgtctctctctcttcctgagtctctttcttgctgttttccttcctctggcatggtcgccctctctctccctctctggctctcgccccctccctccagatctttttctccttctgcctctttctgccctgtttctcttgcctcagtgtccttcatctttctgtctctcttcctggatctgaatctctgccttgatttctcccgccccctgtctttcttctgactttgtccttctaaatacatatctttctttcagagctgggcctttcagttctccttactctatttcctaccaggttgtttccttcccaggcctatgaagattggggagctggtgcagggggcagggctccagagtcaccccaaaggatccctctttttagtaggggccagatgtcctggaagccccactgggcttatgtggttgaacctgaaatggagggtgcaaggttgaagagcctacagagagtgtggcaccaggaaacaagagtgtgagtctgcctttccagggttttaggggatgggctccatccatctagtctaccttccactagcccagg

SEQ ID NO: 52443 - DNA, 3012 bp, Homo sapiens
tgcgttggtatgtgagctcccccaggctggggggatgggagagtgggggggtctgtcaccttatagccactcatgtggtcagctcagacctgaccagtcacattcctgcccaggagggctggggcttgaggcagaggggcaggggcaggggcctggagggggctggtttgcaggaatggaaagggggagccaagaagctggggcaaggggctgctgggcagtattaagatacataaagcttgagtccatctcctcattcctctaggcctcaatctccctatctttcctcccagtttgcaccccctaaaaccttccagtggtgcacatgcctgtgacacaggtacagacctggtcccagttctaaacaaagagaagagtgtggccaaggcagtttctgacatgcagggcagctcagggacttgttggtagcctgcagtgtgactttctggtgcttaggggaggttggctaggtttttggctgggtcagaggatttgagatctagggtacggatcaagctgtgctagacagtagaaagagacctgggcggggacccaggaaacttggttctttgcccagccctgtgcctgactcctcatggcctcagtatccccatttgaagggtttaggccagtggtctctaaaagccctcctgtcctgttagtcagtagccctgggtgagggatgaggggtggggggcgatggtctggaggggtgtgggaagctgccagctcaagggggagtttgcaacgtgatcccagagcgaaaatagcccaggtcattttcagctgcttgggcggaggtatctgatcccggcagggcagcttgggcagggggcagggaggagcattctgtaaagctctctgggaaaccagaccctaggatgggagggtagggaaaggttggcatgcccagctgggcttcctgagacccgctgggggcccaggaatggaaagatgaggaatgcagagggttaacaggaggtgaaggctggactccagccccctttgggtcctggcctggctgaggtgaaaggtcagctccagggagtctaggcacagctggggaaagagtaacccgatccttctccctagccagactcagggcatcacagtgccgcctcccccaggaaaggtgctttgacatccccaggaaggagtttgtttctacttgttctcagcaggggttggggctaggggagggtccaggcctgtcgggtcagggagagagctacaggccaggcgccccaaccaatatggcagtgctttgtcatccgggggtcaggggaggtggaggtgagcctgctggaaaggttagaggtagcctgttctggccctgctgtcacgctgccccatttatgactcctgacggccagcatcagggctggggaagcttagaggtaggagatgttcttcccttctccaaacacactgagtagtgagagaacccgcctggtactagactgtgacagcgaggtatgtttggggtggagaattacacctcaactctgagatagatggctttgctgtctgcagttgtgtgtgtggtggggtgctagggtgtaaggtggtgtgatgggaggctgagatgatgcgacatggaagaacatggggttcaaatccttgcctgtcttaggcaggctattttacccaagcctcagttcccccatctacaaaataagactaatagtactcaccatgtagggtgatgatgaggattggcacagagtaagtgctcagtaaaaagtaaccttaacaagccttattggatgccaaggtcacacacagtgtggagccaggattgcagctggcagtctgactccagagcaggggttggtgagctatagaccatatgagggagaagacagtttccagaatgtgactgcgtcagtgtccccagggctgtgcactgggcgatggggggtagtatccagatgatttggggtgggatggggtgagggggctttgagtatgtggcaagtgggcgggggggttcagggcagggctcttcttacggccgatttctggggctttcgccagccccccgcgccccaccctggcaggctttgtgcgggtgtgtgggtgtagctgtccctggagtgcggctgtaggtatgtttgagaaggcgcaggcatcccgagaaagaacaagtcgccttttgtacgcgtccagccccaggctgggctgggcgctctctgggggatcccctgtttccgcgcccagctccccgcccacgaagagcgccccggcccggcccggcccgccgcaggctcccacctgaggggcgcagcgagcggagcgccccctcccgggcacccgcgccgcggccgggggaaagggtccggggaagagggcgtgtccgaagccccgaccccgcccctagcgacatcactccaggtgctaccaatctccgggagcccggcccgcgcggcccgccccctcgcgggcaccgctcctggtgttcgggacgcgccgtgggtggagtcggcgggaggtggaggaaaaggcagggccggcctaaggggcggggagaccgttgaaggcctcgcccttccaagtctgggagaggctgaacacgcgagcgacctgagaccgagctgctctgctcccgtgaagctcctcacaagacctctctcctggagtgctccaccttccagcccacctgccccaagatcttgccaagtaccactttctgcaggaagccttcctagaacctaccctgcgatcttttctgattacccgcaccctctaggaccctctgtagttaagggcagtaccagcactactgccagcgctagctgccatccactgagcagtttgctcagtgtacccccacactgctccatggaatggcttaccggctgcatttctgcgggctgtccaccttgtactatcgggcccttctcacccacagggttgggtgtgcctctggtcaggcgttacagacaccggcccgcctcagaatagccaccactgcatccagagtcacacagagcaaggaggtaggagcatcaa

SEQ ID NO: 52444 - DNA, 1031 bp, Homo sapiens
aggggggcggaggtggcagggatcagtgggcagcttagcctgccaggtagccccagaggcggcggcggcggcgggaaaactcggaggcgggctcttcgggccctgagaagtgctgggcctgcggactggagcttcttgctccagccagaggaatctgagggctgctaggagggaggcaaggcagtcttctcccagcatgcagcacccccgccccgcctcccaactgcggagccgatgtgggggcagatgtgctgggaaaatcctggataattttcccgacggcgacagtagctttctttgagagcatttctgcaccttgcaggccccagagtccagagaagggccccgggatgggaggggcttcattttacaagagccctgagaatccaggagtaggtatgtgacctctcagggctcactcttggcactatggcttggggaaggaaagaggtctaccctgccctttgttgggcaggggaagggacgctttcccacaactttgttcccttccagcaccatttggtgctctgtaaactgatgaaccttttggcaactcagcaggcatcttccccatctgatggtggacccttctccccctgccagtggcccttgttcagttctgtttcctgcccccacctagcatactctcaccatggtaaacaaaagcagtcgggataggcacgcttcacctatgccacagttgccactcgctggctgtgtgaccttgaacaagtccttttactcctgagtttccctttcctcacgtgaaaaactagataacactagataggccatggccttgtggtggggctcaaagttacacaacatttcaatcagttagcatagcatctgcacatagtaagggtgggaaatgaagggcacccgtgtgacatccagccccatcctgaggaatagaggtagcccccaaaacatttgaattcccttcccctgcaccaagcctgtgagatttcacttcccaaggtctctgtcacactagtctcctcacagtgctccttttgccttccactggg

SEQ ID NO: 52445 - DNA, 1052 bp, Homo sapiens
tttgtgacaggggcgctgtcaccagtgcaaggtagggtactggtctctgtgttcatgtcatgacggtgggtgctggcgttggggggtgtgggcaggcggtgagcactgggatgcactgtatatatgtgtgtgtgtgaggtgctagactcaggatggccagtgcctagacagggccagggtcacgggtcaccacatgcccaaaagcagcctccactgttgtaagggtgacactggtgtgatccccccatgtccctacgggtagatggaggtgggaatggccccagtggagctgttgagaacagcccctcatgcctggaactgggaccagagcagaaggggtccccagggactgcctgaaagggaggagggaagcagcaatgcttgtcctgcctgtgtcagggtgaacactgtgttcagtggttaacgggttctggaaccagagtttttctgactttaggctctgacattgtgtgacctttggtgggtcacttaaccttcgtgaacttcagctttctcattaacaaaaaggggataatattacctactttatggaggccttataattgagttagcgcatgctaataatgcagggcaggtgccctgtgttagcagtgaccattgggtagtcgctaggcacaaataggtggtcagtgaaaacgcattgttcagatgtccggacgctttccctgcagagggccttttcagaccccttcgttttaataaggaaaacggaggcccccaattgtgacagcgttttgcccaaggagaggcacacagcaaacaaaacctttatatggcacctaccctataaagccgggtagctcaaccccaatttacaggtaaggaaatcgaggcctgtgattggccgccggttcacggtggcgctatccagttaggcctcagtccgccgctgcggagggagcgccgggccgccagtgctctctgcaggaggggcgtgcaggtagcgggcgccctggagccactgcccgagccaggcacgctattaataaccccgccactcagccgcgtccgagagcgcaggtccggaccgc

SEQ ID NO: 52446 - DNA, 1433 bp, Homo sapiens
cactccagcctgtgcgacagtgtaagactccgtgtcaaaaaaaaaaaagagaagccacatatgtaatttaaaattttcaagtagccacattaaacaaagtaaaaagacataaaaggaagtaagtggaattaattttaacaatttatctttctttttttttttgagagggagtcttgctctgttgccctcactggagtgcagtggcacaatctcagctcactgcaacctccacctcccgagttgaagcgattctcctgcctcagccccccaagtagctgggattacaggtgcccaccaccacacccagctaatttttgtattttttgtagagatggggtgtcaccgtgttggccaggctggtctcgaactcctgacctcaggtgatccacccacctcggcctcccaaagtgtgggattacaggcatgagccactgtgcctggcccaacaatttatcttatataacccaatatatccaaagtactagcattttaatgtataagccttataaaaattattaatgaggtattttatatttaaaaaatacattaagacttcagaatctggtgtatattttgtacttacagcacattccagttctgactagccacactcacatgtggctagtggctaccatgttggacagcacagatttagaaacaggcttttctttgggaccagggtccagaggagttatgagccagaataatctggaacaagtagggttgtactcgccagaggttacacccttagcagacttgaactgggtgtagtctgactgcctgggagaacatctgggctgtgggctggggagtcaggggttccctcccctggagtcttaactccctggcctcaggtggaatctctgttggggctctggcctctcagggtattcagtatcacctctgagcactggcccccagttcctgtcccttatcccagtgtcacctcagtcttgtctggcctggcaggtcagggggaggggagcagggtggcagctggacccttgagagagcaggagctccacccctccgagccagctgctgccagccttcctggactgactctgtggaaacagggggcccagagacagaaataaactgccaggtttccggggcggagtggggggcctgccagtctttgtgcttccttgcttgggagtggggggagcaggaagcagctccaagccctgtcctaggctgttccccctgtatgccatctcccctcacccccagatgcccctgcccccatggctctgaggctaggctgagtctagaatttgatggattagtgaaacctaggggcccatagtctgggactgacacttgggagcagagagtggtccttaggactctggtcccagcttggtgcccatttctagaatcctgtcctgggggcccctctagctgccgcacggcaggagctgaacagattc

SEQ ID NO: 52447 - DNA, 1113 bp, Homo sapiens
taatcccagcattttgggaggctgaggtggacagatcacctgaggtcaggagctcgagatcagcctggccaacatggtgaaacctcgtctctactaaaaatacaaaaattagctgggcatggtggcatgcacctgtaatcctagctactcgggagtctgaggcaggagaatcgcttgaacccgggaggcggaggttgcaatgagctgagatggcaccactgcactccagcctggcgacagagcgagactccatctcaaaaaaaaaacccaagtttttggttggttaaaatgttgtgaggtttataaacctgtgaagtccatctatggaactaagctagatgatcaatagtaataaaaatagcagctagcattaaatgcttattatgtgccaggcactgggcagagcaatatacctcatgatcttgttaaagctatacaacaacctgtgaaatagttaccattttacagacgagaaaactgaggaggcctagagagatgaagtggcttgcccagtcagggttggaagttaagcctgggcttgtcagatccagaccctgagatcttaaccacaaaggttagccaaggattctaggattcaggaagaagaaatggcagggaaggggacaggtatgggagggttttcaaagaaagccgtggagatagcagagcaggagaaaagggaagaggggtagtggtgccagctcagctctgaggagagacgacgcatcaggtagttggaggtaaggggctggagatgcggatttcatttagagccccctggcctggcttccagagggcttggtatctgtcccacatgacccccagctaagtgacctgctctggagcctgctgggaaggggtggaggtggggccactctatctcttggcctcattatattttgcccccttgttctggaagggcttacccctaactctttgactcagcctccagtgctgtctctggaatctaccctccctcccacatcccaaggccatcaagaagggcccatgggccttgatctctctaggggagttaagaagtagagacaccctttccatcccagagaggagtcctggggcccatctgccgagatcagagtaggatttggaacc

SEQ ID NO: 52448 - DNA, 2469 bp, Homo sapiens
ttaaggatcagtggggttccagttcctgagctgagtgaccttaggcaagtcatacaacctctatgagcaaggttcgtcgtgcaaggatggggtagtacaggtgttgggcttgtagtagctgctcaataaataatagccattattgtcagttatcacttggacatggggggacatcagatgaagagatttactgagcatcttctgagggctgggtactgtgccagctgctggggcccagactcttttcttagtctacagaaagctcacctgataaccatatcacacagacagcagagagtgagtcttcaccttcacctccaccccagaagcttaaaggaaattgtcagggttctgggtggctcatggaggaactggtattgagctggctggtagaatttgggcagggagaagttggggaaggagcttccaagcaagctaggtgaacagcaaggccgagggcaggaactgaggttggttgaggtctaaccagttgctgcgtaggacagaagggaaagttgtggaacgggcctatggaggcgaggcctcagaggctaggctgggagagggcagcatggaactgagccgccctctgaaaatccagtgttgtagtgtgacatggaatgtaccccttagagagtcagcttcaggctctcctactaggtcactgggtgaccacaaacaaaatgccttgtcttccccggcctcagtttccccatctgtgcaatgagccgattagtcttgtgtaggagggaattctggcatcacgtcctaggggttggttggtctagccaactgggtcaggcatttttctggcttgggattctgggcctcagcagtactttcttccagagcatcctaagccaaaagtggaggaaagtgaggggtcctcagagatggattttggggcactccaaatgaggggccagggcctcagcacagaagaggggggtcttgccgagacctgactccaagccccagaggggacccagaagagaggaccagggtgcctcttttcttctgctctgacctgtgtggtggtagatgtggcccagtgtccaaccccccgacctagagggtgtcaggacccttcctgcccactgactggggagcagggcttggagtgccctggggataaggagccaggaggccaatctggggtggcagagccaggtgggtgcctatgggtagctgggctctgcctttgatatttggggttgccgggagttgtggtgtaaggcaggttttggtgacacacgcctccagcccaagctgccctggatcctggcttcaagggcccctttaagcatctcacctgtgaggtagggctaggagagaattaatttcctgtgctattttaattttgctgtatttaatctgctgtttattttaattaattaatgacgggtaatcgcctatcataacctactgccgctggctcctcttccttttcaaatgggtggaaggctgggccaggtgattgccgggttagctgtgggggagagggaggtccttggaggcctgtccctctccccttctgcctgtctcatcccaggggtcctctccaccaggggtcctctcctcccatctcacctgtggctcctcctttccctccctcttctcgcccaggtctgcttcagggccttggaagtagtgactgtggcaatgaggggcctgacctgaggcccctgcctgtctctcaagaaacagtattttgatgtcataggatggtagttggaaggatggggagcttgccttggatggcgcttaggcacccttggggaaacttttgaagttgggggtcagtttttaacagcagctcctttcccctctcccccaccccagtgcccagacagcatgcccatccacattgtcgggcctgtgggacaccagcatgtcttagtatctatggacatatccgggggtatgatttcagttattcattaatccctaggacagacctccagggggattaaccccttgtatagaggagatggctgaggctcagagaggctaagtaacttgcccagggtcacatagcaactaagcagcagggcctgaattctggccacagtctgattgcatggaaagagttaacagttggaggaaggggaggggaagtggcttgaggactagggtggggggattaggtcagaagactgattaggccgggaaatggggtcctctgcctctggaggatgtggggaggaggagggggtccctgccacaaggggcttctcgaaggtgtgcagtctctgctacctcttcccgtttccttgtgtgtcttcagttatctgtttggaacaggggctttgtcactagctctgtaccctaccacaggaacctttctagagctaggtggagctcaacttttatttatttaacaaacatgtatatagtgtttactatgttccagatactattccaactttataaacagatcttcacttaattattattgcagccctttta

SEQ ID NO: 52449 - DNA, 1490 bp, Homo sapiens
tgtctacaggggcctcctgcgttccggcccctccattttgcagatggagcaaccgagtccagaggggtgcaagggtggtcaaggccagccagctggggagccccctccttcctgccccattctgctgtcactcaggctcttctcagcctcagctcagctaagagcagggcctgggggggggagggcgggggatgtttgggaaagtggttgcggctgagaggttgccatggcgatgctgcaggatgccgagctgaagtgggggtcccacagggtctctggggcccccagctccgcacccctgtggtcttctcctccccatctcctgtcccccacccagatgtctgtcaggcggctccggtgacaggctgggtgggtgacaggtggtgcaggtgatgggctgggtgggtgacgagctgggtgggtgacaggtggtgcgggtgcgaggcaggcaggtgacaagctgggtggtgacgggctctgtggatgacaggcagggggtgtggttggcgaggatgctgtctcctggctggtggcctgttgcagccccctaccctcatgcgtgtgcacacacatagactctgggctcagagcttggggctaagatactaatgaggcttattacttgtggaggggcaggtgcctaggctcactaatgagaggcctttaacaaataggggagacagctagggggcttcgaggaattcggctggcccttctgggctgagaccctgggggtcctgacctggctcaaggatgaagctggatcgcctccagccaggtcggggatccctcttcccccttctccctggccactggatttatgttaatactaaccacaattatgatcgctaccattgttcaagcacttattatgtgtcaggcactgtgccaaggcctttgcatgcattttctcatttcaactcaacagtcctaggagagaggcactattaccccattttacagatggggaatctgaggctgagaaaaggcacaggacttcatataacaagttactggtgcagctagggcattaatccgggtctgtatgtccctagaacatgtgctcttaaccaccccaccagtaaaactcaggtcttggtgcagactccagatcctctctcagggactggaaaatgggcatgtggtggaggggtgatcaccataaactcttcagctctgacttgggtggctgtgaggactcctccaggtagctgctgtgaccttaccccatctgggccagattctggacagagggcagggcctaatgctaaggggggtgagccgaaaggtggtcacctgggatatctgagccactttctgcattgtgcagtgggaaggctgaggcccagagaggagcagtcaccacccaaggtcacacaccctgtgagctgcagggccccgtgggatcccaggtctcctggcctcttgaaagggcagggctgggtgtggtgccagagcggggaggctacctcctcctgggccccacccac

SEQ ID NO: 52450 - DNA, 1492 bp, Homo sapiens
ctaacacacacaaaccctgcagccccatcacctctctggggtccagggactcagttacagctcccaacaccttctaaatagacaactgccccacatacacactcacagctctaacacctctaaaacacaactgctccacctacaacacccagcccacacacttccacacacacactctacatacagataccccccgacatccagctacctcacatgcacatacccccaaacacacaaccaccacatgcttacccacaacctgcaacacctccctgacaccaggaacctggttacagccctcatacctgtgcatgcacggacgatagcctgtggcacatctctgatatcagagacccattcttcccttcccacgtatggagggacctcaggtctctaacgcctccccagacccttgcaggtacccaattaaaatcccaataacctttccagagacactccccagctcctccccaaaaccacagtgcatcctccaccaaccacaacacctttccaggcacatgttcacagccctagtacttaaccaaaacccacatttttatgaccccccaatacatccctaaacaccccaacacacacacaatcacacacacacacacacacagctatcacaccctcagcatatcaaccccctatccaaccccaacactgccagatacacccaggacccagctacagccctgctaccttcccactgactcataccctcaaagccctgacacctccccagacacacacactctgcccacagcccccaacgtttctcccagctatagctcagcacttccccaaacaccggtatcatcccctatacctttccaaacatacagcctccccctacaacacacatacactcactgcttcaaacacccactcaaacaagaacaccctctgtagccacaacatttgcctcaaacacacagacatggcttcggttctagtatatctctaacagatcaggccccgaagcttctaatacctcctgaaacttgtgcacactgcctcctggatcccggcacctcctcgacaggcagtcctaatggcccggccccaccgcttcccagacagtctcagctccggtacttttcctcagccacctaagggcccagggacacccctacacctctccaaacaccccgataccacacctgtacacaaagacagcctcagctagtcacaaccctgcacccattctgtgctccgcctgcaccccacggcaccctgtcacataccccgcctaatccttctgcagccctcactcccaccgttggcacattccagcacaccctctcccccaccttgttcccctagacagcctcagcctgtcacacacattgctcactcttgtgtgctctcgctctctctctctctgctgcccaggcctcccgctcttcccagagcctcctctgcctggggaggcatctccaccccttcaccgccccaggcctttcattcctggacagtgaggctggac

SEQ ID NO: 52451 - DNA, 1016 bp, Homo sapiens
cctgccacctgccccccacccccatactctaacccggctggcaaggtggggaggcagaaggtcctctcagtcggtgagagcccttctggaaagcttcagggcctgacctggacacagagaaatgcccagtggcttgggtagtggggagctgtctcaaaggtggtgaggcatatgtgtataaacatgtgcttgcatgtgcaggtagaagggatggcgagtgtcctcatggagtgtgagagagactgggtgtatgtgagatagggtacgggtgtgacagggagctccaaggtgtgtggagtgtgtgggtgtgtgtgtgagagtgacttgtcaggtatgtatgtgtggatgcacgtttatgtgataggtgtgtgtgtaagatgggtgtgtgtaactgtgggttttgcagggtggggtatgtgtgatgggggtacatatatgaaggtttaagggcatggggcaaactgcatgtgtgagcgtgcagtggcaggcatgcatgtgggaaggtgtatgagtgcgtgtgagtgtagggactatgcagatatgagggtgtagttcaggtgtgaggctgggagcctgttgcctggattggagcagtgttttccaaggcctgagtgctacctgaacaggaacatccagcacaagcacgtgggaaggggcccccggcctggaagttgggcactgacccacacagatgcacaaggacagacatacccgcccctgtcctccctcttcctctcttctggcgtcagtggtttttaaaggagcctccgtgaggactgtttgctgtgcagttcccccacccccagcctgtgtctcttcaaacgcagtgctgccctccaggcagctttgtggaggctcctgcctcgaccatctgaaggcagatgggtgggcttggatccgctgctgccccccagggagcgaggaggcagctctgctccttgggcctgggcacaggctgagacagatggactgcctgtctcaacacccccgcacaggcaccccataccataggggtt

SEQ ID NO: 52452 - DNA, 1026 bp, Homo sapiens
tcaatagttggagtaatccccagagactggtgaacttctggccccagagctcccactcttcaggggttgcaaagaccagtaagggcataagctttgggggaccagtggctaccagcccaaaccagtgagttgtccttcttcatctggctttggggcagatgcccaggtgggcaggcattgccccctccccaggaatcacccacaagcccaaggtgtagtctggcctttctagtctggtcagtgcctaactgtgcccaagccctcaggaacgttcccctggtgggcgctctcctccgcctgggctcccagcccacgtgccgatatttattttctgtagtaaaatccatttttaatgccgttacttttgaaataatatagagagaaacaaatgtgatgtgtttaagttgccctctgtgagtttttaatgtgatctatggctgaggtagtgatggaaggagctgttgggcttggagaaatttggtgtcataaagaaaaagagcttgctgtttattattgttgctgggctggggggtctggaacagggtcgtgggggcagggagcccctaccaccctcaggcgctgtgggacagcatagcttctcagtttcaatgcgtgagggttctggggttattttgcattgctccccagcccttgatggggcctttggggaaggggtttgggagctgggggactttgttacccccactgcatgggcttagatctgggctgggaggcttctggaaccccctgctgagctaagtggaggtgtacagtagggaagttggacttggattcaaaaggttaaaagatggggtctccacctgattgctgtggttgtgctggaggcttgaggggcagactgcccctggcagaagacatttgggtagggggagctgttctggactggcagagccccagagggacattgttgttctccaatcagcctggagcactgactttgaaccactcccacctctatgcttctgttccccattggacaggggcttcctccaggcaaacctgatc

SEQ ID NO: 52453 - DNA, 1018 bp, Homo sapiens
ttgctaaggaggaccctgggaacacaaacatgaataagacctgtccctgccctggaggaggagttcatagtcaagcagaggaggaaaattataataataataactcacttattaagtgtcttctgaatgtcagatgtatttacagccatcttttcaatttaatccagtactgagcctggttctgtgattagccccatttgtaggtgagaaaactgaggctcaggggttacatgatgtaccaagagcatgcagtgtatgtgacagagctaggatttgaacctagatcttacaccaaagctcatggtcttttcactagacttcattgcctctaggctttgggaagagagcctctgtggagtgtgtgtgtgtgcgtgtgtgtgtgtgtgtgtgtgtgtgtgtgatccttcctcctctagttattggtagaaagattccctggaaatcctcctatgctgggtgacctaaaggaaagaaagataaggcaatcaatgcagattgagaattccctgtgtcctgccctgtgctgggggttgctgaatgagagcagtaagatggagagaagccaaatggctgctcagaggggttgtcataggggtgggagccttagctccacagaaaaagtctcaggggccaaggcttcccaagggccacagtttctggctgaccaaactcacaagagcctgatgtataagccagaggccagtgattctgcctgccatgaaataagcagagaagagcacggctctggagctgtagtgcctggtgtgaatcctgcctccaccactcactagctgtgtggtttagtgcaagtttttcacctctcgaagcctcaatttcctcatctgtgaaatagtaatcaaatgatcaatacatgtgagctctctctgtcactaccatttgcaaattgttgactgtgtgccaggcatcctgctaagtgcatgcatgctgcgattttatcctcgcagatccctatgaggaggagtttgttgtatcttcatgttgctaatgaggaaactga

SEQ ID NO: 52454 - DNA, 1121 bp, Homo sapiens
tgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatgaaatacccttgaaccttcctttgggagcgggggtggtcaatagggggtgaacggacagatatggctacaggcagcagcaggggaagctggagagggccctaatgcctaccaagcacggggcatccaaggtgtggagttttagaacacccagagtcccactgctcatctgcacgtgagtttagaagacaagcagctgaagatacattaaaatgtccccttcgttgctgatatggccttcaatctgtgtataataggtttgctaattctttatctgagttcatcagatttgccattcatcacaggcgcaa

SEQ ID NO: 52455 - DNA, 1022 bp, Homo sapiens
aagaccttgtctctactaaaaatcaaacaaattagccaggggtactggcacgcacctgtatagtcccagttcttgggaggctgagaccagaggatcacttgagcccaggagatcaaggctgcagcaagctatgattgtgccactgcactccagcctgggcaacagagtgagatcttgtctcaaaacaaaacaaaaaaagcaaagcaataggaggcaaaaatatgcaaataagcatagcaatatcccaatgtagaaagccagccccagagatatagacatgagccaatgggaagagaagcactgaggggggacatactgtgaggcagactgaacggtacagtaggtggcccagttccgcctttatcccttacagggaggaccccaatctaggcccaagagggaaagccacgtgcctgtatgagcgtatgagcatgtgcatgcgcgtgtgtgcacagggtggtgcacctggcaggggtccttgagtgaggcatgccccattctgtagcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcaggtgagtccaaggggtcggaggcaggagctgcctggatcctgggagaaactgagggaagaagaagagatgcgaacttgcccttaggagcctccaggaggatgtggcagatacaaccccgctttcaagatcacatgggctgagggagtctgtacagccctcccatcagaaaccacagtctgcaggggagggtcaagaagctctactcccagtctgagaggggcaggatcctgtgacagatgcaagtgacaaagagaaacttcttgcccttttaggtgcca

SEQ ID NO: 52456 - DNA, 1068 bp, Homo sapiens
aagaactggtttttaggagatggtgactggggactgtgagggagctgagcatggcttgatagaaatcctgttagagagatgattataatgttcaaaatcatgtgtgtctgagtgtgttcgtctgttaacctggcaggcaccccatgtatatgtgcatgtgtatgtgtgtgtgctattgtgagcttgggcttgttagagcctgtattggcgtgtgatggggttggcacgcacactcatgcaaatatatgctgtgagtgttattgtgtgactgtgctggtgggtcaggtgagtatgagtgtgaaagagagctggtgtgggtggtttgccctatgtgacgggggttgtgtaagtgtgccaggggtgataggaaggaaagtgaaggcagaagtcatgctggggcagagcccaggccttctggcttcctgaagagggcaggagctgggcagctgctgacagaaacattggcagagacttcatcttccttgtccttctgtctcaccctcaggtctctgacccctcccaaggatcatgccgcagccccactgacccaggagtaggggcctaaggggtgagtggggtagactgagggctttcagggtcaggaaacagggtgggggtggccttcctgaaccccacaactcctcacagcctcctcctcctacaaggaccctgttgctaggtaacggatgggggagccagaatgaggcagcttgagaggctgaaggctggacccacgacaggaaatggccttgatccccctctgcagtgactctccaggtgcagacacacagcctcacacacactcacacacaaacatgcgcagatatatagacatacatgcagagatacacacatccagagacaggcacactgctcccacacagagataggtgcacattcatagacacacagacacagagacacccactcacacagacaggcacacacatactcacacagaaacacatgcacacaaacacggtcttacagacatatacacatgcagccaaacacatacacagagacttttatacactctcgtatacacacaaacctgcacacacagac

SEQ ID NO: 52457 - DNA, 1187 bp, Homo sapiens
caccaactatgtgctaggcacccagctcttatcttctctaagtcttgctttctctgtctataaaatgagataatagtacttacatggtcattgtgaagattaaatgagctcatgtatataaaacccttagcatatccttggctcattaaaaatattcaataaacatgttatttttttttttcaaaggagttgatttaatttcaggtgatacaaagtttagggtagaacaaggaccaaagagcagactctggcaagattctgagctggttttacttttaaattcacagttatggtaggaatgacttagtgaaaacaactaaagagatgatgagccactgtaagattttttttttttttttacaaaagtttattcttaaatgtacaacagctccaagataacactttattccagctatacggggcaaaagatgttatggcagggaatagagaagtttaaatacggatgaaataaagggtcaccatctcctcaggcacaaggaacagcttgcttttcgccagatttcttaattccacctgtggccaagggccccttccccgcggccttcgcttttagctcctcgagtttcttctgctcctctttttgtttctgcttgaaagccttgtcttcctcgtccatctccttggcctgcttcttgggctgtttcggtggcttcttcttgccaccttcgtggccggacatggcacctgccgccccttccgcagaccctgccaccagaaacctaaacatgttatttttcaattcaaccagcaaatactgagagatgccatctctgggccaggccctcaagagtccagtgggaaaggcagatctggaaacatatatttatgaataaagtgcaggccaagctcacacctgtaatcctaatacattgagaggccaaggtgggaggattgcttgaagccaggagttcaaggccagcctgggcagcacagcaagaccctgtctgtacaaaaaaattaaaaattagccgcatatggttgtgcacagctgtagtcttagctactcaggagactgaggcaggaagatcatctgaactcagaggtttgaggctgcagtgagctaggatcatgccattacgctccagcttgggcgacagagtaagaccttgtctcttaaaaaaaaaaagtccaaacaacagagtatttgggggacaaggtggggctgg

SEQ ID NO: 52458 - DNA, 1070 bp, Homo sapiens
gcctcaaacctctgagttcagatgatcttcctgcctcagtctcctgagtagctaagactacagctgtgcacaaccatatgcggctaatttttaatttttttgtacagacagggtcttgctgtgctgcccaggctggccttgaactcctggcttcaagcaatcctcccaccttggcctctcaatgtattaggattacaggtgtgagcttggcctgcactttattcataaatatatgtttccagatctgcctttcccactggactcttgagggcctggcccagagatggcatctctcagtatttgctggttgaattgaaaaataacatgtttaggtttctggtggcagggtctgcggaaggggcggcaggtgccatgtccggccacgaaggtggcaagaagaagccaccgaaacagcccaagaagcaggccaaggagatggacgaggaagacaaggctttcaagcagaaacaaaaagaggagcagaagaaactcgaggagctaaaagcgaaggccgcggggaaggggcccttggccacaggtggaattaagaaatctggcgaaaagcaagctgttccttgtgcctgaggagatggtgaccctttatttcatccgtatttaaacttctctattccctgccataacatcttttgccccgtatagctggaataaagtgttatcttggagctgttgtacatttaagaataaacttttgtaaaaaaaaaaaaaaaatcttacagtggctcatcatctctttagttgttttcactaagtcattcctaccataactgtgaatttaaaagtaaaaccagctcagaatcttgccagagtctgctctttggtccttgttctaccctaaactttgtatcacctgaaattaaatcaactcctttgaaaaaaaaaaataacatgtttattgaatatttttaatgagccaaggatatgctaagggttttatatacatgagctcatttaatcttcacaatgaccatgtaagtactattatctcattttatagacagagaaagcaagacttagagaagataagagctgggtgcctagcacatagttgg

SEQ ID NO: 52459 - DNA, 1030 bp, Homo sapiens
caccttgcccagcttcccctacactaattctaagaagtccagagctggatgcttttctttgtgatctctgcccatatcttcctgcaggcaggagaggagttgatcttgagaggtaaagacaggttgggattaaggcaatgttgccaaatttgtgaggatccacacttccttaacattcagaaagccagcccagtgcagattctggatcaggagagaatgagatgcatttgcatgtttttgtttcatttcaagccagtctaaatgcatacttttagtcctcactttcctctcccctcctcagtggtacttcctcttgtgagctgcttgggtcctaatatccagagtgtcccatctgtgttggtacagtgggctgcttctcaacaaagtgttgggaccaaccatttttctgttcctccaggcctgggcatcctgaagtgaaaccacctgacacacttcctgcgatctttgaaatcatctccatcctgaaaactcctcccattcacagttctccttcccagccagtagtggatataggagcagaccagcatataggcttaccaggactgattttgtttatttagagggatacaaaacattctttcccattgccttttttgttaacttgctttcagactctacaaggtttttagaactagtttcactgatttttaaacttcttgaattgaaccttctggaatgcttaatttaggtagtcagattacatggggggaggaaccataaagatcatctttctggccagctttactgttctctcataagctagtctggccattgtgaagaaagggatgtggcacaggttgtccatcacctctgccagggcatgtgaccctgcaaaaactacttcaaggaatgaactttttgaacaccctgctttataaaggcctaagccaagacctatggctttagattcatttctgttttgtgctcatttatgatccaggctgtgtttgaatgacctggaaaaagctcgttcgtatcttccagtttaaccaaccagtccttaatgttc

SEQ ID NO: 52460 - DNA, 1044 bp, Homo sapiens
tgccattgcactccagcctaggcaacaagagtgaaactctgtctcaaaaagaaaaaaagagaaaagagagagttagtgaggtcagtccctaacacaggatagaaaggatgggtgttgtcaactatttattggtatggggggaatcctctcacaagaagcaggaagggtagggcattaagaggtttggggacaacaaaaagttacttacattagctcattactctagttatgggtttaaatagactctattcagttgaagaaagacaggtccttagcaggtattgaaacagatgtgagactgcagctctaagggtgcttccagatctgaaactagtggagactgtaataggtcctttcagtactttctcctgcacaccttgttttatgattttgcatttatttttgttatgcagtaattccatccattcattagttatgagagcattgattcattcttcctctgacagtcttctcatatgcttcatgtaaactgagaggagggtaggaatattcttgtcgattatttatgtcttccagtcctagccatagaaatgtttgacttggtaactgtgaggtagtttgtccactggttaggcttgctatttggagtttcttcctgtgtagagaaatgttggctattagatgtggtttaggatataagaacagtgagtcgttactatatatagggagttgagaatgagtattccagtgtctgcttaggaaaaacaggtttgtgttttactttaaagattgtcctgggaaaagtaaagagcgttctttgagaactctctagagaacaggatttgaccctcttggcagtgattccttaacttgctttgagtctgaggcacttctgactggccattgaaagctatggatcctcactctaaaaaccacccattatatgtgtagacaagattgtacatataattttggggttttgcagatttcctgaaactatcccttcttttttttttttttttttttttttgagacggagtttcgctcttgttgcccaggctggagtgcaatggcgcaatcttg

SEQ ID NO: 52461 - DNA, 3299 bp, Homo sapiens
gatctactgaagtaatataatcatataatcagtttttctgcaacatagtaaaagttcagtaattggtagcaactattattctcaaatattcagaaatgttagttcaggactttgtgtaattttcaggaaagctttagagaaaaagagggtgtggaattccctggttttgatttagatacggatctgcaggagagccctggatttcattaatttgggtgaccatttagctctctgaaagcaatttttttttattgcacagaaatttcttctggttattctgccttgtttccctcagattacagagttgaaggctgattttcagtaccaggaatcgcagatgagagccaaaatgaaccagatggagaaaacccacaaagaagtcacagaacaactgcaggtgactgactctgcttattttatgtgctaaaattgtgtacctacctggtatacctagctgattgtattttaagtgatcatctcttagatttcttttttttctcaaagtattaacaaatcatgttaatcccccttttaggttttttttttttgttttttttttgagacaggttctctgtcgcctaggctggagggcagtggcacgatcatggcttactgcagcctcaacctcccaggctcaggtgatcctcccacctcacccttccaagtagcgaagaccacagccatataccaccataccccactaatttattttttaatttttttgtagagatgggctctcgctatattgcctgggctagtcttgaactcctggcttcaagcaatcctcccacctcaacctcacaaagtgctaggattacaggcgtgagccaccatgcccagcctgtagatactttgtattgtttcactcttggatgtgttctgatcttttcccctcaaaaacagtagaattattaagtatgttctttgatttttgaataaaccagatgtgattccagatgtctgaattatagattctgtttatccagctcatgaagtcacttcacagtttgtattgcataaagcatccctttgtaacagtgggtcccaagagattgaggtacactgattaacctctggcaaatacttttttctcctgaaccaagtttcaagccctagagcttcctgttgttttccacctctagaattgttcatctctttctgaccctccacattgtctgccttagcatctgcacttactctgcatgaaaaatagcttatatcctgtttgaaacatccttcttgcactgattttttttttctttaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgcttatatcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctcaaaaaaaaaaaaaaaaggaataatatttgaactacagagcatttttggggtcagcatgagctgctctagtaaggactcttgagtctgggaaaagtggtatcactataccttctccccactcctcacccacccgagcccatacactccctgcttttcatggatatgtattgaaaacaggtgcttctcagaagcactttgcctcaaccagagttatgtatgccctgcctatcttcccttcttaaccctgtaggaatatggatttacttttccaggaaaggggatagatttacatttctaggcatactctcaggtcctctatgtgatgtttgtgaaaggaattagggtgtgtcatgtgtgccatgaaacaacaaaaccaactaccctagaatcatttatgcagggggtactagagttagaaataataatgagggcagataacatttgtacctcagtctaccaaaaaattatagtactaaatttaacttctaggcgtttcctggaagcagatgctctataatttgtgatagcattctcataaatggagtcctacacataattggacaga

SEQ ID NO: 52462 - DNA, 1029 bp, Homo sapiens
tgcagtacagaaaaaccattaataattagtgtggtgtgttagcccatttgggctactataacaaaataccataaactgagtagtttataaacaacaactttatttccatgatctaatcaccctccaaaggaccccatctcctaatattatcacctcgggaattaggatttcaacatatgaattttgcagggacactaacattcagatcatagcatgtggtttcactgtcgtctcagaaagcctttgtagaaatggctggatagtagaggaaaccacaaatgaaaagagtactttttgtatttctactactttaagttccacttaatatactacatattctttcctcttcaattccccttcctccctactccttttgtatttttaacaggtaaggcttctttgttttggagggaagagccagaaactcaggtataaagagcaggtaggaagccaaggataaggctagaaaagagccagctttttaaagcaagagcatgggattagatgtttggaggttgttccctagggtaggtaggaagctacgcttttaatgcacatttcatctaactgtctgtgcctagattctagtcagtggactgtggcagtcaactcctggacaataagagagttcagtatgtttaaactacttgatttaggtgtgggcggcaattgttctttttatatttttatcagaactgctgatatgcttttcttctcttcccaaagagttaaaattcccgatctgtgctttcttcagcaggctattgaagcagattctttctgctcagtgaagataccttgaagtgggtttgcctgggtaatatttctggaattttgttgtgaacctgggcatctagggactcatttcttcaaatggcccttcattccctacgttatgagacactctgagaacaaagtggttctgtgtataaccctctcaagaagtgacaacatcctgaaacatatcttttctctcttaggcaacagttacaacactccacaaatcagctcgccaaggaaacaaatgaa

SEQ ID NO: 52463 - DNA, 1120 bp, Homo sapiens
actgcactccagtctaggtgacagagtgagatcccgtctcttaaaaaaaaaaaaaaaaaaaaggtagcaaaaataaaaatattataaggaccttctttataccctttacccagatttacctcttgttaacattctaccccatttgctttattatgtattctttctctctttctctatgtgtatctacataattttttatgaatcatttatgggtaagttaaatacttcatagcccccaaaaattcattgttttttctccaaagaaaaggctagtctcttaccaaggtagtaactcgatttcatggctggatagtttggatagtggtagtgaaaccaggacatgtaacatcagaaatctgttcaatttgcagtcttaaaacatctgagtgtgttaaaacatcctctgtccttccttttgcagatagcatagaagccaatgtggaaagctcagaggtgcacgtcgaaagagccactgaacagttacagcgagctgcttactatcaggtaaaagcgggtaccaaagaaagtcactctgtgttgcagactttttaggccatcagagtacattgacatattgagaacagctacagcctttgcttaggtttaagctaaaggaaagtagtcataattgcagtcccagttccatttttattattttcctttgcagatagatctacaaaaaataatcacaccttgaataaacttatcagaaggctagtaactgcaaagctaaccctatacactaatatgatacctaaatctgctatgaggctgttttatatcccgaacagctgaatgtatttcaattaggatagtaagaagtacagttaaagtagaagacttcatagattctttatgttgagtgttgccatagaggatggacatagaatcaacttcgactgctatttatatatgaataaataaggataatcattctggaactgttcctgtaaagtgaaatccttctacatgttagttgaaactctggtttttttacttatccaagtctttatctcagtgtacaaataatgtgaatgaagtctttctcacttcccttcaatttggtgttgcatggctttttagaaataaatagcatttcatgtccttcgcccactttttg

SEQ ID NO: 52464 - DNA, 1731 bp, Homo sapiens
aaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggca

SEQ ID NO: 52465 - DNA, 2442 bp, Homo sapiens
ctccaagccccgcatccctctgtggttgctgcatccctcgtgcggcacttgtctgtctgccacagagaatacgagggtaggttagcgccatccctgccctcagggagctcccagtctgtggcactagtaggcattagtaatggttggcatgaaccctttttatcccttcgaaagttcttgggaataatgaaataatttaatttggtctttgagtagggtacaagttgaataaatatgaattaccttacaaggaaacgcttctgaattaagagtttttttctgctgtagctcatcgcagtgtattgtttgttgcttgtctctgtctcccgttgtattgccatcctcaagggcaaagactgcatctttgtattcccagctcctaggcctgagtcaggcacatagtaggaattcagaaagtatgttttggatgtaacattcctcctttttcctggacaaaatggccttttgtccggtgcattgtcctttccatagaggaggggttggggcaggattgtgagatgactgtgttgaatcttcagttagctagacaaggatacgttttttcatgtgcaaatctaaaggttctagtgaggtggttcttttttctaacttcaaattagcaaacccaaaaagcaagcaaatgtgtggctattttctggatcgctttgcacttttgtagtagttgcttcagtctacaaattctgtatccattttgatccctcgctgtattgatttcaaatttgggccgagatagcaaacatagttagaaagcactgtttttgagatcacctaccctttccttaggatctggtaggtaccaggcaccgttaggtgctttgacatatgagtctcccttgaatggtatggctgtaggatatagaggaaacgtcccctaatcatgctgttgtagaaagacctgtttcaagggtaacatattcatttggtacctggtttcatggggcatgattttgaattgccctagttccctaattatgcacctctgatttggtttcagagctcaggacagtactctttgcttactctgtgatgagactaatcttgatgagccccaaacagcaactaatttattcggtctttatatgatattggagtaggggtggatttcagattcaaactccaggtgactagaccaccccagctatcgtacttgcactctctatgcagttctttctctgaggtgaagatccagtgttaaaatataggtttcttggtgctgctctaaatacagatctactaaaatctgttgcagagcaattgaatcactagggaagtaagtgtcaaacgtagaatggagctgtaataacagtgaagtggatgacatttctgcttgaacatgaactaattataggctggtaggagagctgcaatgttgaatgggacaatggttgtaaatagcatttataaacccatcctgaaaatgcttttttctatttttatttttcagggcaggtaagccccctcccggtttacatctggatgtagtcaaaggagacaaactaattgaggtatggaaatacatgtcttacttttttggctgccacactaaagatttttgccagtgactcacttttccaccccctctcctgtgctttgttttccagcaatgctactttctttcatcctgattttttttttctgttaaaagcacatggtgacatcacacatttaaagcttatgtctaccacagacactcaattttttgtgacttctctcaaatgaagggttttaataggtcatgggtcctgtgggccccagtcaaactggaagccctgttagcttggttaattccctctccctgagtacatggagttgtgtaaaccgtgcaaggtatgcagtaactgaagaaagtgaatgatatatattgagtttaacttctaagttaattttaagacattcaggcccaactccttataagaagtatggtaaactaagacatttactcaaaaagataatggaattgtggtgaaattcattaattgattctttcaaaacatgtattgagtgtttactatgtgccagttactgtgcttggcatacagattgcagcagtaagcaaaaccaacataatttctgtcctcaagtcatccagtgggagagacagaatcacaccaaaaaattacataattatatttgaattaagtactataaaagtttagcagaattccagcttttatacaagcctctagagagaacaccacataggagttcaagagaacatgagtttttattagctattagtttgcgtaaattttttataatccttacggtattatttatttaccaagagatggatattaagcccactatgaccatgtagctgtgagtctcccatattagaccaattttatatttgcttgctcagctagaatttaggttcaaggccccattattgaatgcagttttttcattgtggttttttgg

SEQ ID NO: 52466 - DNA, 1210 bp, Homo sapiens
tacttatcttttctctcccattttataacatgcagaatgccaacaggggaaaatattcagaatctatagtaggattttggcttgctttggcattgatattgcacctgtttcagccaagctctttcttgtcctggggaaaacctaagcataactgccaccaggccagcaatttctatattcttttgacttggagctggagagggaaaactacagtgatgtccagctcctgctttgggaggcgtggcttctgctgggttggagccattcttatttgacccagaatggagccaagcctgtatggcagcagagaacggtcagtggtatttgttatctgggggaacaacaggtctgaggatataagaaacccaccgaggagattcaaggctcagtgagggagtttccttctcactgtaacacatgatggatgtggtggacccagtgccattttcattttttaaaaagctggagtttctgaccatgatcctgactatggcatttttaaaataaattaaaaacagacaaaaaagcaaaactgatgtgctggggggaagctgacctgataagagagttggcgatcatactcttccttctaaaactcaggttgtttttgttttcccccttacgtttctgatttggttattcccagcacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgatgtaattccctgtttatgtcattgttttgtctttggggaccctggtttttggagtatacagctgttctatgtagctggaaatgccagtgacttagcagcagggggttctcttgagtccagtaatgggcctttggcaatctggtgtggccagctgtgacagctctcggagagccacattgtatggatttggttgtgtatcaccaggcctaacaaggaggctgagtcccagccactagtctccttgagctgttttgtgcaccttcactggctgttagaagctaagactggaagctacatttctctgtcccttgactgcttagagctaatgctgtccaatatggtag

SEQ ID NO: 52467 - DNA, 1053 bp, Homo sapiens
aggtggcccagaagaaagaggacttccattgcgttcccccatgtgccagatgctacatgacgtctgctctttaatcctcaagttaccctctgagtggtttcaattcccagtttatgtaggagagaaagtgtgccttgtcaaaggtcacacggggatccacagcagggccaaggtttggacccagagccacgcctgtgacctgtagaggcagaggtcttggcgccccaccacgctttacagagtgtgcggcacagctccctgatcagcaccaagattccaacgcacagaggggaaaagttgtggttccagggcgacagcagtgaccgggcccagagtccctccactgggagccaagacacgggctaaggtctgtcggttctggaaagtacccttttcagcactggcacaaggcctgtgtttcggatgtttcagtccagccattgtcagaaaatgacttcccacgctcacgccacagataaaagcccctgctggggctgagaccactcaggagtcatcttgtaatttccactgccacctgctgcctaccacacgtgattaaatacgagtcacccaagatcccaaaacaagagctggggatagtaaaggacttttgatctgtctcatcccctcccgttctcagcagaccacggtagttagaagctcaggctgtgtggtcagacccaattgcaagctctggccctgccacttgttggctgtgtgatctcaggtaaactatttgacctctctgtgcctctcaccttctcaactgtgaagcaggacaccggtgtgtaactcagaagcactgtgagaattggttgggacaaagcatatcaggggcctgccacagagtaagcaggtcacagaaagcagctgcagaggatatcacaggtctactggtgagaaaaaggacgctcggaggagtacccagcacaggcagagtaagtgaaccggaacgtaaacttagtctttctgaccccatgcctggctctctcccgctcatctgtgattctgtttggccccgtttagcaggtcctctctggccttggagcaggt

SEQ ID NO: 52468 - DNA, 1050 bp, Homo sapiens
tgaagccaagttcccacattaatccatgttaaccacatgtggttaaacccctgtttaccatatacagatctatcaggcttggtgctacagagatgaggaagacagtccaggcctcccgggggcttagagcttgggggtgagagtgggggtggcagacgttaacaaaatctcccatgcagtgtgatcagcattggcactgcgctgctgtcaccaaggttgatggcctcggattcccctctgcatccaccggtgggacagctggggttgcaggattgagaggaaccctgccagctgctctgcatcccaaggctctgaggctgagggagtcacgtgcgagatgttaggtccaaaccagcccgccctaagtagcaagaatctagaacctgaaggaagctggtgcagtgtccatcaaatcagtttccacaaagctactccccgtctgcagctcagtttctgtgagacttgcccgaggtcttttagaggcttaaaatggttggctggtgtcggattccctgagaagcagcagttaggaagcgtggttcctccagcacttagatggttttctgaaattgctcaagtatttcttcataatcatgttcatcatcatctgcaaaagagtccgagtcaatgaggatctttagcgttaggcaagttccttcccttctgtagggcagtttcctcatctgtgcagggaaagaggtggcctggatgccctacggtctttgctagcctagaaaccacgatttgttctgtctcaacactttgcaaccctttcattttcctgtatgctgcagggagggtagtatgttggggactgaactcattttccttgccaaagccctagagcccatgggaaagacagtaggaacctttctacctgagcccaccccatagaggcctgtccatcaaactgggaccatagaagggtctgtccctggacagggccaccagaggcaaaggaagcagcaaggtagggaggggagacacaaggacaagggtgagcagcgcccacagggactcacctagatcctgcctttggggcttagcggg

SEQ ID NO: 52469 - DNA, 1227 bp, Homo sapiens
gttactgtccccattgtggacatgagtgtattaggctatctgtaccttattaaacaatcagtccttccaacacccttgtcctgattccatcttagacaagcagcctcctgattccagtgtagtaaaccaatcaaacaaactgacttatggtgcttgtgatagttatttgttactataaatcaattgacctgccaggcctagatagataagaaatgctcagggctgattccatttcctgtcctgtaaaattaggataataattcctatctcagagttgcgtgctgatgaggtagagaactgctgttacttaggtgctctgtagattgtggctattaaatacgttactgacactaaccctgaggaccttgaagggtttgaaggtttcagagtgtttcctttgcttcccacaactttacttccctgagagggaccaacggggtttcagtgtgtggctggaaaagggggacttttaaagacagtggtttctactaggagattttgtgtgcaagtgtgactacagctttagatccttgttttcctgcttagactgtatttaagtgaggccctgttgtctttcctttgcacaatttgggagagggatccaagacagccctaatagccattgtctccatgaataagctctgttttgctattttactggcatttctccctgtgagagctttctatgtgcagaatacttgtgaattcttagctaaggtagaaagttgggagataagcgaagtttgcatatttggccatatccaaaaggcagtttccttctgaattggcctgaaaatgaccttttttttttcttctttctttctaggcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgct

SEQ ID NO: 52470 - DNA, 1426 bp, Homo sapiens
tcccgcacgaccgtgggtgggaaacaccgaagccaaaactccgctacagccctttagatgaaggcgtcgtctgattggtgatagtttggcgcgaacctgagcacgccgaacaaaggaagtgacggcagaagtcgcgcacttgacgagggtgggatcacacggcgctgcgtcgcggtagtattgttctgattggttgatttcttgcgataccgctctgccagccccttgcttccgctagtgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtaatgatgggggtgcggggtggaggaggaagagaatcgcaggaggttttagcaagagggcgagcctagggtccgagaggcgtgtggtagcgggagaggaagggcgggagcggagctggggcgtttgggggtcacccgcaggaaggcggcgaggaaggttagggagactcgggcagtgtttgaaggggcgaagcctccgggagcctgcgggtttctcggaggcgtgggacgtggcacaggcactaatcctgttgttcaaaacaggtggattcgaaagctatggcagctcctcatacgggggagccggcggctacacgcagtccccggggggctttggatcgcccgcaccttctcaagccgaaaagaaatcagtaggttgaaaggagtatttagttttgttttatcctgtcctgaagtccctgagtcatctatgacagaaactttatgctttgaaggaagatttcaacgtgaactgatgcgataatgatctattattatctgcatctcttataattaagtgctgtaagtttcagaaatgaaatcttgccaaattttccacctcctgtttccctggcttttcccgtcgttggccttattttgaaattgatcagtgtagctaatgaatcagtcttgtgtgaacgccctcaacttggtttttaaatttatttttattttttaaaatagagatggggtctcactatgttgcccaggctggtctccgactcctgagctcaagcgatcctcccacctcggcctctcaaagtgctggggtaacaggtgtgagccactgctcctggcctgaacttatattaatagtctcttttacattcttttttttttttttttgagatggaacctcactctgttgcccaggctggag

SEQ ID NO: 52471 - DNA, 1102 bp, Homo sapiens
tgccttaacctcccaaagtgctgagattacaggtgtgagccactgtgccaccatgcctggcaggaatatattagtgatcacaatatgtgtggaaaggttaaattttccccattataaacaaaggctcagtttggataaaaaataaaaatgtgggaatatgctgtcaacaaaaagacccatctaaaatagaaaggcactggtttttaacccctttcacaatcacatcttcctgggagggattggagcccagagatccccatcatttaccatgtgatcttaggcatgttgacctccagaccttagtttccttatctgtaaagtgggataatgttcccagggctctgcggagaacactgtaacaatgcatgtgggagggataatgatttgcttaatcagccatttacactttagtatgaatgtgtttcacatcctttcctgagactgtttagatcaggagaggtggggaaaagctcaagagcatctgggagggaaagtcaaggagtgagggtcaggggccagcctttatctgcaggctgtccactgaatgtcctgtggcctgggtggggccctggctatccaaccctgagatcaaaagaagtccagtctcccaggcccagacacagcttcttggggccagtgatgttgacttgtggctctaggtgacacaagaaatgggggaggaagtgattgcaatagcagagggtgaggaaatcctgggcgtcattcttgttttatcgagaaacaggatgaacagaggccagatctgctcaaccctccttcagtaagcagtcattgaaacaacttgtgctggccaggtgcggtggctcacgcctgtaatgccagcactttgggaagctgaggcgggcggatcacctgaggtcaaggagtttgagaccagcctggctaacatggcgaaaccccatttctactaaaaatacaaatacaaaaaaaaaaaaattagctgggcgtggtggcgcatgactgtaatcccagctgcttgggaggctgaggccagagaatcacttgaacccaggaggcagaggttgcagtgagccgagattgcaccattgcactccagcttgggcacagagcgaaactctgt

SEQ ID NO: 52472 - DNA, 1101 bp, Homo sapiens
accaccatagccagctaattttagtatttttggtagagatggcatttcactatgttggccaggctggtctcaaagtcctgacctcaagtgatccgcacgccttggcctcccaaagtgctgggattacaggcgtgagccactgcgcctggcctgttttcaatttttgtagagatggggttcttgctgtgttgcctaggctggtcttgaactcctgggctcaagtaattctctctcttagcctcccaaagtgtagggattacaggcatgagccaccatgcctggcctattgactatgatttaacacaaatgtaaattataagattttgtagtttctactacacttgcatgtttattgaatttcctaatatccaagatgccattgactgaaagatgcatcattatgtataactaagaaaaaacagctaccaattataatctgacacagcgctttctcatggccacacctcacttttagagatggtactatgagaacaaattggaagagatgaaatgaaggtattatctagctgagaattctaaaaacacaagtcaagcagaacactcccatcttatagataactaaactgaagtacagagaggtcgagtaagtggcctaagaagaggaagggactgaaactcgagattcagggttccacatcatgtgttcttcctgctgtgttcaactttacccaccagagtcagctgtgaacactggtcctcacctcatcagcacagccaagtggttgacaacacaggcacgcaaggcaaacaaatccagggccctgggccaggtgcagtgatcatatgcctgtaaacccagcactttgagaagctaaggctggaggatcgcttgaggtcaggagtttgagactggcctgggcaacatagcaagaccctgcttctacaaaaaataaaaaaaaattagctgtgtgtggtgctgtgtatctatactcttagctacttgggaggctgagacaggaggatcacttgaccccaggaatttgaggttacaatgagctatgatcgtgccactgcactgcagcctgggaggcaaaggaagaccctgtcatgcagggcccaattctagctctggtatggttt

SEQ ID NO: 52473 - DNA, 1055 bp, Homo sapiens
atacttgctgactgcatggatgagtgaaactcctaaggcctcccagagtgacgcagaccctttccctaacagtaagatgatctggaatcaacaggaattgggaacactaaattaccaagtggctgatgacgatcggactcatttagacctagttttccccttctcatcatctgctgctttccttctaactaggaaactttctgctgggaatgggtttagggactgtgatgaaagaacccactgctcttccctccaaagtctaagcaaagttcagtcagattctatcaaatgtgggtttcctatctgtgtcttttcctcatctgtgctatcgctcttccccttgagctctgatggccagtggccaacagaaaatgattaactcccccgagtgcttttgcatatatattttgatatttcaccctttcttcctagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtaccaacaccacctgctcctatcaagagcacttactgtatgccagggtctgatcttcgtcttcacaacaacctcttagaataagtactgattttatccccaatttacagataaggaagccagggtcatacagcttagaaaaggcagtcttgggagcagactccagaattaactccaaagcccttcctctaaaccccacgacactgatgatgctcctaagttcatatttattgagcctttactgtgtgcgaggcactgccctctcagcctggtcctagacacttcacaacaacccttggaaggagtggtttcatttccagcaggtttgaaccttgccaccactgacaccatgggctggataactctgtcgcagacaactgccacgtgtgttgcagaatgttgcaaacactcactagagtgataccctcaggaacacccccagctgtgacaaccaaaaatgtctcagacattgcccagtg

SEQ ID NO: 52474 - DNA, 1098 bp, Homo sapiens
catagcagggcagttcttcgggcaccaccacaccgacagctttcggatgctctatgatgatgcaggtattcaacctggagggcaactgccagctccctccctccttctctccccagacccgctcagtcctgctgtctctctcctgacaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcttcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagtactcaaggcttcccacagtctgacttcaagcccattgtccacattttccgtacacagacgaggctccagcccctaattctttgggcagtccctcacctcgtaggatgagcttgtggttgttgagatgaaaaatattattcctttatttatccaacaaaatgcattaagtgtgtgccattggccaggccctgttctaatctcagaagatatgtaaatttaaaaacaaagtcacccctctcctggacctgacatcttacaggagagggacaataaatatgtagaattaattatagtactgagagaagggctaaggagaaaatcaaaacagtgaggcgacagggtgacagctatgggaggtgtgtactgtgttagataggtgggaaggggaagtgtccacataaggtgccatttgagttct

SEQ ID NO: 52475 - DNA, 1002 bp, Homo sapiens
atgcatacgggcagctcctcttaccccgtctgcagtggcctgaagcaggttcataaatgtacctggaacccgctggactgatgaaccctgcagagtctagccgtgaacatgcacctgggtcctaggagtctacagttcataatctctctcatgcttagtgttgctctttttatgttgcttttatctattcattatgtaaatatttactgagcgtcttctatgtgtaccctagcatggtgggacctggggtaaacctggggtccaatcctgctaccactgaatacctgtatgaatacctgtatgaccctggccaagtgaattaacctctttaggcctcagtttcctcatttgtgaaacctaggtaataagcgcagttacctcattcgattcagaggatgtctgccaagcacaatgggtgcacagctaagtgctcaataactactagtggtcatggtcactgctctaaagaacttgggggcaaatgcaaggtgcaggatggggatggaagcagacaactgctcacagccggtctaccccaaaccctttttccaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccg

SEQ ID NO: 52476 - DNA, 1042 bp, Homo sapiens
gcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgagtgcttcgccccgggaggggaggagtgtcggagcccagcacctccgtcagctgggtcacctgtacaggtgacacgccatatgccgggaaggggactgggagagggaaccaagtcctgtgggcgcctggcctacaggtgagcgtgcagccctttacggaaagggaatcccggtagactgccttcattctagccctagctttcctggcacaggcgaagaaactgaggcccagggaagaaagggaggcgcatgggctttgaagtcggacctctcagggatccacttctggctttgccccctctcgcctcacttctgcatttctctgagcctcagtttcctcctgcgtagaaaggaggtagtcaccctgagacaggtgtgacgggcaggcctgttgtgaagagtgagcgaaagaatgagaaagtgcctcgcacagtgcctggcctgtaatggcaggggctgcggactcagt

SEQ ID NO: 52477 - DNA, 1026 bp, Homo sapiens
gctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggctacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaa

SEQ ID NO: 52478 - DNA, 1067 bp, Homo sapiens
tggaagagatcagggacataaaatctacctctcaaaatcagtcaaggtccacgaacagagagagggctggcttaggtggggtttctcaacctcgtgtttgaagtttcaggagctggtgagccagcgtggggtagacagctcagctggagatcagaatccagatctgggctgacttagtgcatcctcttcaacaccagctctgctgctgggcccagcaggagtggccacagacacatttagggccaagaagtgaatatagttgcctggtgaagaaaggtctttttgctgggagctctgagaggttaagtgatgaggtgcctcaggggatgtggatgtggtgggtgatggtgctggggaagtggaaccttttgctgttctaggaggtccatggtttggagaaacgggacagaaaagtcaattgagatagagaagaaaatgttctagtcactgctgtgatgggatccaggatagtctcagctctgttactattctggtggagacacaaaaaccaggataagtaaaacatttagtatatcagatagtgttaagaagtgctaaaagaaaaagggaaagggatagggagagagagtaagtatttgtgtgttgggggtgggaattacaactttgtatagaatggctggggaaggccttcctgcaaaaccggtaagctggttagcagtgacttgggtgtggcctataaatgtcacgagaaggagcagaacctggagtcactggtagcttgaaccactgtggtggaaggaatgatgcaaacagaattccaccggatgaataagcacttgtaaccactctgttggcctggaactaaagatgacccagagatgaagggtgggggcagggagaggatctgagatgatgctggtgacttttacatacaagcaatggttagaggcagaaaggatcctgcagatcatcctgtctagtgattttcaggcttttgaatatcatgtacctataaaatggccaacatggttgcaacttaattttaacaaaaaagggcattaaaaactaccaccatttggctgggcatggtggcccacgcctgtaat

SEQ ID NO: 52479 - DNA, 2243 bp, Homo sapiens
tttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctatagtttgctcctgtgtcttttctgaataggatcagcacagttgcccagctgtgtggggtcctaattatggcttcataaaaattctaagagttcattagaaagatgtcaccctttcagtaactgggtcatttcaccaaaaaagtaagaacaaaccatttggtataaatatacatgggaaaatattttaaaataatttgtatgggagaatgtattgtttctaaaatatattgcttttaaagtttagaactggagtgagaaaagatttcattcacttccaaatatgctgaaatttattaaggagagaaatcagtaccttgctgcactgcacttaaaccacaaaagcgataaaactgacaaactgataccaaacctcatttgatttgccctgatttcctgtcacatcaactactttttctcatttcatttctctgatttgggt

SEQ ID NO: 52480 - DNA, 1111 bp, Homo sapiens
catggtggctcatgcctgtaatcccagcactttgggaggccaaggtgagcagatcacctgaggtcaggagtttgagaacagcctggtcaacatggtgaaaccccatctctactaaaaatacaaaaattagccaggcgtggtggtgggcgcctgtaatctcagctaatcaggaggctgaggtaggagaatcgcttgaacctgggaggcggaggttgcagtgagccgagatcatgccactgtactccagcctgggtgacagagcgagactccatctcaacaacaacaacaaaaaaaaaaaaaaaaaaaaaaagagaacccaccatgcccagctagggaaggactcatcatttggctaatttcatgaggactctaatgaagagggtctcccccttgatgaatggacccacagtgtcctttggtcctcagcttctaacagctcttaatcctacccacttattttcctttccagatttttgtgttggggtggagaaaaaggcagggtaattacagagagcactgtgttccctggacaattcattttggcaaacagccaagaagctcctgttttctctcttccatttaaatgagggtggcaacaaccaggaatgagcaaagactgctctgctcagcctccttacctctcttggccaagttcaagttccttttggaaagagctaagctaggaagtcagagtaagaggaaaaaggccaatgataaaagtgagttcaagttacattctaaaataaagagctcccaaaagggtggagagggaagtatctgtgtgtgtgtgcttgcgtgcatggtgggggtaccactccgcagcctcacaaacctgaagcgcagcacaacagccgtggcctttgtccaggacaaaaacccaacagctatactgcatagggggagggtttgaggcctcagagtaaaacctagagcttcctaagatcaaccatcaaacaaggcagagcagcatctaggcaactatgctgaatacagaccaagggaaggcctacctcacactacatctccctcctcccaaccccacaggaaacaaggccaaagaggcagctaagtaaaggagcactgacttcagctactcagcaaaaacttactc

SEQ ID NO: 52481 - DNA, 1930 bp, Homo sapiens
tctctctctctctctctctctgtctttatccatggaatgctggcgagaacacaatcagaaccaacagctgcaatttttgctaagagtgagctgcagccccgtgttcatctccatacagaagcagggacagttggatagagagaacaatggactcactgcagctacagtgcttttaatttttctgtgttttgtttttgtttttttgttttcaaaaaatgaaaaagaaaaggaaattcctggggcagagttgcactcttagtccatgaccagattgagaattactgataacttgtggtgatcagataaatgcagcagacttttatgataacatctcttgcagtcttagagtctccttagcttagaatctcacttatttccagcgaatgtgtatgttatttttataggtaagggtctgatctttgacgcaggtttcccccactttctttttctagcaagaaggggtgtttaaagtcttgaaaatagtaattgaaatatctaaaatacctccctgtggcagtagcacctctatagctgctccagtggtctgctctctaggatgatacctttcctgttcttctatctcctagctggtgaactgtggggcactggacactgagtaacttaaactttggcatttcccatctagaagccttagtcttctttccagtcccttttccctttagtcaaatggcacaaccctaaaaactccttcagcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctgagtagctgaagtcagtgctcctttacttagctgcctctttggccttgtttcctgtggggttgg

SEQ ID NO: 52482 - DNA, 1034 bp, Homo sapiens
ttattattagttgaatggtttaatgtttgaactgaattgaggcataagacctggactacagtcctccactgaatcatttgtgagattaatatgaatttactcagcaaacattgattgaatccctcatatgaatgtaaggcatgacaattctattgtaaaatattagcactaaaagagacccaagtgcacctaagccaagccttgtattgtaagtggccagctgagcccagagtgatctagtgtctggtccagttgactagtccgtctgttttgaagtgccactgggttaaggatgtcaaagatttgcagttacatatctgcacaacttctgtgccaagtaggacttctgcgtatggaagtataagttctggccaattatgttacagttatcttagatttgtatatttatatattacagtgattttccagcagatggcagtcaaatgtcttgaggaagaggcagctttatcttatttacacaggaaccctggtgctaagtcactctgttgggcaaggggaaagaacaagaaggttaatagagcaggatgaagaagaaagccaaagttaggaccttgtttaactgaagaaggtggcagaagcagggagataaaaagagcaagggatataacttctttttatttatacaaataaagtatctttcccacagcagtatgatctgtgtatgttttaggtgttggttgcagatgggatttgagttttgatacactgccatgtttctcaaaactgtctgcagttctgagaaatggatttaaatcacccatttcccaaggtcaatttcagtgatgcagtatcttggttacaactacaaggtatagtaagtaaggaggttccagatatgacaaatgttgatgccatatttattggtcactgttctcagttctattctggggctgttctctcactgaaagacgtaaggcctatacccaggactgtttctgggaaatgaagaattggagggaaatggctttttgtttgttattgtttctaacaagaaatcagggccttgtgttttc

SEQ ID NO: 52483 - DNA, 1260 bp, Homo sapiens
tctcaaactcctgagctcaagtgatcctcccaccttggcctcccaaagtactgggattaccggcgtgagcactgcacccagccaacacaaagtaatcccatctcttttaaaataaacgtctgttctactcaacagacaattcttcaataaattaatagtgccccgagctccagtacttttgtctaaactccataatgctttaatcttccctcaacttcatatgttgataaattaggacatcatagtttttattcagcaaacatttattgaaaacctactacatgccaataattattgccaattgtatttgtaatgattttctagacatagtcctcactcaggaactgaaagttctgtgaagaatttgacctgaatgtgttcctgccccccaggtcagtgcttctcaactttagggggcataagaatcacctggggagcttcttaaaagtggagattctaggacttcactctcagaaattctgattcaagtaggtctgggatggacccaagaatatgcatttttaaaaaacttccccagaggattctgatgcaggtaccctaagtggtatcagaggagtacatccatcagttaggtagtgggcggcattttatgtcagtagtagcatgggcttggtggaaagaaccttggattagaagcgggggaaaaaaagaagcagaaaacctgggttatttctagtctctttctgccactcactaattgtatgactttgagaaaatcatttcacctcacttttaaaacatgaggagattgatttagatgacctcttctaactcctgactttgaagttagaaatttcagtcattctcggttttgataccacactaccagcgtctgttttgtctataaaaatttattgggcacaacctacgtaaggatactggactagatcagagagatgcaaaggagatgtgagatgtggctcctgccccaagagacctgcattgtaataggacttacagtctggtgtaggacataagaacatttgaagtgtaagggagcttgtgcttattcccatgagctgttggagaaatgaaatattgagataggagtagaaacaagggatgggatagttacagaactcatgaagactgggatgtgaatcaggtcttaagaggaattggacagcaaggggtgtgagagtgatcacccacacataagagattccataaggcatttcattatcctgccactgtatatggtctttttatagtatgtcatgatggtaatatcacttctac

SEQ ID NO: 52484 - DNA, 1047 bp, Homo sapiens
caggtgagtcatttttcagcctctggagaagatgggctggaggaattggatttagctgtgatttcattgatattattagtatgagctgtgaattgaatatatatccttttaggcctttaataagaagaattgaagactcaagttgaaacagaaagatgtttcaaatgttttgtttttaaccaagtgtaaatgtagctatcccacacaaaaaagcaaaacgagtgtttgtttcctttgccaatgttgtttatctccttataaatctgttcacttaaaacacatctattttcagtttcttctaaccttttacataatatctttaatatcttttaaccccatcaatcctctagcttcaagcacaaatgccagcctgatatctacttcttctacaattgccaatattccagcagcagcagtagccagcatctcaaaccaggtatgatgctacctttgttcatcctgtttgatagagttcatccagcttgctctttcttctttccatggtcaatttgcctatctaagaaacaaccaggaatagtatgggctgtggagacttttttctggataccttcagaactcggaccctggatggcatcttaggttactgtctagtttttgttgttcctctgctgggtctctctagaatatggttatgtctgtttctttactgtatttgtcttcacttcctactctgcccctactagaatgtaagctgcatgaaggtagggatttatttttctgttttgttcatttacatattcccagagtatagaaaaatgcctgccacttacatcaaaggcacttgataaatatttatggaatgaacaactcattctttatgaattttttgtggtctattcttgatcactgttatgttaactatgcttaggagatcactggtaacaccttcagtgttctagagttttttatttttgttttgatttgttttctctacagcaattatcatcaccactgtctccttggatcttttcctggctacagttaacattactattctggttattatactggttttgcttttttttt

SEQ ID NO: 52485 - DNA, 1737 bp, Homo sapiens
aggtcaggtgttcaagaccaccctgaccaacatggtgaaacccatctctactaaaaaaaatgcagcattagccgggcttggtggtgcatgtctgtaatctcagctacctgggaaactgaggcaggaggattcttgaacccgggaggcggaggttgcagtgagccgagactaccattgcactctagcctgggcaacaagagtgatactcatctcaaaaaaaagaaaaaaaggatatggagaaggtaggacagaattaaagatcaataggtgaaaaagaggattgtatgccaggaccagggccagaagaaaactgaactaaaaatggacttgctggggaagataaatgattaaatcaattctttattttatttcccaccttaaatcacctgtgttcagttttattgcaggcctgcctaggataatgtactgataacaaaatctggaaaccattcaaaattcttttcctacaagaatggttaaaaccatttacagagtcagttaccctgtatattgtcatgttttgatgcttcctcttaggaaaaaggatggcttaagccacagtaggaaagaaggtgaatattggttgaaagaaaataccttctgtaaagctataaaacctatttcatttagttgttatgtttaggaaagtaagcccttaagagtcctttagttcccctgaagcaaaacgtgctatagaaaataaagttactctggatagttaggaaatttgtttttgtttttgttgttttaattttttttaatttattttttgagactgagtcactctgtcgcccaggctggagtgcagtggcgcgatctcagctcactgcaacctctgcctcccgagtttaagtgattctcctgcctcagcctcctgcatagctgggattacaggtgcacaccatcacacctggttaatttttgtatttttagtggagatggggtttcatcatgttggctaggctggtctcaaactcttgacctcaggtgatccacccacttcaggctcccaaagtgctggggttacaggcgtgagccaccacgcacctggccatagttagggaatttgaaccctagcttagctgctgaccctgaggaagaagcactggatgaagaattgggagatccaagttgtcattttggttatcttccattatttttgctgctgtggacaagttactttaattcttctttgtcctaggttcttcatcttaaagctggggttgcagcaatagctgtaactgaacttactgtcttctggattgtcttctaagccgagtacccttagggaaagggatgaaaattatctaattttgaccagagcacttaagtttctattgcatttgttctcctgccctgttctcaatggaagttttcttactaattttctctctgggggactttgttaatggggcaggtagtcagttagtcaggtctacctgatggtgaacccatatggtgtgtgtacctgcagtaggaaccatgtctaagtgtgtttatgataaatgaggacaaggagtttgagaacagtactgataatatcagttacattgttcacctgagaaaagtcactggttagtgctagtcattgagattttgattaaaaccctagtagaatgaacctatgacagaagaagtataaaacttaacccaaattacttgtctttatttttattgttttatgtgaatggaaatcagcattttctttcttttttttcttttttcttttcttttttt

SEQ ID NO: 52486 - DNA, 1058 bp, Homo sapiens
tcccatttttgttaaaaagaagattagtgaatacatagaagaaatctggactgagtgtagtggctcatgcctataatcccagcactaaaggaggctggggcaaaagtatcgcttgaggcctggagttcaagaccagcctgggcaacaaagcaaaaccctatcttatttaaaaaaaaaaaaaagaagaagaagaaatcatctgggtgactcttctgcaaactgttaatagtggttaagtctggatgatgggattatatatgactgtattttttttctaaattatgtatttctgtaatgtttttaatttataaaaataagcaggtatgtctttcctaatcggaagaaacaaaagtaacaaaataaccagcttaagaaggcagagaagtatttaatatattttagaaaaatttggtccttgtttaatgggtaagtgaattttaaacttatatggaatgtctcctaccttgacagtttggataaattatttatcactgtacatgaacatcaggcactctttataacagatactccagttgggtgtcaataactctttttttctgaatcctggtcaatttcccccagtcattgaaatgaatttatatacatattgggatttgtggcaagctttttgtttctttagcctcatcccctaattctttgaaagtgttatttgcttgtgatatattacaagtgggagattcaataattttctcttacaagcaaatttatttttgttttaagatttagattttaaacctactggctgatatttgaaagcataaccatgctcctcagtcccagtgtattgtttgtaattggtccaatttatctgattcaggtgcattgtggccaggtatgaaacctgaaagtggtttaattcagactccatctccaagtcaacacagtgttcttacctgcactacagggttaaccacaagccagccaagcccagcacattattcttatcccattcaaggtaaataggcatggttgtgtgtgtgttttaaaattattattattgtttcttgtttttaatctacctgtatctccaaacaaac

SEQ ID NO: 52487 - DNA, 1600 bp, Homo sapiens
ctctgcctcccaggttcaagccattttcctgactcagccttccgaatagctggaattacaggcacgcaccatcacgcctggctaatttttgtatttttagtagagatggggtttcaccatgttggccaggctggtctcgaactcttgacctcaagtgatctgccggcctcagcctcccaaagtgctgggattacaggcatgagccaccacacccagccatttccttcttgtcaggatgtaagcagcatacttgctcttgtcagatatagaggctattatttgtgtttcatatgctatctgtttttaccttccccaaggactttggtactatagttttcttgccaccacttgtgtgtcatcacggtcttccctttttatccttcctgtcagtaaagaaacatcttaccattttaaaacataaacactgctcccccgacccccccctgcccctccgcccttggctccacatctcttactagttatggaccttctctttgttctgtgacatatcagaacttctgcaagagttgccctcacttgctttttcacctcccattcacttttccagcctctcaaatttagcttctatcctcactcttccagtgaaactgctgtcgtcaaggccattagttattttcatgttgcaaattctagaatacgtttctcctcacattctccctctcagtacttttcctcccacctttctcctttgatggcccttctttggtgggcctcagggcttaattctaggctaccatgtttcctcttttgggattctccgatccattacattactttaaatatcttgtacatggttaatgaattccatattgatatttccagtctgacttctcccctgatttcatttgtgtatcagactgcctgtttgacatctttactggaaggaaaatcatacctaagatcttcaaaaaagaactttcgattcctttagcccccgtgacatacactcttctcccaaacttgcccatcttaggaagtggtatcactctccgtctagttgttttcctcattctctacatcaaatccatcagaatgtcctgttagttttaccttcagaatatatttcaaagtctttgcctcatccccactgttgctattctagtccaagccagcatattacttacttgattcttctatagtataatggatattatatcttgactctttataatcattttgtggttcccaagtactgtgaagatcaagtctcattcattctctagagaagtgaaaattggcctcagtctcctaggatgttgttgattccttccagaattaaattaaattggaggaagataagggtttgggttttttaatatatgtgtcaactgagaaccattatgtagaattcaaataaacttaccttacattctttgcaatggattgtcaaaactttagatctaattgacatcttcatttttgtcaaaatgattagaggtgaatgtgatctccaataattatttttaaatacctcaaacaatagcattggacaagctcttctgtaataaactcacaggtgttgatttgtcttactcttgagcatttgagttggcccctcatctacttttgatcaaggttc

SEQ ID NO: 52488 - DNA, 1132 bp, Homo sapiens
caaccaccattctactttctgtctgcatgattgtgactgctctaagtacctcacagaaatggagtcatacagtatttgtccttttgtgattcatcatgatgtctttaaggtctatccatttgtagcatgtgtcagaatttcctctttttaaggctcaataatactccattgtatgtctgttccgcattttctttatccattcatctgttgtttgtgttgttaatagttctgttgaatgagaaggaggtatttgttgtgccactttatggacttggatgttgttgggtttttttggtcattttattttagagcagttgttttttcatggtgtattcattgttaagcaaaatttatgtttatataactttgaaaataattatattttgaggcagtatgtcatttctctaaggataataatttaaatatttaacaagtgctagagttaactcactgtcttggtgctgttgtttctatttattctctagatgctcagttgagtatgtaggggatgttgctataacataatattctaggaccattgggttttaggaactggtccagtggatactggatcatagcaatatcaccaacttctaaaatataagatctacaaatagtcttcaacagtgggtataacagtgaacctcatacttaaccaggtacatgtagaagtcaaactagttattgatgtcaggaaaattctggttcagttttatgcccttcccctggtaattctatgtaagtaggtgtgagatggggtccagaagtctatttttattaactattcaggtaattataataaatcacccagtttgggaaactgacacaactattccatataatttcttgcccttacccttcaatttccataatcacatcttagtacattaagttctattacaaaaatataaacatttgagtaacaagataaaaatgaaccttacttggggatttagctttaaaattaattacaaatgaggaaaaattatttgaacattcaaaatataccattaaagctggacactgtggctcacacctgtaattccagcactttggatgctgaggtggacggattgcttgagaccaggagtttgagaccagcttgggcaacatgatgaaaccctatctctac

SEQ ID NO: 52489 - DNA, 1008 bp, Homo sapiens
gtcccttaaagaaaagatacttcaatttgaaactaagacataaactagtaaaaccaaaaatgtttgatctttcatagctgtgaatcagttttaggtcacattgactgtgttgttctaagctgagcaaaacaagtgcagggaagatagctcctatgagctttacttattgcactctgtaattctgtatcactagttacctgtgtcatgtagtaggagaacttagcttttgaggctctgtgtatgagctacagtgagagcattgagcatcaagtgcttctgacctttaaacttcttttttcttttgatattctaaattggggtagggaataaagctgtgttagagttggacaactttgcatctaattgtaaccttatgtgtgttttctctccttttcacattctggagtgtggctctaaaataaagttgtgttgtattgcaacacgacagagtaatagaagtagagtggtggtatactggcataacaagtttttggttttcttgttatttgtctattttcagtacttgtgtgataagattatatacttactttagctttgtatgtgagttaggtacagtggttggtagaaaagctaaaaacagctgtgactttaattaaatatacaagcaatcacatcttttgggagaagtgctggtttcacttttgttagatagaaatggagtatttcatttttataatgtatgcagctttctaatttttgtctctttgtctcctgtcagtaggacatggtaaggtggacttagaatcccatttttccttttttgtttgaaaatcaggacagaaagagcagggtctgagaacgtaaagattttgcttaaataattgggcagtacagttagtagaagttcattatttcagaattaaattaggtcctatctttggatgattattttctttagttctaaaagtcaaggtttcactctacttatttatttttattattgagatgcagaagaattgagttttccttgaaattgatgacatatag

SEQ ID NO: 52490 - DNA, 1058 bp, Homo sapiens
cctgggaggcggagcttgcagtgagctgagatcgcgccactgcactccagcctgggcgacagagcgagactccatctcaaaaaacaaaagacaaaaaaaaaaaacacgttaaattctagaactaatacaaggaaactaatactaagatttttacagtaattctgtacttcttttattaccaagttttgcaatattgtgtcttagttatactgtattttcatctcttgctagtaagtatgacttttgattgtatagcatgcaccacttgtggaaaatggtatgaagtcttaataaaagttttaaacattgataaatgctgggactgtgatgaatacttgcattcttatatttagtatgttctgatatttcaggtctttcagggtacaaattattggaaggcaggagaatactgtattgatggaaactagtatttagatgaatgttttggtagaattacataatttgtggtcattagtgcattttatacagaatgtaccagaatgtatgtttgcaaacttcccacacattgtatgttgccagtagaatcccgggggattttgtaatctattctttccttgtaggcagctttttgttttaaaatgatcaaaattattcgtggtcattgaccagttattttgagatagcaagcctggtttttaaacttttcttttcttttcttttttgagacagagtctcactctgtcaccaagctggagtgcagtggtgcgatctcagctcactgaaacctccgcctcccaggttcacgcgattctcttgcctcagcctcccaaggagctgggactacaggcttgcgccaccacgcccagctaatttttgtatttttagtagagacagggtttcaccatcttggccaagatggtcttgatctcctgaccttgtgatccgcctgcctcggcgtcccaaagtgctgggattacaggcatgagccaccatgcctggccagttcttttcttctaaatgtagaaattatttgtgtactttttattctcctagattgaaaagccaagaagacagagaattttaaagatggaaacaac

SEQ ID NO: 52491 - DNA, 1035 bp, Homo sapiens
tttggaatagtcaatgcttcccagatgttcatctaattggtttataccaaaaggttgaattgttatattgatagtaaggtggaaaataggtggactttctgttttctaattaacttaaaaatacaagtgcatattcttttacaaagtgtatggcttaagctctaaactaccctgttgatactggtatcttttactgtcagataacatagcaaataatggaacatatcatccttgatatttttatttagttccatcaacctaagttccagggtagctaattattaaatgtagaagtaatttaggcattttctctgttctttatagtagtatatttaaaaacagccatttaaaatatgggcttcctaaaatttgtctttgctgttttcccatttaagtatgcaatagtattttgaatcagaaaaggaatgtgtagtttaaatagtgccaacttactgtaaataagttaacagatcagcccaaggcagtcagtgcttaatatcgtgaagatcttactacagattgttttggatgcactttaacttattagctgtggttaatgtttgtagcagttagatggttttcattttcttccctagaaaataattagcaatactctttgtaatacatttatttcagcaaatattgtttaggcacctactgtgtacagttacagtaatacatatttaggctatttatgtggctaggtaatattgtaccaggctgatatgtacacttaaattctgaatttgatcttatttgtacatttctgaattaaacgtaagacaacataattagaattaaataaacttaattaacataaaatcatgttctttcgttatagatacaatcaaataattttcacttgggaaactttcacaactgaaccatgaaactctgtagtggtaaaacagtaaaaataaaagtgaactttatacagcacttactatgtaccaggaactattttaagtagtttacatgtattaactctttaatctttacaaccctatgaaataagggtactattctttttttttt

SEQ ID NO: 52492 - DNA, 1057 bp, Homo sapiens
gtgcctctgtcgcctcgctgtttttcctcagcctcatcagtccttttccaacctcggtttcttgccttacgcctcagcgcttctctcagccactgcctctccttttttctcctcctcccttcttttagaacctcttttcccctacccctgatctgggatctcagcgttctttcacctagcgagacggcccagcttctcattgtgctcactcttcaccacgagaaactgagcctctccctagggtcctagttccttgtcccccaactttcttcagctttgatccttcctcctgggaccagtaggtgacagtgcttctcctggggttcttctgcctgtccttagctagaggagagctttgccaaagccccgaaatgggaagacttccccagcctgggggaagttttgccttaaggcgccgggttagactgaactctggtagcttccatagttagggtacaacaaaggcgttcctagttcttcgctttacctcagttttggggctctctcaagagcagctaacaggtggcaggcacacggtactgctagcagttgggctggcgcgatcttgttaattgacaagtcatgaagaagttctgtcagttttgtgttcccatgagaatggatgtgcacagctgaggcaaaaacgccaatattttgggacgttcagctctgttttcggcatggacgcttcttacaggacacttgtgatgatagaggacagaatttgtggagagatcattagccccagatttatgaatttattgtgttgtttccgaaaagtggtctgctgaagagttcactatagtaatttcaaagtaatctttaaacttagtatgcacatatgcattttttcatttttactgtattaagttttctatttgtcttcctcttccttcattagccagactttacttagaattacattacttagaagtacattacttagaatattcttctaacttttgtatttttttttccttaccatttccacctttgtagtaaaactatcattttctcattttgagatttagggcacctttcttaaatttccctagag

SEQ ID NO: 52493 - DNA, 1560 bp, Homo sapiens
gccttcaaaatctgtccagaacctgaccatttactgcctccgttggtataaaccagtcagtcagtgactgtgagtgccctatttatactcttgccttcccacaatctttttttttttttttttttcagacagagcctccctctgtcacccaggctggagtgtactggcctgatcttggctcagtgcaacctctgcctcctgggttctcctgcctcagcctcctgaatagctgggattacaggggcccgccagcacgcgcggctaattgttatatttttagtagagacggggttttgccatgttggccagactggtcttgaactcctggcctcaagtgatccacccgcctcagcctcccaaagtgctgggattacaggtgtgagcctccacgcccggcccccacaatctattaatatagtagcaatgggctcctgttaaaaccctaattagatcatatccttcctccaatgcattcctatttcagagtaaaaaccaaaatccttacattggtctacaggaccctcaagatttgacacctccagtacagctctgctctaacctcaactcctactccttctgtcatccttccccttaaagcacattggcctctgccattcctcaaaactacaggtaggcccagggcctttgtgctttttaatccatctgcctggagtgctcttcccccagatacctgcatcattcatccgctcacctcatttacatctttattcacatgtcactttctcaatgagatcttccctgacactacattaaaaattggaacactaccatcctctttgtactttcccatccaacaagttgcttgtaaatttggcttagtgtctctctccccctgccagaatgtaagttccatgagtccatggatgtttgtccgatttgttcacggatgttttttcagcaccagaatggagcctggcacactgtaggcactcagtaaatgtttgttgaatgaagggctaaattgctcatttactttggttttcctgatctgaaaccctgcaaactgagccaccacctccaccagagggagcccatgagtaatcaatgcaatagctccagaaaagttatgcctaaagcatttacatacatatacactctgtttaaggacaggaatatgttctgagaaatccctcgttaggtagtttcatcattgtgcgaacatcgtaaaatggacttatacacacctaagctatatggtataacctattgctcctaggctataaatctgtatagcatatgactgtactgaatactgtaggcaattgtaacacaatggcaagtatttgtgtatttaaacatataaaaacatagaaaaggtacagtaaaaatattaaataatcttatgggaccaccatcatatatgcattctatcatttaccaaaatatcattatgtgacagctatgattctaaaacagagctacaagaaagcatgcaaattcctccccagagcagaagctgtaccttgctggtgctctagtgtctttacagtcatttaagaataaaatccaggctgggcgtggtggctcacgcctataatc

SEQ ID NO: 52494 - DNA, 1112 bp, Homo sapiens
ctgcctgccaggctcaagcgattctcctgcctcagcctcccgagtagctgggattacaggcacctgccaccacgcccggctaatttttgtatttttattagacacagggtttcaccatgttggccaggctggtcttgaactcctgacctcaggtgatctgcccgcctcggcctcccgaagtgctgggattataggtatgagccactgtgcctggccagctctattctactcttgggttattccagaggactgaagtgggctgggctacaggagggtgagtggatggcagaccaggtttaggcctttccactcattgactggtctcctcacctcaaacttcttttgtacttaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcct

SEQ ID NO: 52495 - DNA, 1073 bp, Homo sapiens
gtgttaggattacaggcatgagccactgcatgctgccagggagtttatttataatcaagagccttgtgtgtgttcttcctgatgtcctggagtgaaataagcagttattaaggccattgttactgaagccagaaccttttgtggggctagtggctacagctttggtgagtgtatagtactgtagtgtcatcagtaacaaaatgtttaatgttctaaaatatgatttctcttgaacatcagaaatgttagaatttcgcttttgttgcccaggctggagtgcaatggcatgatcttggctcactgcaacctccacctccccaggttcaggtgattctcctgcctggctaatttttgcatttttagtagagacggggtttcaccatgttggtcaggctggtctcgaactcctgacctcacatgatccacctgccccagcctcccaaagtgctggcgttacaggcatgagccgctacatccggccgagttttgtttctgtatgtattttatattgttgcttggtaggtaccagtaactaaaatttgctagttgaggttgtgtgaaatatctttgttttcggatagggttttgtccagagatcttaagaactttggctttataatggtcattctgctgaaataaggtggcctgtgttctcgacatagctttgtcactgaaagagcccaaaacctcagattgctcttggctgggctttagttactttatctgtgtaacaaggatatttatgtctttccccacagccatgcccaagtctgatctgcgtgttttagaatgagacattcatgaaaatgctatgagccctttccagacagccatctttgtagacttctagggaattgatttactatatatgcttgcttctgtggggagatgccaccttgtatggttaattcagtctgtaagtatcatataaatactatgatctggttttcctcctaggaaacgacaaagggaagaagagattgaagctcaagaaaaagccaaacgggaaagagagtggcagaaaaactttgaggtaaatttccaaggtggccagggattctaattccagaata

SEQ ID NO: 52496 - DNA, 3255 bp, Homo sapiens
tggcacaatctcaacctcccaggctcaagtgattctcccacgttagcttcctaaatagcttggactacaggcgaccaccaccatgtctgggtaattaaaaaattttttttttgtagagacagggtcttgctatgttgctcaggctggtctcgaagtcctgggcttaagtaatcctctcacctcagcctcccaaagtggtgggatgacaggcgtgagcctctgtgcctggcatgtttggtctcaactttgtgattaaaacctgaaatgtttcctagttgtacctttaccttttggtgcttgaattttgttaaagatcagtatttctgggcatttaaagagatttgttaattttttaaatgcttttgctaagagtctctttttgccgtaggaccttagagcttttggttgtaacgagacagggcaggctggaagttagtaaatgtttcccttattgacaaccccaacttttctcttattgtagttatccatcttggtgcatcctgacaaaaatcaagatgatgctgacagagcacaaaaggcttttgaaggtatttgtaaatttacctgcttctgagtattagattgtgaatggcagggcctaactgttccttgtcctagatcaagcaaagactgttatagttttgtcttctggtcaccaagaagctgtggttttcagtagagcagttgccatttcaaagcagaatgttgttgtttaagaagtagaccttaactttgctttgttaaaacttttatatgccaacaaagactgttattgcataggatcattttttttctttgaacataaagaattttatcactgaattaaatccagatgtagtgtatttagccttgagtatatatttaattttttccaaggctcttaaggaaagtcattgctatagttgaatgttttttttaacttagtttaacgacagtaaataattaaagtagggaatgctttagagagcacaagtccatttacactgcctgagtatagttcagactttcagagggtgtttgcagaaacagttaatttcaatgttttgcattagctgtggacaaagcttacaagttgctactggatcaggagcaaaagaagagggccctggatgtaattcaggcaggaaaagaatacgtggaacacactgtaagtatttatagtgctgctgtgtttacaggaagtatcagcaagccttgggcaccttgtagaagggtacatatgaacatagtaatgcctactggcacaacctgtggctacttctgtgctctctaccactttgctgtggtggtcatgaatagtgtgtgcctgaagctgtaattcacccctaagagaagaactcagatgaggagtagctggtacactgctcctacctctttccctaccagtcctgtgttggggagaaagggttgttctctccctctcatcacatattgccacttaccccattcttagagtggaaacgtggagcagcctgtgactcttgactcttgatttttattcttgtccctgtgaagggtttgcaacaaggcttggcaaaggctagcaagaggataggcgtaaactttttttaaaataggaggaggtttatgtccatcttaataacagagttgggaagaactcagttgaaggaaactgagttgtagctggtgttatttttgtttgctcttgagggcatacataagtctccaatgtggtgggaaatgtcagtatggctttcccaaggtaagaaaggtcttttaactttttacttgctggggcaagaatcttgaggtcatttgtaagagctgcttcaattgtgattggatgacttttcacatgaagagctttgaaatctgagacaactttataaccataataatgaatccagtttcggtgaggaaaatggataagaagaggagacaaagggcccataactatatcctgcgggtcatgtgttggaaatggcacttgtaggccctatcctggtagaaatagggaaagtgcctgacagtttctccttaaatcattgtggcttcgtatgtctttcacctgtaagaaagtcatccttaggcttcctgaccacagggtggcagtagggcctttctgagcttagagggtacttggcctttgctggtataatagactggttagttcatggagtagtgtcattcttgtatgaattcgtatatttatttatttattttttatctcagtagtggccaatgtgataaaagtatcagttaatatgatatgtggtttaaggaggttccatggtgaaagtgatcaagaatgcagttatagaaatgccagaaaaactacttggacataatgccacagattctgtagcttcttctaaaacttgacagatatatttgctttgctctaaacacataaccacaagccaagaaaggtaaataagtagtctgtttcaaagactttttggatctgatgagttggggacaacctcccgttggtcccctttcatctttcattcttcctggtagattggattttagatgagattagaaaaaggacttgtggttcctaattttccttgattctgttgttcttttgaggagggaggggaggggctctttttttttttaatgaaaactttttgctatacccgtgcctatagaaagttaaatatattgtatgtgtacagcccagtggatattctcaaagcacagatgctcgtcttttgatgaaaaaaaattctttttaggtgaaagagcgaaaaaaacaattaaagaaggaaggaaaacctacaattgtagaggaggatgatcctgagctggtgagttaaatataggaaaagccactgtatcttgtgtgattgtgtctacgaattggtgggttacagagacagaagccaaaagaatgatgaatatatgctatttcacatttatttatttatttatttattatttttgagactgagtttcactcttgttgcccaggctggagggcaatggcgcgatctcggctcactgcaacctctgcctcctgggttcaaacgattcttctgcctcagcctcccaagtagctgggattaccagcatgtaccaccatgcccggttaattttgtatttttagtagagatggggtttctccatgtttgtcagtctggtctcgaactcctgacctcagatgatccgcctgccttggcctcccaaagtcctgggattgcaggctacaggcatgagccaccctgcccggcctctggctaatttttttgtatttttagtagagacggggtttcatcatgttggcta

SEQ ID NO: 52497 - DNA, 1009 bp, Homo sapiens
tctttaaaggctgtgacttatttatctttgaatcctcttgatgcctgctgtggggtcaaactgttggggttaaaattctggcttacaagttgggtaattgggaacaagtcagttaccttctctaagcctcagtattcttatctgtgaattgggtataacagcagtatctaccacatagggttgttgagattaataaatacatgtaaggtttttatattaaaattcaacaaatggtagttttaatttctcaaagcatttagcaaaatgtcttgcacatggtaaacacacaaataaatgtttgttgaacatatcagtgaacattttgttaagataattcagtttgttattgaattctattaatgaagtttttaatcctcataattttaggtgaaacaaatagagaagagagactcggttctaacttcgaaaaatcagattgaaagactgacccgtcctggttcctcttacttcaatttgaacccatttgaggtgagccgattgatgttgctagggcctctgtaatgggggagatttgcatagctgcaggcatacctacatcagaatacatacctaatttatatcatagttaggattgagaaaaatggtggagtaaagtgatggaatctgtatagtacaaaattgagtattccttatccaaaatgcttgggaccagaagttttttggattttggatttttttgggattttggaatatatacatacattctgcttacttactggttgaagcatcccaaattagaaaattcagaatgttaatgagcattttctttgagcatcagttgactctcagaaagtttcagattttggagcattttggattttgcatttttggattagggatatgtaacctgtatatagattgtctttaaacttgggtgattgtaccgagcagaactggagagacagcatgttaaggaaagtgagatggtcacatatctttcatcatcttttagcaacccaaatatataaggatttaatttcagatgtga

SEQ ID NO: 52498 - DNA, 1245 bp, Homo sapiens
tatctaagccagggcacattggacgtcggtatcctggacatcagcatcctggacacagctcccaaaccccgaattcccccattttattgatgctagcaggccagggaagggaaaacttcctttgggctttgaataataacgactttagaattgaaatcgtgggctggaggtggacgccacgcctcattctgatgggtccaagagccgaaatttcggcttctggcactctcctcactcagctctctaaactcctccatcattcctctttccagtcctttggccctaagcccttgctagcggttggctaagaagaaacccgtctcttgctcgggattcgctgtgagctccgggaagcccgcctccgctctcccgtgattcgctactcctgtgttcatccgcccctccgtcgaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcaggtacgctgcggcagtgtccgctgctccagccccgcgggcggatcccatctttgcttccgtacctttaccagtgtccctgtctctctgcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctca

SEQ ID NO: 52499 - DNA, 1187 bp, Homo sapiens
tgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgtttgatgccttcttctatctggaagagatagacagacaccaatggactgctaaaatggattagaggcgtccctgcatccaggaacccacagacaatgcacagtgtgataagtgctatgaaacaacacgagttggggggataggtgtgacacagacaaagtacccctccccgtctaattagaggtgttcagagaaagcttcctgaaggataaatcccaatctgaagcataaagatcaggaggatcctggagatccgaaggagtcattgcttcaaaagatacaattaggccaggtgcggtggctcatgcctgtaatcccagcactttggaaggccaaggtgggtggatcacctgaggtcaggagttcaagaccagcctggacaacagtaaaaccccatctctattaaaaatacaaaaattagccaggtgtggtggcacgcacctgtagtcccagctactcaggagg

SEQ ID NO: 52500 - DNA, 1033 bp, Homo sapiens
ggctttgagggagggatctttacacagaagccatgtttcctcagtggagaaaactgctgctatctgggaggtttctttttcttatctttttttttttttttttttgagatggagtcttgctctgttgcccaggctggagtgcagtggcacgatctcagctcactgcaacctccatctcccaggttcaagcaattctcctgcctcagcctccctagtagttgggattacaggcacccgccaccatgcccagctaatttttgtattttcagtagaaacagagtttcagcatgttggccaggctgatcttgaactcctaacctcaggtgatccacctgccttggcctcccaaagtgctgagattaccggcatgagccaccgcacctggcctatctgggagatttctgtgtattcctctctcgagaaaagaggaccttcggacggtttctgctttgagtggtggcatccttagaagacagcagggtgctgatctttgagtcaggtgcccgaggtccaagagaagacccaggcgtgcagctcccttaactccctgtcacttcaccacacactccctttcaggagctcattgccttcagatgtgtgtatcttcagaaagttccaagggcttcactctagtactggtagtattgggctcccgaataactttctcggccagatgcagtggctcatgcctgtaatactaacactttgggaggccgaggcagatggattgcttgagcccaggagttcaaaaccagcctgaaaccctgtctctacaaaatatacaaaagttagccaggcgtggtggtgtgcgccagctacttcgaaggctgaggtgggaggattgcttgagcctgggaggcggaggttgcagtgaactgtgatcatgccactgcactccagcctgggtgacagagcaagagtctgtctcaaaaaaaaaaaaaaaaaaaaaaccaggctgggcgcggtggctcgcacctgtaatccaagcactttgggaggccgaggtaggtggatcacaaggtcaggagattga

SEQ ID NO: 52501 - DNA, 1034 bp, Homo sapiens
attctgttggactgtgctatgctaggcactggggtaacaacaaagaactagattcagtgtgtgcccccaagtgtgacaggtgctgtgactggagcttctcattcttggtgagtcccagatgcagcagcctggagactattgagaccttgagaagtttagagaatggggaatcatttctgcacttgcagaaacctgggttgtatcccagccctgctactgccttcctgcctgagtagccagaagtgagttgacctctctgagccttgttcctcatctgtaaaatggaagccctagtagtagcttctgccctaaagtccaggtagtgcatgtgaaattaatgcttagccagtggtaaccagccttgttatgcaccattgttattactgactccccagtccagggaattgggcagggagggctgacttggaggggtcatttcttggcagtggtatgctgccctgcctgcttcctctgtcaggatcggggaagcattcagggtattggagccatggattcaaatctacttggttttgccttcagggctttatactcgcgttccctctggctggaatgctggtccccctagtttttggggtgtgtgtttgtttgttttgagacggagtttcactcttgttgcccaggctggagtgcaatggtgcgatctcagctcaccacaacctccacctcctgggttcaagcaattctcctgcctcagccccccgagtagctgggactacaggcatgcaccaccatgcctggctaattttttgtatttttagtagagacggggtttctccatgttggtcaggctggtctcgaactcccaacctctggtgatccgcctgcctcggcctctcaaagtgctgggatttcaggcgtgagccactgcgcccggcctgtttgttttttaagagagggtgtcctgctgtgttgtccagactgttctcaaattcctagcctcaggtgatcctccaccaccaagccttccaaagtaccggggttacaggtgtgaaccaccccacttaggcccccta

SEQ ID NO: 52502 - DNA, 1014 bp, Homo sapiens
tcctcagtgggcttttggccatctgagaaggaaggttcaattatagtttttggttcccggatacctgagggctggtactaagtctggatcttaatgggaaggggagaactgggcgcctcctatccctgtccagtgagagcatggctctgatttgggtaaactgtaaacaagaccagtgctgagagccacctccactctcagattaacaaaataaattaataagtagagcatccttcctgaaccccatctctaggactaggagaagcagatgtagtgagtacctgatattagtggtttctaaagaggctgcagcatataacaggtcaaaacagttgctcccatcagccttgtacaccctgctcagattccctccgtgcctttctgctttctctgtcttcattcacagactagtatgaatgacctggcgctgctctccactaaatgtgatctggtgtcagggaaacaaaacagacaatttgatgacagtgtttttagaagcaaaagccctgggaattttggggtcataggtgagggccagaaaaaggttcctagactattgtggtttagctttgcaaaaggagtgaccactgggactgggccagttgtatctggaagcccatgggagggggaggtagggttttaagccagttgatcggatttatattcagaaagttaatgtggctactgggtagaggatggataggagaggccagggctaaggaggccgggggacaactggcgaggttgtgagtagtggtccagacaagagggggtggtagttaatgaggtggtggtggtgggaggacagataagcagccaggcatggtgactcccatctgtaatcccagtgctttgggaggccaaggcaggaggatccattgagcccagcagtttgaggctatagtgagctatgactgcaccactaaagaagaggccaggcgtggtggctcattccagtaatcccagcactttgggaggctgaggtgggcggatcacctgaggttggggattcga

SEQ ID NO: 52503 - DNA, 1007 bp, Homo sapiens
agcatctggggtacttggttacctggcttcagggtgcaaactgtggtgtgttcttgtataagttctctgggaccactaagaaggtggcctcctggagatgtgcagcatgatggctatatagttccttttccaggaccctcccatcccgcaatgctgggattcttgggtcccaacccagttcctgaagaactcagcctggagtgagccctctttcttgattacccttccaaacatgtgtatatctcccatctggctccaccatccaaagtatgctagaaaggtgggtttaacacttcagtgtagccccttggataggaggaagaggctggataggtaataatcctctttattctcccttctactacggactaacctcatatgtttcctcccaggagcagagggagagccgggctcggcgaggccctcgagggcccagcgccttcatccccgtggaggaggtaagcttggaaggggttagggatctttggtccctgggaagaaaggacatggcatattggtaggcaggcatcttttcctgttctttaaattgcagcttttaagctattcctttctgatttctgattcatttaattcacaaaacggctttgtgaagcaggcactgtcaactccattttactgggaagaaacaggctcaaagaaatcaagtgctaatagccaggtagtggccaaactttttttttttttcatgctcaaacttttgattcctagatcagtgcctgctttcccttaagaagatagaactatctatctcatccatgaccatacatatattacacgctcttttctgttttaaaagtaatatatgtttattattttaaaaatttccattgtttcagaaagctctgatctcctgtatcctcctgcaccctgcagagatcatcactgttaaccatttgccactgtttactgtgcttttttcaagccaatacttactttcagtacagaaccaaggtcatagtttacaacgtgtttttttgttttgtttt

SEQ ID NO: 52504 - DNA, 1839 bp, Homo sapiens
gagaaactgtacttttactctctgtgcctgatttttcctacctaaaagtggagaaacagaactccagttttatagttgttgtgagagttaaataagttaaaatatgcattcttgaacagtgcttggcacatagcattgtatgtgtaagtactggccattattatataaggtacctaataagtatttattgaatcacttattaaaatatgtgatcctccccattctttctttttggacacggtggtggtttttagtttcttgccattaaaaacccactggaagaatacattggtctctttgatgagtggggcaggagggaaacccatgctctcctcccctttggttggcaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggtgagcctctctgggcctgacacttggagaggtggctttgtggtgggttctgtcctttgatctcttttctgggagctttgtgagctgattccatagacaagcagggaaagccctggctttatctaactgtagagttttgggttttttgtttttattttttctcagaaggaaaattttaggttttgaagaaaggcatcgttagtgcttgtgttaggtacagattggcaaactgaggtgcaaaaaggaatcaggtggcctgcaagctggtggcagagctggggttacttagaacttagatttcctgcctcttggggaacagtgagccctacaacctctcccctgatggggtacccaccctgagccaggcacaaaaggaggagggtgactcaggctgtgtccactacctccgcaggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggtgcagggggcagagaggcgggtgtctgagggagcacagaggcctggctggtgcctggtgggtaacccagggcaggcactgagcagctctgacctccccccttgtcccttccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctggggtaagtcacgggcctgggtcttgatcggggaggaagcgggcatgacctctggtccttaggtagaagctactgcttcccaatctcgtatctgcactacctgctgctatgagagaccatagaaaagttatttgactttgaagcttagtttcctcatctgtgaaatggggagataaagaccctctactcacactgggctgtgagggttaaatgaaataccatgtgactgacactgtgtatatgccataggctcaaagcctgttggttttagcactttaaaactacaaagtttaccttttactctgtaatgtggccttgtatgtttcaatacaaaaatacagatactttaaaaattcctgctcagggaagatg

SEQ ID NO: 52505 - DNA, 2101 bp, Homo sapiens
agttgttttattcatttactcaaacatgagcatgttttagtgaacccatgattttttttcctgcctttctcacttaacagtttataccaaacaccaaaaaattatcccccaattttaaaaaaggtacgtgctccttgtagaaagtttgtgtttctgtgtattactagctgtaaatcatatttcactgaatgggttgagctatacttaatgaaccatcctcttactctagtcactagtaggtttccaacccatggctggccaaggacaggcttcttagaatgtgagttgggctggtttccgcccagccctcaggtccaggcttctctgctctccaacatggttcttgctcctatttctttgtcttccaaatctgccctccagtttccagccagtcattcctctgtctacactgatctgttttgacattggctcccctcactcactagactggggataactaagtggcttctagactcatcatcaacttgctttttggctttgaagaagttagtcatcttctccagggcttaggttgcccatttgtagaatgagtacaagcacctttttacccttatcctcttccttctcctccactgacctcctcctctaccttccatggcctttactacagagtagtggttatggcccctgagctaggcagagctgggtttaaaacccattcctgtccaggcgtggtggctcacgcctgtaatcccagcactttgggaggctgaggcaggcggatcatgaggtcaggagttcgagaccagcctgaccaacatggtgaaaccccatctctactaaaaatacaaaaattagccgggcacagtggcatgtacctgtaatcccagctactcaggaggctgaggcaggagaattgcttgaactcaggaggctgaggttgcggtgagccgagatcacgccattgcactccagcctgtgcaacagagcgagactccgtctcaaaagaaaaacaaaaacatactgaaattaatgtaaaaaaatgtgagctaagctttctgcaactctgaaatcaagttatatctcctcctttaaataaaactgccttgttgatcatgaaaaaacaaaaacaaagaccattccttgctgtattaactagggcaagtgacttcctttctctaaatctcagtttcctcatctataacatggggttgatgaatgtagcagattgcatacaccatccagtcatgtacacagtagtgtagagtagttttgaggattccacatggcacatagttggtattcaatacagcatgctcattctctgcattccttgacgtggtcccctgccaatgtggcggcctgtgataacacgatatcagctgtttctccaagaggaactaggcttcttgttgcttctaccttctgatttttctcaacactctgttcttccctctgtagggtggggttgcggggagggagctgcctttgggaagaaagcatgagtaatgctgctgggacctttccatccagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtatgacctatacaggcagggcaggatggaagtagacaggccaagccagtggagagggcaaggggttaggacccagtgagagtccccagactgagtctgtcctgctaggtgggacacctgggcctattcctctggattgaagtcctattccactgtgtgatttcagagtctgtttactcacctgtaaaatgggaatgagggtgcctgcttcacattagtggtagcttggtggacctgggttcaaatcataacactatctcttgatagcagtgtgactttcggcaagtcacattatctcgctgagtttttttgtttttttttttgagatgagtctccctttgttgcccaggctggagtgcagtggcacgatcttggctcactgcaacttccacctcccaagttcaagcgattctcctgcctcagcctcctgagtagctgggactacaggcgtgtgccaccatc

SEQ ID NO: 52506 - DNA, 2888 bp, Homo sapiens
gggattacaggcgtgagccaccgcacctggccattttacctttagggaatacagagcttagtcatgataggaatgaatgtgcttgtccttgtactaaactgctcagagccttagcagatgctggggcagctctgtaggaaaggaaatggtgaggtaagtgggtcagggatcaaggcagtctgggaggggtgtgggggtgaggagtgacatcagttgccaacatgccttcctctgtgccccaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgttctttcaatttcctgaaggtcatggttcaccttgtagcataggcagagagctgtgattgcatcatgggcctgacctgatagcccctgccctgccgagaacttgtgcccagtgattgtaggttgggactgttggcactgaaagtctacttgtcccttggacatccagtcctgtcacccttctgcggctgccctggcactgtggagtaataatgaccatggtgtttttctaagcctggccatgggctgggtacttggagaccattcctctgaatttgcagcaatcctgtaggagaattgagacgggtgaactgacgttgttgaggccacatggctaatcggtgggggagccaggattcccccctgctctgcttgaccctgaggccttgacattttaccttgctgttttgcccactactggacttcccctgtgacaaagaggctgtttgaatctggaaggacccccttgtgtccccaaccccaccacattatgattacctgcttctcatcctaccgcctccagcaccaaggagacaacgccaggaacaaagaggtgcaacccccaagctgtgccagtgccgtttatggctgtgtgaccttggtcaagcttcttaacttctctgggtaccaggaactagttagcttaccaggaaaaccacatcatgtaagagctaagaccactcccgcgggcttcctacttcctataaataccgctgtcagaacactaggtctcttccaggcagcctcccctagtggactttgtgttccccttccccttgaggtatctgttcattttcgcaggattcctatacacttccccttcctctagagtcatttgagagggtgtgggagaa

SEQ ID NO: 52507 - DNA, 1357 bp, Homo sapiens
gccttgacctcctgggctcaaatgacactcccatctcagcctcccaagtagctggaattacaggcgagggctaccatgtctggctaatttttaattttttgtagagatggggtctccctacgttgcctaggctggtcttgaactactgggctcaagtgatccacctgcctcggtctcccaaagtgctggaattacaggtatgatccaccatgtccaggacccatcttaagtcctaagcactagtgtgttaacctctgcccttctgcttctccatgaagtctttttgggctttctcctctcctctgggttgtacaaagagtctcctccagaaaacatttgagttgatggcataaataatggcataaaaccatttgacccaaggaagggggtaattgtgatgagatcttaggggaccagaaacaaactcttttacttccacatagattatacagcagacttgcaattctggcagctgtgagatggagagaataccacctgcttctgagagctagtatgaggaggaaatgaattatacagattcagctgagcatggtggctcacacctgtaatcccagcactttgggaggctgaggcaggtggatcacctgaggtctggagttcgagaccagcctggccaatttggtgaaaccccgtctctactacaaatacaaaaattagctgagtgtggtggtgcacgctcgtaatcccagctatttgggaggcggaggcaggagaatcacttgaacctggtgggtggaggttgcagtgagccgagatcatgccactgcacatccacctgggtgacagagtaagactccatctcaaaaaaaaaaaaaaaaaatacagattcacagaaagtgcttaccacagagcctggcacccagtaatcacacactcaaggggagctgtccaggaaatttgagacccagtgggttaattatcggttaattatcttcagactaaaaccaacactgatttccccagacagcccgggaggggagaaacccaaacagacagttacagttcagctaaaacagagctaatctttaatcttttatggatacatgtaatacattaactattatagcttatcccctcaaggcacctcaacacctggtcaaccagaggctagagttgggttggctgggctaagaggaagggagcaagtaaataggccaattacccttctgcaacagactttcttagggccccgccttgagattaagagaattaaatggctaatgctgcctgtcattcagccagtggggtggggaggtgaatttcttgagtcagcacccaatgaagaacactaggcacaaaattatatgaggtgttttacctgtctctcagcaaacta

SEQ ID NO: 52508 - DNA, 1023 bp, Homo sapiens
gcctcggcctcccaaagtgctggggttacaggcgtgagccaccgcgcccaacccctcagttcttttttcttttgaaacccactataatctctgtaagtcctatcagttccaagagactttctacacaaatacatctccaggttgtcaaacctaaaaagattttcctagagcatggcctatgacgtcaaggatccaggtagcgcccggaggaaagcgccaaaggaggccgccatctttcatacagcagcccggaattttgcgcatgcgcctctgattgtctgtccgcaatgaagctcttcggccttctcggcacccatacgtttgggaacggcagtttcgaggtttgtgagacgtcggcttccgaccggaagtgagaagaggaggaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtgtgcttctagtgtttaattggatacgtgttatggatgccggcttagaaggacctatataccatcatcttaaaataacttccccttggctctctctctctttttttttttttttttttttttgagacggagtttcgctcttgttgcccaggctggagtgcaatggcgcgatctcggctcaccgcaacctcgccttccgggttcaagcgattctcctgcctcagcctcctgaggagctgggattacaggcgctcgccaccaggcctggctaattttttgtatttttagtagagtcggggtttcttcatgttggtcaggctggtctcgaactcccaacctccagttgatccgccggcctcggcctcccaaagtactgagattacaggcgtgagccaccgcgcccggccttggctctctttaaaaggcatttttaggctagccgcagtgtggtctcccgcctgtagtagtcccagctactcggcttgagcccaggagtt

SEQ ID NO: 52509 - DNA, 1046 bp, Homo sapiens
cataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagc

SEQ ID NO: 52510 - DNA, 1082 bp, Homo sapiens
gaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgta

SEQ ID NO: 52511 - DNA, 1721 bp, Homo sapiens
cctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccaca

SEQ ID NO: 52512 - DNA, 1172 bp, Homo sapiens
gcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactg

SEQ ID NO: 52513 - DNA, 1070 bp, Homo sapiens
aaatacaaaaaatcagctgggcatggtggtgggtgcctgtagtcccagctactctggaggctgaggcagaagaatggcgtgaacatgggaggcggagcttgcagtgagccgagatcacgccattgcactccagcctgggcaacaagagtgaaactccatctcaaaaaaaaaaaaaaaaagagagagaaaatgctctgcgcagtgctagggaaataaatatttattaaatgttagcttgcattaatttattcctctgctagaatttgagctcaggagagcaggaacgttgtctttctgtgactgctgcatcctgtgcgtagcacagtgcctggcatacagggcagactgtaaatatttgctgaattttcttctatgagttactttccagcagggtgtcggggaagctcctatttgggaatgttccctaggggtgaaggtgtcgaggaggatggtgaactgaatgtgggaattcctgcagatattagaattgtttgtacttggatcttgacactatgtggacacctgttgatgggactctcctttcttcctctagtttaatggactctctctttctcttctcagcctcttttcctttctacattcctgcccaccttcttatccttacttctttttcatgtgtccattcttagactttaatcacatttgtgatctaaattgtatatttttttcatgcaggggttatggttttgtgaaattcacagatgaactggaacagaagcgagccctgacggagtgccagggagcagtgggactggggtctaagcctgtgcggctgagcgtggcaatccctaaagcgtgagtcctgcagggaaggtagagagactctagactcccctccagacactcctcttttgtttgctgagaatcagggcatccatacgctggatgggaggctgaaggggatccaattcaagtcacaagtactgaatgcctgctgtttgccaggctgtgggtgctggggttgaactagccccactcctgcagaaacttagagttggggatagagtatgatttggaaaggctgatgtattcagacattactggtgaca

SEQ ID NO: 52514 - DNA, 1028 bp, Homo sapiens
ttacatacctacctgtcaactgagaaaccttgaactcaggctttagtgtgtgaattatcccaagctgctcatcccagttttggataatcccaaactgtcctatgtggataactacctggacaaaggattcctgtgaaggaaaccaatttgaaccttgtttaaaagttgttcccttggtcttcaaactcaaatggtcaaatgaatgcagcagtgttgtagaaacattcatgatctccaaaaacagtcattattaaaatcttacaaatcatatttccaaaaaggtttcacaatttttaaaaaggagtctctcatctccctcacatcatgcaacctggcttgtcctttggcctggctacatcatggcagggatctctgaagacactgtgtccaggggctgccagtgacagtccatcagagcgtcatacagctcctcactctgttccatgaactccttgttggcctcagtcacatccagctgtggcatggggtctggaaagcaagcaaggatggggtcagggaagtctagggacagctgcaagggacctggttcagttcccttctcccagaactctgttctatggtaaggtccctatcctgccagtttctttcaggaagtgaaagcactgccttgcagggttctggggaagatgaaaatagaataatgtatctagagaatgggaaaatggcagctgttagcctgcatctattaaaagctacacctgtgtctctagccatcatgtatcctagattttctggtctggtcctcacttcaaatttgggtttagaaggtctgatcaaagttattaagtccagagcatcatctcaagaactgacaataagtgcatagtggaagaacttcagtcaaatataggagctgaaaggccaagtcctgtatgtatgtatgtgtgtgtgtatgtactttagagaaagggtcttgctctgtcacacaggctagagtacagtggcacacttacagctcacagcagccttgaactcttaggttaaagtgatcctcccgccttagcctc

SEQ ID NO: 52515 - DNA, 1006 bp, Homo sapiens
gacagagcaagaccctttctctaaagtacatacacacacacatacatacatacaggacttggcctttcagctcctatatttgactgaagttcttccactatgcacttattgtcagttcttgagatgatgctctggacttaataactttgatcagaccttctaaacccaaatttgaagtgaggaccagaccagaaaatctaggatacatgatggctagagacacaggtgtagcttttaatagatgcaggctaacagctgccattttcccattctctagatacattattctattttcatcttccccagaaccctgcaaggcagtgctttcacttcctgaaagaaactggcaggatagggaccttaccatagaacagagttctgggagaagggaactgaaccaggtcccttgcagctgtccctagacttccctgaccccatccttgcttgctttccagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtc

SEQ ID NO: 52516 - DNA, 2767 bp, Homo sapiens
ctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggtaagttagtgactacccaaagctttgtcacaacttggtgtgtagctgcaggtagtgctcaactatctgggatcctgtcctaagtagtcaacctaatagaactataaggttacttaggtctgtgtcaaagttacagctttttttttttttttttttgagacagggtctttctgtcacccaggctggagtgcagtggcacaatcttggctaattgcctcccaggttcaagtgattctcctgcctcagcctcctgagtagctgggactataagcacgcaccactatgtctggctaatttttgtatttttagtagagacagggtttcaccacgttgcccagggcagtcttgaactcctgaccccaagtgatctgcctgccttggcctaccaaagtgctaggattacaggcatgaaccactgtgccgggccagaaagtcttagcatcttagtaacatttacatttggcctccctcgtgtgcccttagctattcattaccagagggcaaagatggttagaacatgatttacccaccctaaaatgcattgaaggcatcagagggcaccgtgggccacaaggcctggtagccacaaatgttcagtggtggctggagctcatgatgcattctttggtgggacgtctctcagcattagggagagttgagagtggggtagaaacaaggggttccatgtagcacacactgtatttagaatgactggtccaggatgaaacctaatttgagtggacatccatggatgagaaatgcggatatgggactgagaccagctcctaggaaaatgtctgggtgggggaaatctgggaattagtaacacaatggcttacacttcctttgcaggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctcttcccgagctcaagcaatccatctcccaaagtgagccaccatgcccagcccttaaagagatctttggagattttttatgatgtaggatgaatgctttgcctcaagcagtaagtcccaacacatgacaaggttggacagtttccccatttacttgggaaacacggaagtgagcagtataaagttcacacggagggtctgctttggctttgagctatcttccttaatcctttctgagctgccttctcccgt

SEQ ID NO: 52517 - DNA, 1033 bp, Homo sapiens
tagatacagtagacatttatattgccaacttttaccaagttctgaaggccattgatataattcctgcaggctcatatcccacaattttgcccaataaaatattccatatgctgttagtttatccctaacagcagacattcattttataagaaggtggtctatatgtgccataatcatcattaattaattttcaaagttgcttatgaaagagatggagatgtttgtcttggctcccactaaggaaaaggagatatatttctccacatccagtttgcttggatcctggttggtgaagatgtaccaggccattcaactaaaatggttccatggcaaggatggtgcttgatgccagttgttcatttacaggtagcttttgaaaatggctgcctctcatttcaccgggctcacagctgttgctgatgtaattaaagatctagacactcagatagctgtaagtaagtttgaggctactgtgagcagaacttggtgaatgtgcttctgatcgtgatgacacccaagctgacgtccacagagtcagcctcatgactctaagattcaggagtctcagctgctccagactagggtctctgcatgtacttagattgctaacactcagagaaaaattgctcttgataaagaggagtttacttttaacagctgctaaaagttatgtttattgggcatagccctgacatagacttaagcatgtttgaaatgccagaatgaactagtctgtattcttaagctttgtgactgatttttttaaaggatgtgattgtgctatgacttatttgaatttaacattatttgatactttaaaaataatgcatgtagtacttaactatttttacaaagttctcaaaaatgtcttgcttattctagtttatttatttatttatttatttatttttattattatttgagatggagtttcgtcaacctctgcatcccgagttcaagcaattcttctgccttagcctcccaagtagctgggattacaggcgtgtgtcaccacgcccggctaattttgtgt

SEQ ID NO: 52518 - DNA, 1130 bp, Homo sapiens
cctgcctgggctgctccaaggtggtggctaggggtggcacaagttacacattttcaatttggataggttgtgattcttgtcttccccagtcagatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttggattttgtgttcacctttaccaaaaaatggatttggtaacactgccaccctgctttggtgacagagaaagcaaaaagggcttctgtcgtgagtggcacacgtagggcaactcgattgctctgcgtgcggaatcgacatcaagagatttcggaagcataattttttggtatttgggcagctggtgatcgttggtcccggcgccctttctttactgttatatgttaggcgaaatattacgcgtttggagtaagtggtgctttttgtaactgaaaagagattctgtgtgtgtttttttttttttttagaggctgcatagttatttgtatgaaccgcaggtgacctaattagcaaggtaattcagacctgtatcctagcacttaagaagtggaagtgggataaccctgcgtgttctcgtgtgggaggctagcttaagcaacaaagcaggaaggccccaccaacaaaagaatttaaaaattatacgtgcgtggtggcgcgcgtatgaggaaattatttggcaactgtgttacagtatagcagcaaatggaatagacctagtccctgactttaggagacctgcctcagccccccgaatggctgggactacaggcgtgcgcctccgcgcccagctaatttttgcatttttggtagagacgggttcaccatgttggccaggatggtctccatctcttcatctggtgatccgcc

SEQ ID NO: 52519 - DNA, 1077 bp, Homo sapiens
cccagactggagtgcaatggcgcgatctcagctcactgcaacctccgcctcttgggttcaagcgattctcctgcctcaccctcccgagtagctggggctacaggcgcccgccaccacacccagctaatttttgtatttttaatagagacggggtttcaccatgttggccaggctggtctcgaactcccaacctcaggtgatcccacatcctcagcctcccagagtactgggattacaggcgtgaatcactgcgcctggcccaaccaggctaatttttttgtgtttttagtagagacggggtttcaccatgttagccaggatggtttcgatctcctgaccttgtgattcgcccgcgttggcctcctaaagtgctggtattacaggcgtgagccactgcgcccggcgggggaaacttattcaatggttgcaccgtctcctaatttgagagccttatatcaaggatgtatatttaatatcttacttaaatgattttttttgggttcctatttacttcagcaaatacattgtataggtagcttctactcagcttcattgggtttattgtgggggcagtattttggtcttgccctaagccaaagtccaccggactgtagcgggatgactccaaataactcttatcccatcgctccctcaaacatctacataatagtctccagtctgtgacttagaatttcacctcctctggatacttccctcagtgtttctgcataatttacttgttgacctcattacatcttgtagcactatggatcacccactgaatgcatgagaagaaataaaggggatatcaaggagttttggcctcaagtaataataaagttttaacttggatttttccccccgttttaaacaaaactgtagtttagagtggaaatttcttttttattttatttttttgggggaacagagtttccctctgttgcccaggtgagagtgcattgcgggatctcagctcactgcaaactcgatcctctcagctcagcctcctgagtagctgggactacaggtgcgtggcactgcgcccgcctaattttgttagttttctggcgggcgctg

SEQ ID NO: 52520 - DNA, 1159 bp, Homo sapiens
agaaggcggaggttatagtgagctgagattgtgccattgtactccagcctgggcaacaagaacgaaactctgtctaaaaaaacaaaacaaaacaaaacacaatccttgcttttccaggacgtacagactgaggaggaaaagccaacaaagtgagatgatggttgtgacgggggtactgcaggtgctgagagatcaagaacacaaactcaaacctagtgaaggaattcacagaaggcctccccaaggaagtgatgtttcaagtaaatcacaaaatggttagcagggactagccaaaaaggaagggaaagagaattgcttgaacctgggaggcagaggttgcagtgagccaagatcgtgccacagaactccagtctgggcaacggagcgagaccgcgtctcaaaaaaaagaaaatagtttagcagtggctttgtggagaagtgagctttgaactggactttgaagggagaagatgagggagaaaggcattaaagacatttcaggcttaaggaataaagggcaaagaaatataaaggtacattatgctatgctcagagtacattaggtggctggtatggtattaggacttaagattcttggggtatgatagttgcaggtaagaccagatgagtattttgggaccattgagggaattcagagtgccgtgcttaagtatgtgtgttttaggcaaacaagtgctgtgggagaggtgagatgtggattagatcttctgactacactttttttttctttgagacggagtttcgctcttgttgcccaggctggagtgcaatggcatgatctcggctcaccgcaatctccacctcctgggttcaagcgattctcctgcctcagcctctcaagtagctcagattacaggcatgtaccaccgcgccaggccaattttttgtatttttagtagagacagggtttctccaggttggtcaggctggtctcgaactcccaacctcaggtgatccacccgcctaggcctccaaaagtgctgggattacaggtgtgagccaccacgcacggccctgactacacgttttgtactcaaacttgcatccattgtgtgcctactctgtttgggcacagtcgtagtcatctttacatactcatatattaaaataaatacagtgctcttacctatactctctt

SEQ ID NO: 52521 - DNA, 1032 bp, Homo sapiens
taactctgtcacccaggctggagtgcagtggcgtgatctcagcttactgcaacctcagcttcctggctcaagtgattcttcagcctcatcctcccaattagctgggactacaggcctcagctaccatgcctggctgatttttgtattttttatagaaatgtggtttcaccatgttggacacgctggtctcaaactcctgagttcaagtgatcctcctgccttggcctgccaaagtgctgggattacaggcgtgaatcactgcacctggctgaggaatacctttaactttgagttttgttgttcttggcgggttttatttacccagaaggacaagcatatgccaattttccccaaatgtaaaagagtcaggatactaaaaaatctttagtgaaagccaaatgacattataacatagaatttactataattaaaataccccatggttttgctcatgtcctataacgttttgtggatccaattataaggacattttccagagtgggtttagtatagtgaacttttttctgtattcctaggagagttttttaaaagactgaaactttatgtctgtgaaagtggcaccagatcttgctgcaatactcataatgaataaactacagagggaggaggaatactggtaaatgtgggcaggaccagtgaaaatttaaagccccaattagaatttttgcaacctaatgacttctaacactattaggtttcactaatctacacagtaggctcagcagtgttgtccctatttttccctgaggcctagttcccactagatgaagtataggctgaactggtacttcttgtctccctttgcacaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagggggtaggaaaccacctgaaaacccattgtgtttttcagc

SEQ ID NO: 52522 - DNA, 1029 bp, Homo sapiens
cccgtctctactaaaaatacaaaattagcctggtgtgctagtgcatgcctgtaatcccagctactcggaggctgagacaggagaagcacttgaacctgggaggtggaggttgcagtgagctgatatcacgccattgcactccagcctgggcaacaagaacgaaactctgttctcagaaaaaaaataaaaataaaaaaataaaaaaagaaaagacatagccaccaccctcagagagcttatagccccatctatccaactgttttgttttgttttcttaagtataggactagagagagtatatcttaattaatatttcatttctttactatttaacttttatgatattaaatatctcgtttttaaattaaattaaaattaaataatatgtaatgttaaatatgtttaatgtttaatatttttattggaggaaaatgactattctttgtagtgagaactatgacaaattgagagaatgacaaattgaggcaatcatcccaagcacctatgctgctgaaggggcgacataattgggtgcccactcagggaagcatctagtattccaaagcttattcccttttttcaggaatggcccaataagaaatcattttgagttaaaataattttgaatttaacgttgtagagatttgcctaagtatctaggtagtgtctcttttttaccctctgtcttatccttcttgtgccagaggacactttgatgttctggaaaggaatagctgatgtagggctgatggaagaggttgtctgcaatatacagaaggaaatagaggagctactcaggggagttcagcagcggctcatccaggctcccttccaagtcacaggtaagtgcactaatcctaacagtagcagtgatttattgaatactcacctccgtaggcaggtcctgtaagccttgcaaaaaccctgatgtataggtattattatcttaattttacagataaggaaactaaggctcatataagttaagtcacttgtctaaggttcataactaggttttgaactcagatc

SEQ ID NO: 52523 - DNA, 1089 bp, Homo sapiens
tggcgtgaacccgggaggtggaggttgcaatgagctgagatcatgttactgcactccagcctgggggacagagcaagactctgtctccaaaaaaaggaaaaaaaaattgtttcaaatttatgtaagtagagacaggggtctcactatgttgcccaggctggtcttgaactcctggcctcaagcaatgctcccgccttggcctcccaaagtgttgggattacaggcatgtgccaccatgcccagcctgatctttgtatttatttatatggaaagatttacaaaaatataacaattaaaccagtagtcattatacatgtaataaatctttgttaaaaatgtgttaaaatgcagttaggagagtcccataatttctggttgtttcatatttataaacagcacaatggagagtggtggaacatatctgttttaactggacaggcatgtcttttgttttaaatagatgctgctgttctcaacaatgtagcacacacatttggcctaatggacacagtcaagaaggttttagacaacagaaggaaccaagtagagcagggagaagaacagtttctctatactctgacaggtatgtataagttatcgctcttcttcggtgatatcatgctaatattcttgtcttcccattttcttgttgacttttgttggggtaacttttttttttttaaatagtatcagattttgcttttaaaaataaaaaaaaaagccgcagatgaggtggattgatgagaaacaaaagaggcacaaaggaaaaaaaaaggaagctgccatcatagtcccccttctgtgtcttgtggaggattaagatgtctcttagattgctccattaattcaataacattggtggcagaagacacaaattggtctttgtcttttttacattattgatactgcatcttttgatagatataaatttagcactttctccattatttgtggtaatcagaaattttgtgtaatcccagcactttgggagactgaggcagacagatcacgaggtcaagagattgagacaatcctggccaacatggtgaaaccctgtctctactaaaaatacaaaaattacctggatgt

SEQ ID NO: 52524 - DNA, 1354 bp, Homo sapiens
atcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctcaaaaaaaaaaaaaaaaaaaagtg

SEQ ID NO: 52525 - DNA, 1333 bp, Homo sapiens
agccaaggccgggtgcggtggctcatgcctgtaatcccagcactttgggaggccgaggtgggtgaatcacctgaggtcaggagtttgaggccagcctggccaacatggtgaaaccccgtctctactgaaaatacaaaaaaaaaaaattagctgggcatggtggcacgcgcctgtaatcccagctacttgggaggctgaggcaggagaattgcttgaacctgggaggcggaggttgcagtgagctgagatcatgccattgcactctagcctgggcgaggagtgaaactccgtctcaaaaaaaaagaaagaaatggaaagccaaggatgctgcagctgtgctttggggttcaaggtaatagcttaccttgttccacactttgtcaaagcactcaccctcctaagctaggaccagtccattcatttgaaactgtgcaatgtgatgtaaatggctctggttcttagactgtggctgtcacagggatggggctccaaggccatcattttcattgcatggctccaagagcagggagttcctcaatgaaaccagctgccttttttggtggggccatttttttggctttggaacccaaagcagccactcatttggtgcttcctcttgttctgccctccatccctcaactcttaatggcatctgtctcctagaacccacgctcttcagctttttggctgatttggagaacagtgacaggtgcctgcctgccttcgtccccttttagattcatttataccacagatgtttctgtgagatactgagatcataaaaagctttaggcttggcagagaggactcaacacccccaggctttcctgaggcaccaactagatgtctcttgagtgagctggactccctgggaaagaagcattgtctgcaacattatattataggaaatgtaccaggaatgtcaataataatgctttgggggggggggttattttgttttgttttgtttttaatgttgtttgtatatttagagctgggccattttccgtgctgcgatttcttctctttgaccctcttcagtgtttggggcaagagtggaccctggtttttatttctttgattgcattgtttactgcactaggaaaaatatagagatacagggaaactacagacaaatttaaggaaaaataggtcaaaaaagaaagcacacaccttaagagtgggaggaatatttttattaaaaacaaaacttggacctgtagtttttttttttcttttttatttttaagaaggcacctttcagaagccatgtttcttccaacagatgttggaaaccccatcgagcaagtaaaagttgcattctccatccctc

SEQ ID NO: 52526 - DNA, 1004 bp, Homo sapiens
ttctgaggattcatttttttttcttttttctgttttctgtttttttgagactgagtctcgctctgacgcccaggctggggtgtagtggcgcaatttcggctcgctccaacttccgcctctcgggttcaagcgaatctcctgtctcagcctcccgagtaggtgggattacacgtgtgcaccaccgcacacagctagtttttctatttttttagtagagacggggtttcatgttggccgggctggtcttgaactcctcaggtgattcacccgccttggcctcccaaagtgctgggattacaggcgtgagccaccacgcctagccgaggattcactttcttaatacctgtattttttctctgccctctatcaggaaatcccatgttctgagggttcacctccttaatacctattaatgtattataaaacagttaactgcaaatgtcctaggccgttgagattcccatctctgtaatatcagcaaccatactgtattgagaacgtaatactgataacactctactggcagtaacatgtgcatgaataattgtcttcttccttaccaagaatgtagcagtgcagaatttagggattcttacagtgttaaatattctgaattttcaccccagagaactttggattcatatgatagggaaagttctaatgtaaaatcacctgaaggcgggaagatctcttgagcccagaagtttgaagctgcagtgagctatctacgatcatacctgtgaaaagccactgcgctccagccttggtgacagaacaagatctggtctctaaaaaatagtcacctgaacttcattcagtgctgcaggactggctgtctttcttttctctagtttatgggttcttagattatcagaactatttcggagttaggaaatttttttttttttttttttgagacgtagtgtcaactcttgtcacccaggctggagtgcagtggtgcaatctcggctcactgcaacctctgcctaccaggtgattttgcc

SEQ ID NO: 52527 - DNA, 1010 bp, Homo sapiens
ttcttttgtattattatctctgattccaaagacagttacactgttgtaactaatttaactccccagattaataggccaaaaggaaaactggcaatatatcttccaaaatgccctgaaaggtcaagaaatttataagttctgaacgtatgctgtatgaaacatagttggtagtcctgaataactgcatgcccatatatggatctgattatcacataaaacttgtagaatccctgtgtaaaattttcaacactgaaagtatagaaaccacttgagcaagtgattggaaaaaagttttcacaaaacacaaccagttaatcaggaaaagtagggaaggaagtagaggaatgaactattaataggttcctgctattgaagtagtttgcttacataatcattataacagggagagttggagcatttagaagcataattctaggtagttcttgtaaaacattgtgtaattcaaattttttagcttgagcatgtgggagcctgccagttcaggtacagacattcaactgtgtcttggcataacctgtgatattaagtgcatttgatttttctttctcaggtaagccaaagcttaaatgtctttgtttaaaaaaaatttggctaataatataaatcttagatgagtagatgaggaagggtaacctgagaatctagttcattgtctagagtaagtcatctactttttagccaatttttcattaccctattttggaataatacttcaagtttaatctgttgattataggctgaatttcttatatatgtggatttgggtctgctaaaatttttaaccttacctttgtgagaaattttaaatgtgaaaagggtatgtgtgaaaagacctcacttttgtttttatgtattatttatttatttatttttgagatagagtctcactctgtcacccaggctgtagtgcagtggtgcgatctcggctcactgcaaccttcacctcctgggttcacaccattctcctgcctcagcctcccgagtagctg

SEQ ID NO: 52528 - DNA, 2716 bp, Homo sapiens
ggattacaggtgtgagccaccgcgtccggcctgcacactcctttttatagtatatttgaattgcgtgactaggtggggggaggaaatagcctgatgttaattttttgtgttttgatttgcctttttttttcttccacagaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggtaacccacttcttcttattaagatttttagggaaggaggaaccagagagaacagaagaggtattatatagtgaaccgttaataaaaactctgtaaatgaatacagtatcacctaacagttcaaggctttatagaagtataattggttttaatacttgaaccctaatgtgaaggaatgtgagaacattagtagaggacagaaatacggactttgaaaggaaagcaaaaacagtacaaggaaatcagacagaaacagtacatgatgcagaaagaggtgaagaatgagtcaaagagatgcagaggggtaatggaagtgataaaaccatagaaattaaagcagaagattgagtctataatatggcagagaaaaatcgaaatgttctctgttggattaacttggcctagctggggttttgtggttattttcaagagtcaatatgtcatcaccaactcttgaaatcacttctgtcttccctgtgacaattggcggtgtaaaagagtcacttctgatttcctctgtaacaagtgggaatcttgggcagaatgatgaggaatggattcaaactagagttgaatttgaaagagttggtagcgtttgctctgtgagtattgagtgaatgtaaactttaggattataagaggatgataaaactggttggagcagataatgatatattatctgggatttatacttacttttttttggacagggttctctgttgcccaggctggagtgcagtggcatgatgtccgcccactccagcctccaccttctgggctcaagtgatccccccatctcagcttcgtgactagctgggatcacagtcatgcaccaccatgcccggctagtttttcatgttttttgtagagctgggttttgccatgttgcccaggctggtcttgaactcctgagctcaagtgatctgcccctgcctcccaaagtgctgggattacaggtgtgagccactgcagctggcctagacattgttaaat

SEQ ID NO: 52529 - DNA, 1146 bp, Homo sapiens
aaaccaccaaataaaggcttcaattatacttctgtcaggttactttttagtttactctcttgtaagaactgctggcactggccgggcgcggtggctcacgcctgtaagcacagcactttgggaggctgaggcgggcagatcacaaggtcaggagatcaagaccatcctggctaacatggtgaaaccccgtctctattaaataaactacaaaaaattagctgggtgtgatggtgggctcctgtagtcccagctactcgggaggctgaggcaggagaatggcgtgaacccagggggcggagcttgcagtgagccaagatggcgccactggactccagcctgggcgacagagcgagactccatctcaaaaaaaaaaaaccaaaaaaaagaactgctgggatttcaggaagatgcctatgattgcttctaagcccagttaccattttagttagtactgccttactctcctgttggttactattttccttaacatctttacataactgattgtaaactgttcttacaatctttattaggctttaaagaacaagcaggttttatgagaatggggctcatagctcattgagatggtagactcccttaggtgaagtgtttgtgtgtgtacctttgtagtatttacgagattgcagaagctttcatgccagatgggtggtaaccccataaagaagtagggaagtacttaaacttcatcctgaaggtgtcacagctgttttaaagttccatgattgggcagtatcttggcagaacacactgaagcagagccacagccatttttgcctagcattattactgacttgttctgcatgatctaattaacatagaaccttcaagcattagatctgtcaggcttgaaacttagagcaaattttagtgacatgtttgatagatgtgacttacttttatttttttaaaaagcaatatactgtgctttaggtgtggtttaccttgttgaatactgcagatactattgtgtgacctttctgcgtttatttagaacttttccccagttaagtattccctatgacatcacttttgttggcttcatagtattgtcagacttactataatttaccaatccctaattgttgaatatgtcaacaatttgtattttattttttctaattaaaa

SEQ ID NO: 52530 - DNA, 1023 bp, Homo sapiens
ggacttatgagtatgtccaaggccttgggactagtttgggatttgaatttaggtcagtctgactctaacactctagtgtactatgtatgtatgtattctgctttatctgaccagtcatgtatgtttgggttacttccattaggcccatatttttggggggcctgacaactaagtattaatctaaacagtataataggaaagcatgtaatgaattttcaagtcaaaagtaattttgcattaaggtgtttaagtgtttaaaacaaagtaaaagccagtttttctttgtggggaatgttctacttagaataattaattttctaataattctaaataattaaatttctgttgagttattctgtgaagtttttaaattcataaagcatgttcagataatttttaaccatttcaatttttttcttacctctgtaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaa

SEQ ID NO: 52531 - DNA, 1023 bp, Homo sapiens
ctcagcctcccaagtagctgggattactggcatgtgccaccatgcccggttaatttttttttttttgtatttttaatagaaacggggtttcaccatgttggccaggttggtctcgcactcctgacctcaaatgatccacctgcctcagcctcccaaagtactgggattacaggcacccaaccctgagattttaaaaagaatgatttttaaatgctgtgatctcaggttctccttcccccttgcctggcagatgtctggactttgagaggcagggggctgtgcaaggaaaaggcatgatttcattaacctcagagtcctgggacctcaaaatcaaattggccacacggaatgtcataacatgcacaggaagagggataatcgtgggggtagagcagaaagtctggcttaaatgaacaatttaccatcctctgcaggctatagtggccccattaccggctgggagctgtggggtggaatgagggggtgtctgggttgtgttctactgatttatagttcccagtgcagctgcagaaatcagcagctttgtctctggccaggaagggtgtgtgcagaaagaatcttttcttctgtagtcttttttttttttttttttttttttgacatggagcctcactttatcacccaggctggagtgcaatggtgcgatctcggctcactgcaccttccacctcctgggttcaagtgattctcatgcctcagcctcccaagtagctgggattacagatgtgcaccactacacccggctattcttttttaaattttatttgtttgtttatttatttatttatttatttatttgagacggagtcttgctctgtcacccaggctggagtgcaatggcatgatctcggctcactgcaacctccgcctcctgggttcaagcaattcccctgcctcagcctcctgagtagctgggattacaggtacgcacaccatgcctggctaatttttgtattttttgtagagacggggtttcaccatgttggccgggctggtctcgag

SEQ ID NO: 52532 - DNA, 1243 bp, Homo sapiens
ccccaagggctcggaccgtcccgggagaggcgagaccagggtcgaagggtccagggctgaggggtccagcggtcccgaattccagaatccgaacttggggtccaaaggagtctgggcatcttaaagttcagggtgcagggaggggcgtgggagtctggagagggggtccgggagctcggatccggagctagacacgtccgggtccggccggtcctggctgtctggggcgggggtcctgcattcggtgtccgcgggagagtccctgcaggtcggcgcagcccccggccgccccctagccccgccttgcccggccccgcatgctcctgccgggcccgcagcagcgctggagcgggctggcggctagcagcgggagggggctccggggcctggagccccgcgccccgctccggcccttacgtaactgactttgagtttccggacccaggaaccgacccgccagctggggcgccggctgtgcccgccagggtggcccccccggccgtcgcgccagccccacaccctccctgccaggcttggtctaggggacttccctctgtctgggtctcccgggtctctctgtccggttcaggctcaggttccctctcatctctgggttccctgtatctctcatctgtcgtctctgttttgctgtcttttcctgtctctgtcctctgtctttcctcaagaattgtctcgccctcacctacacttcccggcaggccccacctcttcagggtgggacaggacccctcctctccagctagttggaggcagggacctgtccagaccaacccgagcccgagctcgctccaggagtggggaggagagaggagggttggggaagatgattctaggacccttagctcctgggtccgggaacggacgaccccttctccgcctctggagccctttcctccagaaggaggaggcttggacagaacctggctggggctgggcttagggcaactgggagtccctgtgagagctgcctagtgtctcgtcagggtcaggtcctcagctattgaaggggagcgggaggggctggggaggggccagagccctggcacgcgccccggagcttcagcaagctccctacctccacccagtttcaggcctggaggatggtcttggcaggaggctgggtggggaagggatctgcaggaggaggctcaagggacttctgcatgttggggaggagggtggagatagaatgacagacccgcaagtctaaggagcacctact

SEQ ID NO: 52533 - DNA, 1111 bp, Homo sapiens
gagagaaaggggcagagggagcaacctccaggtcagccagggcccactaggggtttccccagaggggcagccccacgcagctactgcccaggtgcaagactgggcactgaaaggcaaccttgggtatgtggccaactttggacctcagttgcctcatctgtaaagcatggacttaaatgagtgtagacactccttgacccctgggttagtggctgaggtcagcaataggataaagggttagaggagagcttggagtgacagtgactgagtctgtgaaggaagagtttgggtcaggaacatcttggatcctgggccagctgtttgatagctatttcagaggaagagactgaggttggagaggttcaaaggcttgtctggggctgttcagccagtaccccagagactgaagggaaataaaccaagggaaaacccggagaacaaaatccaggcagatatgagctagaatcctgggttggccacttaactaggcttggaggtgtgaagtggcacccctgaggacacacgagagtcccttcacctaactgtcctcatctttaaagtgggaatagtaacaatttctcctttgtccacttcctgggttgttgtgaaggttaaaggagatgaggcatttgtaaaatcaggtgagaatgtggttgctggtcatttttcagtccaaagctgcagttccgggtttgtgtttgtggtggtgggagcatttctgacagctcctctgttgagatgctttatccaggagttgtgctggagagaagccctaagaataacaccaccggccgggcatggtggctcacacctgtaatcccagcattttgggaggccaaggtgggcgggtcacctgagatcaggagttcgacacagcctggctaacacggtgaaaccccgtctctactaaaaatacaaaaaattagctgggcatggttggtggcaggcgtctataatcccagctactcgggatgctgaggcaggagaatcacttgaaccgaggaggcggaggttgcagtgagccaagatcgtgccactgcactccagcctgggcaataagaacaagactgcatctcaaaaaaaaaaaaaaaaaaaaaagaataacaccacc

SEQ ID NO: 52534 - DNA, 1040 bp, Homo sapiens
taaggcccaaattcttagtgtgaaactctcatatttctcccaaggaggtagagtgtacatctgaattctctttgtccatctcccatgaccagtacacggctggtgggagctactgacgtgtttgtcggataaataaattcatgcacacacactgcacccccacccaggcctgctgctgtaagagttttaaagagaaaagataatagaaaacaggagaaggctggacagcttggcacttgagggtcagacaggcctgactttgcatcttgcatctattgtttaccagttgtgtgaccttaggcaagatatctaacctcttggagcctcagttttcttacctgtaaaatggggaaaataaaagaacctacctacctcttaggcttcttgtgaggattaaatagtgaggcacatggtgagcattcaacaaatagtagcaatggttattgttattattataattatgaatattatttggggattataaagatgttcctcttgggacaaaagagaccaggtctgggagggaacttctggggacaggtggtggatagcagcctagtctgacagactcctgaaggcatgtgaagggagggaggtggcctcatggaagtaagaatgtacctcccttttctagtcatctgcttttcctctgtgtcaggccctgtgctgggcatggggcccagagatgaatctgtgtagtccttccccaccttccccaccgggagctcggagtctagttgggaagaagatgcagaaatcaccaactccacctttattgaataggtgttcttatgcaaagggcaggaaaaaagacattcctagtggaaggaacagcatgtgccaaggtacacaactgcctgcacttgggggaatgcagctgaagagacaggctcaagacaatgagtgaggacttgacctatggcaatggagagtcactggatagtaagcagggaggggcagggacaggggcaggaggaactgtccaggtgagagatgccgagatcttgggctggggactgtgccatgggataaggagcagc

SEQ ID NO: 52535 - DNA, 1024 bp, Homo sapiens
actccctctctcttgccctccttttccttgccttgaaagtgagaataagaaaacctgttttgcttgcctcgaagattcagtgataaaatacaactacagacagtaaacatttattgagagctgatgggctaggttctgggggcacaaaggtgactcactcagtgttcctgctccttaaggacgaactgccatgtgcagagtgagcccaggggagcaggtggttaactcaggggcatcaaggggaaaagagctaggttgggctttgaaggatgagtaagagctctctaggtaggcaatggcaggaacaactttctaggtacagggaatggcatgtacaaaggctcaagactgcatactgtgctcaggatagatgagcactgtcgttggtgtggctggagcacaaagggaaaggctggcagtgacaggagatgaggctggtcagggaagtagggcccacgtcaggcagacctttggggatgtcactggctcccctctccttcctgcaccctcacaactgcctgttctgctcagagagacaaccaggaccttcccatgctgctcctccccttgagttcccaccttctcccctcatcttcaccaccccagccagatcaagtggctgcctctctcaggagtcaataacctggctgccctgccagccctgccactgaaaagccatgtggcctccagtcactcacataccctgtctatctcagtttccacctcagtgaagtgggaacagcaggctttcctcccagagaagggcggaggcttcaatgagataatctccacaaatggcctggcccagtgtctgtatatattgggcacccataaacaggagctaattaagccatcattatttagactcctcaatctccttggccccacccactgcttcccctttacctctcctggcagcccgttctagccaagaaaggaaggaaaagattaagaaacaagcccaagtcttcagaggggtgctggcccactgccaagctggctcccctcctgccccttgcccgcc

SEQ ID NO: 52536 - DNA, 1251 bp, Homo sapiens
tgtttccttgttatctaagaggcaggacagcataagtgttgccagtgtatttttgtttttcttgtcttttctgtctcagcctcctgagtagctgggactacaggcacacaccaccacacccagctaaatttttgtatttttagtagagacgaggtttcaccatgttggccaggatggtctccaatctcttgacctcgtgatctgcccacgtccgcctcccaaagtgctgggattacaggcatgaaccaccacacccagccaatggcctgtatttttctgagtttcatcaagtttgtgtttggttaaatgcatattcagatgtggattcattgctacctctatatttgaattttttctttaattacttgaacatggaatcactttattttgtgagctaaacaacaataattccaataacttttcttatgaataactttgtttttttcctctaaataaagcccccaaagatggcctctgaattaatcagttatgggccttatgtatgtgaaggatccaaaattattgaaaagtaattgctagctaggtgcagtggtttatgcttgtaatcccagcactttgggaggccgaggcccacggatcacttgagcctttgagtttgagaccactgcattccagcctgggcaacagagtgaaattctgtctcaaagagaaaaaagaaaaagtaattgcttgattgcatttatcatagcatttagttagaggagaggagaggcagatgccaaatgtatgttattttttgttgttcatttaagtttcttggtatgtcactggtggcttttactgtgcgtcctttttaagagtgggttcatggtgtgtttagtcaaatgcaatataacttactctggagtgcacactgggttagattagtattttgatttactctgctgctatttaatgaatacatagaaagataaagaagaatgctgtagcagtgaggagtattcagaacttggaggtgttagaaaggagaactttgatattttatattgagtgctgatctcatttagaactacccaccttactgacactttgcttcaaatattggttttgggaaaatccgattatgatgaaagtctgtttatacttattttgctgattttttatttaaattgaattgtatccacttaaaatatttgaaaataaattggctagctctttgaactttggagaacagcagccagtataattcaaggagtagcttgaagagactttaatatcccctacccgcta

SEQ ID NO: 52537 - DNA, 1463 bp, Homo sapiens
agcctcccgagtagctgggattacaggcatgtgccaccacgcccggctaatttttgtatttagtagagaaggggtttcaccatgttggctgggctagtctcagactccctacctgaagtgatccacctgcctcagcctcccaaagtgctgggattacaggtgtgtaatgtaatgcctgtaatcctagcactttgggaggccgaggtgggaggactgcttgagctcaggagtttgagaccagcctgggcaatgtagcaaaacccaatctctaccaaaaatacaaaaaaattagccgagcatggtggtgtgcgcctgtagttccacctacttgggggtctgaggtgggaggatcacttgaatctgggatgcggaggttgcagtgagatcgtgccatggtactccagcctgggtgacagagtgagatcgtgtctcaaaaaaagaaaaaaaaaaaaaaagaaccagaatataatcctgtttataaatctttaaatttggaggtaatactttaccatctaaaattgttcttactaataatgatataaactgaattatgctataattgcccttattccagtgaagtctctgttgttacttgtttaattatctggtggtgaaaattacatacagataatatgtgttcctgaagagaaatgcacctctgacataattctcctccttttatttggaggggtgggtgttatatcgataaagacggtgtatattctctttattgatgtccttgtcacataaaggagttcagttaatgtttgttaataataactacttggtatctgtagttgagaggttttaaatagataatttttaaaatgagctatatcaccaaccccaaatagtgttaaatgtaacttttatactgcaaccatagcatcaccctaagggaaaaaaaggagtttcataactctaaaggaaggaaggtattgtggagcagtgaatatattaagtataagtgtttaatattctgttttaaaattttctttaaattaggaaatgggccaaagttaatggattgatgtggattgtgaggctaacgtcagaatactgtatattagccactgaatatttatttctcttgtgtattttggtgggattccttacataggtttggcaacaaaactagaaaataaatttcctttcagtgatacaaaattctgttgggctagctgaattagattgacattagtcaagatttgccagaaacattgtagtagtgctggttaatatagcctggttttgcaaggtggcctcagactgctgttatacttgtgaactagccagagtatcccaactgtgataggaaagtagacattgtatgatgtatgggaaattcatctttgaaaaaagtgagtttatgcctttcagatccatactgtgaatgaatgaatataagagtgaaaacgctgctgacaaagatttggatatttgataacgtatacaattttatt

SEQ ID NO: 52538 - DNA, 1051 bp, Homo sapiens
ttttttttgtatttcctgtaaattatttgaatttacacataattgaatcttaaaattgagaaggaaaaccatgcgggccttttgctgtctcaagggttgcagttaatcagctgacttgagaaatccctgctgcccagggaccagatgaaacatagacaagatggcatgttaactttggatttcttgcctaatctggacacatttgtgtttaaaaaggaagcctggattatgccactgcactccagtctggctgacagggcaagacccggtctctgaatgaatgtatgaatgcatacatgcatgcatgcctgatccaagaacctgatgaattgaaccgttttccaatgaaggtgacattagactaatttaatgataagacaaaactaaactttttttagtgagaaaaacatgctttcaatttatttgtattagttagatctcattttcatcttacgtagttaataaagaatggatggacaccagggtccgaagccaaggttctcaaagttaagcatttatcaaaatcacttggaaggcttgcagacagattgctggacatcatccccagagattctgattccatatgtcaaggtcgagtctgagatttgcatttctagcaagttcccaggtgatatcagtgctcctggttaggggaccacactttgagaactattaggctgaagttcaaggatctgcattagaattacctttggagctttaaaaaactcttgaagatgccagtcagaggcctctgcatctatattttaacatgttccataacaattctaatgcgcaccccaggtgagaactgctgctgtaattatttatagtttattcctccatatttcccaagaaatgctcattcattattcatttcaaaatgttaaaagacttctaatattgtttaggcacatggttaggaaggattcattgttttatactgtgctatttatcattgttgtagagggcaaagtaaaagaaaagtgctaaataacaaagagctattggcacctgtcctggaaaatcagtattaatgctcttgcttgctgca

SEQ ID NO: 52539 - DNA, 1061 bp, Homo sapiens
aacccgggaggcggaggttgcagtgggctgacatcgagattgcgccattgctctccagcctgggcgacaagagtgaaactctgtcaaaaaaaaaaaaaaaagaaaaaaaagaaaagagtttgagaccagcctagccaacatgtttggcaaaaccccatctctactaaaaatacaaaaattagccgggtgtggtcgtgggcacctgtaatcccagctacttgggaggctgagtcaggagaattgcttgaacccacgaggcggaggttgcagtgagctgagattgtgccagtgcactctagccagggcaatagagcgagactccttctcaaaaagaaaaaaaaaaaaagaaaaaacttgaaggagactaaaggtcagggttggaggggaaaataaaatgtggatgctgtcaattaattctggttgtagctatctactagtctttatagaataatataaataaccaatgcttacttagcatttgctgtttactaatatatttacatgtattaactcattttatcttcacagtaacactatgaagtaggcactactaccaatatctcattgtatagatgaggaaactgaggtacagatttcctaaagtcactcagccaggaagtagtggagctaatattcaacccaaatgtcagggtccctttttgtctgctcaaaatcactatgctttgtgaaattaatgcaaagactatcaaaggaaatgcaggttgatctggaggcactatttgaagatagtcagtgatcttgcttccagtactctgttgtttatgtgttttggagctctgtgtgaatgccttttctcctttttacagacatggctggattccgccaaagaaataaaaaagcaggttcgtggtaagtggatatagctctttttatagttctttctttcttttagtaggtcagaggatttccaaccatttctggctgtgagtcagtcactttagaatcctgactactgcagattgctttgaaatcgagataaagccttctcctggaaggaggagattccataatagaaaaatatagcagaggtggatactatt

SEQ ID NO: 52540 - DNA, 1413 bp, Homo sapiens
ctctccctttctgtttctccccttttctcctttttctctctttatattttgttgttgttgttgctgacataacatttttctcttttggctgtagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtgaatatgtctccagggtttgttcggtgtttgttttggcgattagtttaaacacaacatggtattggttcattgtttgcctaagagggatcatggtgccatagaaagagtcagtttcctccactgtttgactttgggcaggttacttaacctctcttaatctaagctttctcatcagagtaataggcattgcattgtagggtgaaaactaaatgaggtaatatatgtaaagcacttagcacagtggctggctcagtgctcagcaaatggcagctattattatttttgtttccttaccttttattttttatcagatttaaagctaattatgctgcattaggtaccttgagatccttagagcaggggtttttaatttgagatctttatacatggatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcaggtttcttatatttctgatggagattatcacctcagagaaactagggggactgctaggtttagaaaaggtattgtgggctgaccacaatggctcgcacctgaaatcctagcactttgggaggccgaggcaggaggataacttgaacccgagtgtttgggaccagcctgggcaacatagcaagacctcatctctacaaataatttaaaaattagccaggcatgatggagcactcctgtggcaagtagctgaggtagaaggatagtctgggaggtcaaggctgccatgagctgagatcacaccattgaaaggtgatgtgtgtaaaatactgaatacaatgtcacaatgtctttcatgtggtaaaaaattcagtaaatattagctaatattaaagtgccagaataatttgtgtttcttcctcctcatacattcattgttacttgagtgacttgctatagcttagttctgtaaactgccttagcatatt

SEQ ID NO: 52541 - DNA, 2065 bp, Homo sapiens
aactccctacctcaggtgatccgcctgcctcggcctcccaaagtgctgggattatagacgtgagccaccgcgccaggcctgatctctccttattttttaaagcatgcttatttatagaagcatgtaactacatactgtgaaatttaaatctgtattcaaattgattgaccctattaatgtcccttagggtagggtaggaggagtgagtatagggaagattttatcataattgctttacttaatgttttaaaatttgtcttcaaattcaagtgatccaaattgtgtctcttaattttatgatttgtgtgtagatgaaccactggactatcagaaagctaaggctgcaataataactattcatgtctataaagcagttttacaaccatcatctcatttcgatcccaatagtaacattcattcattcagcaaaaacaaagtcattgcctatcctagtatctagaaatacgcattattatgattctcgttttatagaggagatggagggagacactggctggccacttacaagtactgaagcctggattccagcccaagtattgtgacttgagttttgacttaagtctgctgtctcaactaagggtcctaacttgcctgtggtaatgtgatccctgagaacctgtttcttcaacagcaaaatgaaattattgtactctttaaacttcaagctcctttccagcttcaaaatcctaaaattcagcgggagtggtggctcacgcttgtaatcctaccactttggaaggctgaggctggaggatggcttgagcctaggagttcaagatcagcctgggcaacatactgagaccccctctgtacgaaaaataagaaaactagctggacatggtggcatgcacctgtagacccagctactcaggagtctgaggtgggaagatcacttgagcctgggaagtggaggttgcagtgagctgtgtttgcaccattgcactgcaccctgggtgacagagtgagaccctgtctcaaaaaaaaaaaaaaaattctaaaattcatctcgtcaataacagtaacaacaacagaaacataaaataggagtaatgttaactagaaaaaaatgtaacttagatggaaaaaaattaaaaactacaaaactttcctgaaatgtttttaatgacttgaatatacagacttgcataaggggctaattttcccattctcctttttttaatcttcaatttcaggttcattaataaatagaattaggtgtgatgcttcagtgcttgtgaaaataagtttgttcatgaaggctaaatcagtagcaaatctgcaccctgtctcctgttgtatacatattttggtggttgttgttccaaggaatcctttgtccttttaattagggtaaagacagatggatttggaagagacttttccttgtgaaatgaagagacccctgcagctttctgtagcttgaggcagtcttatgggaaactggcgtttactgttttttccttggggatgtgcctgcattattgttactgttaagttatacttgattggtctgaattgtgcagcattaggagtgatatttttgtctttgaaagctctatataacagctcatgaacacttttcaaaagacgggaaatttatagaggagaagaaaagactgtcacagcgagtgtttagacagtgagactgactgttttcaaacaaatctaattcattatatgcctggtaatgaagacatattaataacagagaaaacagccccattatctatgtgcttccgtgaaccagtttattttgtttatatcagtgggcaggacaccatctgttaccagaaattttcttttcatcaagcctgccccgattaagagtcctcagttaagtaacatcagctgccctcttgtttaatttccataactcaattcaggggtatggagagaaaaaggcagctataagaggatattgtaaattacaccatgccctctgaggatttaatttggtcatctccttggcaagaaaaattagcgggaggagcttatgtatgtcggagaaaaagagtgaagagaagggggcagaactaatgataga

SEQ ID NO: 52542 - DNA, 1267 bp, Homo sapiens
aggcaggagaatggcgtgaacccgggaggtggagcttgcagtgagccgagatcgcacctgcactccagcctgggcgacagagtgagactctgtctcaaaaaaaaaaaaaaaaaaaaaaagaaaaagaaataaccccaaaccgttaattacccctggtagttaaagtgctgtaatggggtgtgcttaacttaacacttgacagtgtcactaattttggtgctctcttaggttttttagactcagtctagggaaaatagcacaatgacattatactccaaagtaatgctgcttagtgtgattaaaaagaatatcaacaccacagattgatgaggttctgtaaagaacttaatgatacaaagtgatttagcccttagtaaaaataatcaattttttaatttaaaatatccaatgctttgggcattgctccctctattatgctccctcttaatagtctgttttttttaaataattgctccattttctatgtataaaatgatgttactaaaggtatttcaaagctaggcaggagaccttagctattccctttctgctattaatatcaaggatgaatcttgcccttctaccaaacacataggctccacctccctagaggagattgcagtgtgttgaatgttgcagctgaatcctgcatgtgcttgtttataagccagccctgggagtaatttcatgtgtcagttacaatttaaattgggtttattgtaatgttttgttgtgtaataaactgaagaatgaagtgcctctttaagtatattgttcaactaacaaaatcctttgtgtttactagtttggtgtcatatgtggtttattacatgtgtgttttaactaaagattttctttttcttcctgtcatatatgtcatacgttgataacttcatatgtaaatttgtttttaaatgttatttaaagtatttccagatcagtttttaaaggcaaaacaaaaacatgggctattgcattaaataagcctaaattattcttttagtgggtacttttttataaataagtataaaaatatattttcttcatcaatagaatacttaccttaattttcttttttgataatttggatatccatattaccttttcagccttgaaaatgtgatggtaaacacagatgacttttgggagtaatatccttccctgtaacaccctccataagactgcatcatgatgattacgtatcagcgtatttcacaaccagcttaaagatgcagcttatttggaaacaacactattcatagaaacc

SEQ ID NO: 52543 - DNA, 1453 bp, Homo sapiens
gagttcaagaccagcctgggcaacatagggagaccccatctcttcaaaaaataaaaataaattagccaggcatggtgatacactcctgtggtcccagctgcttgggaggctgaggcaggaggatcacttgcgtccaggaggttaaggctgctgtgagccacagctgcaccactacattccagcctaggtgacagagtaagaccctgtctccaaaaaaacacccactgtagcagcaactcccagtactgtgtacagccgacttctctgtgcctcattcttttcatctatagagtgggatgaatcagtctgaatcagttaactgagtatatttattggctgatcatgtataaaatgataatctttcttagatcttttttataaaagagatctaatcttttattagattttataattagagatctagatactgcagtgtcactaagtataaaatacatcccaaaagctaaataatgtttttaaagcatttcttcactccatgatacatggagtttcagcgttttttagtcatatattttaaggtaaccctcaaacagttcaatttcaaaaatgaagataaaacagcttgttacataagaagccaatgaagccaggagcactgtctatttaaataacatcatcacattctttcatcattcatgaaaaaggtcatcattttcttgtggtaatcatgttctgtgtccgtgtgactctctgaccatttcatgttggcatatgctgcgctgtggacatttatttttaaatattttttggtttgccaattttcagttttttcccgcaagaacaacattttaattttttatgcttttctgttttcccccctttcattttcacagaaaaagagagaaagactagatggtgaaaacatttatatcagacatagcaatttaatgttggaggtttgtatgaacttgaagcttatttcagttggttgcctggaaccttctgcattctttgctgatccccttttcttcattctgtgctgcatttggttttgcatgcaattgcatgaagggactttaggtttaaaatgcttttgcatgttggtgaacatgaagatatgcaaacatctcgccttctgattctttttagtttctatctgtcatacttacctggaaaaatatatgattgggactacctctacctctcatggttccattgttttacccacctttagaaaattctacaccattgctaaaagttcctttaattttccaagagtataaacttccatatgtcccaagatgcaaatttgcactattctttcattttctgaattaagagagtgtgaaaaagaagggaattcagaatggacttaaaatattggagataatagaaaaatgacagaagaactgtcggggaggggcgggaagtaagatataagaaggaaagaggggagcctagcatttaataagtagttactataagatggttt

SEQ ID NO: 52544 - DNA, 1037 bp, Homo sapiens
agtaccggggttacaggcatgagccactggacccaacctaaactttaaaaactagatagacctctggcttaatatatagcctctaataattatttaaacctcatcttattccttgtcaatacctgtattttgagtacttgttatgtataaagtctctgagaaaaaaatatgcccagccttcattaaacatgtattgcgtggtgggtgaaataccaagtgctttacatatctttgtctcatttaacatgaagtttttcgaggctggaccctcagatatttcaaacttggcaactggatctctttgttttagcccatatctgaaaccagacctgagtagttccatcttcagagactaggaagaatagtgaaggtcagttgatttcctttatttggcagtgtaacatcttgaaattctaaacatgcatatttcctgactagttcgtcttcagtgcttcctcttaactggaacctgcagtaccaatcatatatttgtcatttgttccatgaggtgtgttatggcttctgagactcacaaagtccctgtgtgtgatgtgtttttccctcagcatttcattgacagccctgagaggggatttctaaataagtgtgtttggaaattaaaaccactaactgccttttgagaacattttatatttaatgaagtgtttggtttgattgctgctaaaattatgaagtgataggcatcaaaaagtgtctaacctgaacacagccaaagtaatttggccatcattctttagaagttttttcccctgtaaggaagttctctcaagttatctgtcactccagcaggtttttttttttttaagcatccctcctcccccttctcctaccccgcccccactaatgctttgttctggcacaaataaggtcgagttcatttttagatctaccgcctcctcctccatctcccagagagaacctgtagcaagttgtctatgacaaattctatttggaacaggtccctttgagatcttaattttactctgtgcccccacaggttttcaacaaagccagct

SEQ ID NO: 52545 - DNA, 1687 bp, Homo sapiens
tgtcttcaagttatatttaccatactatttttggccaagtcccctttttgaaagttgttatatacctccttttacataaacctgaatattatttctaactcatgctttattaacctaagcttcattcatttctccctggaatatccctttaatagcttgcctgtacctcaggttgcccagtattcaaatttgctaggatatatacctactatatacccacaaaaattaaaaaaaaaatttaatctgctggaacagttgaattattttaaattgtcaaggagatatataaggtatttggtgaactcttgttaactcactctcaatcctttgaaggttattgcaagaagtccctgttttgagctgtactaagtgatgaagtgaagctgttagaagctagaaagcctaaggcgtttagtttatgtgcatattgttgacaaagaaaaaaagtcattttattatgtacctctgagtgatttttcagaggtagtaacagtctgctctggagcctttaactaggaatttcagtaataaattcttacatcaaaaaagggctattcttgttttttaaaaagcagaaacagccacctagtaatagagaagtaaaaccatctccaggtagaaatagaaggatactgtatgtttgcaactcaacaagacaagacagccaatggtggaagttgtatgtttcaccatgccttcattaaacagtttgtttatctgttgctatctccatcctcctaagctgagcctaaaataatttcttatcaagctgaggctaattgagttgtggaactaccttcttgggatgagaagttagagatctgctgctgtgtcataatgggaagaagaatcataaattaaggcgtgagttctttatgggttatataactgctaacagctatggagttgtgatacttcacagcttctaagaaaagcactttatttaaagaaaaaaaaggcaagcaaatataccatgttgtatatttataatctgaatgcagattagtaacatctgtcctggatgtggtatgttttctaccagtgcccagtctctgacgggttgcccttgattatgttctttgtcctgattgtgtattgttttgcatctttgtcctttcaactgtaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggagtgagtactttgtccacatgaccaattgtgaaaatggagggaataaatgtttttatgtattaatattctgtatctgagagaaagcttagagctgaaatttggatttggtgcctcactatattcattgctgctttaaggcatttgtaatcaaatatttatttttttttaagtcaggtaggctacccagtgcaattataggagctatttggagccaccagtagatgattagcctctgagaactgtctctgcagctacatgcttctggctaatgtatgtttataaactgaccataagccagtagaggtttatttgtattcaaactgtgccttcagggactagaaagtttactaaatttaggaaggtcaaaataggaaagacattagt

SEQ ID NO: 52546 - DNA, 1629 bp, Homo sapiens
cgcctgtaatctcagctacttgggaggctgaggcaggagaatcgcttgaacccaggaggcagagattgcagtgagccgagatcgcgccactgcactccagcctgggcaacggcaagactccgtcttaaaaaaaaaaaaaaaaaaattggttcacaaagggtactttttgtatttttcaaagtgtgactaaaattggctaacagttctccaaacagagctgaacagtttcacaaataaggctggagaatacctgagtaatgggcagctaaatagagttaccagggatgacaggacgctattgtttcctactcactgtcctctcagcctccattttctgatataaatggactttagttttgtgttctaaatctagagcatgtatcctgaactgagacaataactctgctttctaggcaagaccactgttttcagtgtcagtaggatacttaattttgatgtatctgtagtaacaagagtcataaagggtctagtatttctggttgtggcttgatttgatttagagggtctggctagtcaaagcctaaatgaacaattctgaacaagtaatttatcatattgggccttagtttatggagtagatgatctttaaggtccctgttaactctaaaattctgtaagtctgtgactccataagaaaatgccttgtcgctatttcacccagttaaccctatctgcaaactataactgcgtattttctagaagttttctttttgactctgtgcaagtaataaaagatactcgactactttgaaaaagtaacttggtcctctcttggatgaggctgggtaaatttgaattagtctccatttccaggaaatatcttacatcttttaatagaaacctttcagaaatcttctcagggttggttttgggaatggtgatgtcattctgtgtactttaaagaaataactttttataaactaaacaatatccatgggagtacttgaacaattttagctctatgctattacccctgtaaatgaatagtggaataaataagcactgtattatggtgacctttaatattgggtaattctactttctggcatatcttactttttctttaacaattgggatactatttccattctctggggatacctcttccacctttgacggtattgttgttgcattgcaaggcaactgaattttatataatttgtgtatgaccaggtgaagaaaacttctgtcctaccctcggaaagaaaggttggtgggccagaggtaaagctgctgttatgacttgtgcttctcaatcagaatttgctcttgtcatggcactaagcagataatccccccagaactgaacaacagctgctgaatacctttttttcttttggctatactagtaaattcacacccacagcctttcggcctaacacataacacttccactgctgcagcttttgcagctttcgatttgcttatttcggcgcatggctggttgaaaagctgcatgaagatataaatatgttttcagagagaaaatgaatttaattataccctattctttttatgttgtctttcttctcccactttattttctttcaaaaatcatcataattttgcatcctttcttttcctttttttcttttttgctgaccagtc

SEQ ID NO: 52547 - DNA, 1032 bp, Homo sapiens
gtcattataggctttcccaagaaatggaaaaagaagcaaggaccaggttaaaatttaaaatttggtgtgcgtatatatcttttatgtcacaggctatgtctatttataatatatattttgtaaataagtatatttattgattcactcataataagagggacctgaaatattacaaagctgttctctaccacagaaagtaataatcatgagtactctcttttatctgggaaataaagatacaagagtttcccttaatgaaataacaaattggactatagaattggttagattattttaaatctttttttaaggaattaaaaggaaataatcagaactttatttatacttttataactgtttcagattataattcctgaatttccagttttcatccttatacacagctttttattaattactattgtaaacttcaccctgaattttatttctctttgtattggagttattccaagtccattaaaagtctaagccaatgatacttttcagttttctgaaatgcagcaagagtcctcggagatctttattgagagtcaaaggagaggccatttcttctatcaatagggtaagaatgattaagaggagaatggccaagcccttgtattggatgaagctgaccaatgcagactcaaaagataccatcacaattatcagaggaaaaatattgggcattccagctttgtattacctaaaggtaacactgccaatatttgcaacataaagcgtaaatgggctgggcgtggtggctaacacctgtaatcccagcactttgggaggctgaggcgggcagatcacctgaggtcaggaatttgagaccagcctgtgcaacatggtgaaaccccacctatactaaaaatacaaaaattagctgggcatggtggcacacacctgtaatccgagctacttgggaggctgaggcaggagaatcgcttgaacccgggaggcagaggttgcggtgagccaagatcacaccactgcactccagcctgggtgacagagtgagactctgtctca

SEQ ID NO: 52548 - DNA, 1557 bp, Homo sapiens
gtttatttccatctactccttattgatatttgaccactttactaattttccaaatttatccttctcttaataaattcatcttatccaaatggtatgattagagtggatcatacttgaaaataaaccaagcatctatattttgggcctctctttcagccagtttctttcatgctaacacttgcaatatgaagggaattgtttgcatgggtcaagttttctacttatttacatcttcagtaagagttttgaagggaaaagatgctgactctgttgattaagattagactggatattatacatggaatagatttccagttggcatcctaggacctggtacatttctttctattaaatattataaattttactctgaaacttctttggatataataacccaattcactttctcctagtttcctaagtcacttctgtaatacttcttatagataagcctgtagtacttcctatagataagcctataggacacatgaggcattagagatctaattaattttaagaaggtattatggagcagaaattacacttgtgctttacccagtgatcatgtatttacaaaaggaaaacagggcaaaattaatatgagacatggtctcattgttgcttttattttttcggcaagggttttgaatacagtaaagacatacaaaatttgttgacagagttgccttcccttatattcctcttcacaggaattataaaatcccaaactatagcattctctgcagctttgaaaaagactattatattgtttttattatacatagaaacttcacttttttttcatatactcaaattacaccgtttgtaatattggtactagaaactacaacaacttcttattaatctgttttgtgtggcatgtagcattaccatatctgcttcctctacactttagtggatagtattaataggccactctcatttctgaagctgttactcctcatgccttagtatctccttttactgtagcagaatatgacacaaaaagaaacacattggtgcagatctatgaaagcatacctgaaatggttaagaaggtatgggattagagttaggaagccatacaaagttaggctagaggaagagcagtggctatgatcaacaattataaattcatggaggattccttttggtaaacaaaactcctatcatcctagaacttgaaagacaaaaggaagataaagtagtttgttcccacatatcagaaatgcaggctaaaagccaaataacttgaataatagcctaactaaatgtatagataacattgtggagaaaacacactttaggaattttaaaaatcttttgtgtgtccaggcgcggtggctcacgcctataatcccagcactttgggaggctgaggcgggcggatcacaaggtcaggagatcgagaccatcctggctaacatggtgaaactccgtctctactaaaaatacaaaaattagctgggcgtggtgatgggcatctgtagtcccagctactcaggaggctgaggcaggagaatgacatgaacctgggaggcggagcttgcagtgagc

SEQ ID NO: 52549 - DNA, 1056 bp, Homo sapiens
gaacaagtgactaaatgtgtggggataaaattactacacaggtactcatacatggctcttatgtagcaaaattttagaaaaattttcaggatatattttcactttgatctcttaaaggataagacactcttgtaagcttaactgtggttcttttttttttttttttttttttgagacagagtcttgctctgtcgcccaggctggggtgcagtggcacaatcttggctcactgcaagctccgcctcctgggttcacgccattctcctgcctcagcctgagtagctggaactacaggcgcccgccaccatgcccggctaattttttggagttttagtagagacagggttttaccatgttagccaggatggtctccatctcctgaccttgtgatccgcccgccttggcctcccaaagtgctgggattacaggtgtgagccaccgtgcccagccaactgtggttcttttgatagtctcttcaaatatgtaaatccttacttcaaaaataacctgaaaagaaatagactctggattgcatttgttggagtggcagcaaaatacctataaaacacccatatcctgctttttttttgagatggagttttgctcttgttgcccaggctggagtgcaatggcacaatctcagctcactgcaacctccacgtccttggttcaagcaattctcctgcctcagcctcccgagtagcagggattacaggcatgcgccaccacacctggctaattttgtatttatattagagacggggtttctccatgttggtcaggctggtctcgaactcccaacctccgatgatcacccgccttggcctcccaaagtgctgggattgtaggcgtgagccactgcgcccggcccatatcctgcttttaataatatctggaattcataggtcaaaaaaggggtaatttataactcataaaggcatatatataatcagggtctgatgattctgagacataatccctttgcataaatagtttttgagagaaagcctttaggaaaaaaaatcttgttttcttccccaaaacaaagaaaatact

SEQ ID NO: 52550 - DNA, 1052 bp, Homo sapiens
tgtgctataaatggtaatccaacccaactgttatgtttttcttttatttctgaagactagtacatgttaggtgctcagtaaatatttgttgagttgaaattactgtggctagggcttttatcattgttgtcttctacacatgctttggaaaaaaagagattgttctgtctaatttaactcagcagtaggcaagtttgggtcaggtggtgctggcctaagtaatgtttagttcacaaatagcttcttgatgacagactactacttatcacttgaacaaactggcacaaaattggctcttacttgattatcttaggtatttgtctgattattaatcagccttctcagttgtgacaaattatttgaagaagcccaaagttcctctccatgtgaatgggtttagatagctattcacaatgctaggactagcatgtagcaatttcagaaagcctatttgtttaataccagctgatctatttttggacagctctatagccacttgcctgactcaaaagaaacagtgagataagtgccctggaaagtagcatagcatcttaacaatatgacaaattcattctagtgtcccccagaccctaggacattataggtgctctgctcattggttggttgaattaaataagtatagtactttagaatttacaatatggtttcatatacagtatattattgtattttatcttcagaaccctataagtcaaaccaagtattattttcatgttaaatatgaggaaattcatacattcttgtcaagaataattgctgtatctcagatacatttgcagacagagacagccttgttgtcagtctttcagttccatctttcatatcctaagtcatatttgttatcagccaatgaaagatctacctaatatgaattcaactagtgccagtttgagacgcttttgagttgcatgtttcaaaatggcttgggagtgaagctggcctgaagttcctgtgttcagtgtgtctttccttgcctttatggagccctggttaatattcatcacaatggaggctggtttacaagttaagga

SEQ ID NO: 52551 - DNA, 1029 bp, Homo sapiens
taatacctaataaaatataaatgctatgtaaatagttgttatactatattctttagggaacaatgacaagaaaaaagtctgtacatgttcagcatagatgcaattttttttccagatacttttgatccatggttggttgaatccatggatgcagaacccacagatacagagtggtgactctacttgctttagaactgtttttcctgtggagtgaggtatttggcccaggagggaactcttgtgtttccggaatttatttctcttggaggttggaggtgttgtgtcattcatctgtgaagaaatacatctcagctgctgggtcattttaattgtttacaaagaaacatttcaccatttttgatatcatgtttgatgccatgacagtgattgaagtaagcctgtgctagatgtactcaacttctgtctccctgacaactagtctagattttagcttctccatgcagggctagtgtgaggatacatacagtttggaaatatgaaacatttttcaacctgattaggttcctcaagaatatgttttacctgtaatcccagcactgtgggaggccgtggtgggaggattatgagaggccaggagtttgagatcaacctggactacatagtgagaccctgtttctccaaaacatgtaaaacttagccaggttttggtggagcatacctgtagttctagctactctggaggctgaggcaggaggatcccttaaacccaggaattcaaggctgcagtgagctatggtcaggccactgcactccagcctgggtgacagagtgagaccctgtctcaaaaaaaaaaaaagaatatattttgattgatgcacaaattgcattgtgtcctgtgcatagtaataacttaggcatttaggaatgacaaagtaactcctttaagtaacacaaggaagaccataggaatataaattgctggataattgtttttcagattaacaatgatatagaaataggaccaaacttaggttggaactgcttaagctgctgataatgtgtagtgaa

SEQ ID NO: 52552 - DNA, 1032 bp, Homo sapiens
ccagaatctgtcctgtggaggaggtggtggtggtatggtgagggtagtggcctccctgctgttttcaaaatcacagactaaaagcctttgattgtgccaaagaaattcattcagagcaattaactgcatggctagaaatgctttcttctctgataacttaacaaaactccagctgtcagtatgaagctggttaagtgtgttcatcttttccttgctcaagtgtgggctatggaaagaggtgaattgcggtgacttctgtggtgaggaggcttcagtgttctgagaccatgcttaaaaaattcaaatactcttaattaaaggggcaactcatcttcttatgagatttcaggccccaaataatttatgtactgcagccacattgtgcagcccaccactcccactgaccccacccacaagagcattcaggatcataggcactgatttcctatgctaaggtggttggccacttaaccttattacaatcaaatggtagtttcagtgtgatttatactcctggggaaggtgagcagatggacaagaaggcctttggtattccactaatgttcattcttctgaaattctgggattaatcaccaggtggtggtagaactgattgtttttttctttccagttttccaaatactgtctcttctcaataactccaaagtgaatctctgacattgatttgaaagaagttaatgaattcgagggtaatgcattccattgccactgctgtttcatgtaccattcgtacttagtggaggaaatgtggctgattttcttaattataatggtacagacacaaggacaaatcaaagtgattgctatttggcaaatcgttttatattcaaattctgaaggtcagtctgaagtgttttatatcaccaatcataactgtctgctcttacagctttccattaagcttatgaaagtgattacagtaatgctgctttttaatatccctcatgatttgacaccttgtcagggttactttggaatactgtcgaagtcttaggcagggtaaacaccttt

SEQ ID NO: 52553 - DNA, 1017 bp, Homo sapiens
attacaggcatgagccaccgagcatggcccaatttattttatttgttaagaggttaccctgaaaaaaaaaaaaaaaaagaggttaccctggccgggtgcggtagctcacacctgtaatgccagtactttgggaggccgaggcaggcggatcacctgaggtggggagtttgagaccagcctgaccaacatggagaaaccccatctctactaaaaatacaaaattagcccggtgtggtggtgcatgcctgtaatcccagctactcaggaggctgaggcaggagaattgcttgaaaccgggaagcggaggttgcagtgagctgagatcacgccactgcattccagcctgggcgacaagagtgaaactccgtctcaaaaaaaaaaaaagaggtcattctaagggaatgagatttttgcatcagaatgtgcagctgaagagcaaagctgcagcctgcaacatttgcccagtcttcctgagaggcatgatgatgagccatgctttcttctgcagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagcatggccaggcatggtggcccacacctgtaatcccagcactttgggaggccaaggcaggtggatcacctgagatcaggagtacgagactagcctga

SEQ ID NO: 52554 - DNA, 1045 bp, Homo sapiens
cattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtca

SEQ ID NO: 52555 - DNA, 1017 bp, Homo sapiens
gggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgaggattgatccacttttaaatttctcttctaccagcaacttgggaaaaattaaatatgggtgggggagacctaaactcaagtcattttctaaagtaagttacccacattgaccaaaatgcagcttcaacgttgagtaaagggatttctgagagctggccaatgccttttgccagctgcagtgagattctgcagcataggccacgataaaggaaggagagaaggggcttctcagacttatttgcagaagggcccagaactcagtatgaaggcattggcagtagtgtagctctagagggatataccccagatggctgagggaagaaagggattgaggtggtaggagttcaaggctcagtccccgtcccagatggcagtggagagtctcatcccgtggtccatcttcccagaggccccacactccatcaccagtgccgccttggagggagcctgccccagcctgtaacatcccaacctacctcccagtcttaggggcccttgcccacca

SEQ ID NO: 52556 - DNA, 1487 bp, Homo sapiens
caggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaatttcatggtgtttgaattgaagttgtactttctgatatatcttgatatgtcttttcttagcataaaaagttcatgtgtaggccgggcacggtggctcacgcccgtaatcccaacagtttgtgaggcttaggcagacggatcacaatgtcaggagttcgagaccagcctgaccaacatggtgaaaccccgtctctactgaaaatacaaaaattagccaggcatggtggtacacgccagtaatcccagctactcaggagaatgaggcaggagaatcgcttgaaccccgaggggtggaggttacagtgagctgagatcacgccactgtactccagcctgggcgacagagcgagactccgtctcaaaaaa

SEQ ID NO: 52557 - DNA, 1549 bp, Homo sapiens
tctccattgttaaaccaaaggagcactaattttaacacttaacctgtcatgcttttgatgttagtcgaagccttggagatatgcagtatacttccctcatttcatgaataaactaagacccagagaaataaaatgatttaaatttgctcttcaaagtttgtagcagaaccaagactagaacccaggtcggttcttgctgcttcagtcttaatagttagggagtttcagccctggtgtcaaaccacaggtttgaatgccagctcggcggggtttttttatgcaagttatttaatattctgtgccttgatttcttcatttgtaaaacagaaataatagtacctagctgatgggtgctatgaatataaactacgataccattgcttaatagagagattgtttagtcagaggtaacattttatttttattatctagtcttctgtcttaatttatttctatcttattcactctatttattgaatgaaattaagtcattcttcaagtaaagcagacttggtagaaacaaccacactgatctgctctttgctttattctcagaacaagagtccgtatcagatatggtttgttgtatgcgaagatgtttgttttaatcttccaaacccactcagcatgtcaatggcagagagaagtgacaatcagatgcctgatttgatccttgaactgaactttgatatgtttcaaatagattttttcacagaatagtagccaaaatttttctgtaaaataaatttaatctcaagtcagctaatttaataaatgttttggatacccccaaaacaggcttaccaagtgacccacttgttggaactttttagaagtaaatactgggggaggtttgtagggatttttctgtaacattaccagttgtccctgtaactcaaggaagttttattggcaagatatgccttgcttcattctcagcttgcaaagaaagattcatctgtcgtaacattaatttttatttttaaattaacctgcctccactgaacagattgtcactgctttctctgaaaggtcaggataagttctgcatatgagccttggaacagggtgatctttgagtctgggagaatgtattaccatgtaggtctgacagaagcatcacttgccatcagcggccactgggctttctatttcagttgacctgcagagcttaggatgttgcattctgtgaccaccccctctgcccagtagttgtaacccttcactattttgaggaaaacagttggtattttcctgtggtttgtttaatcctcaggattcggtgatgtccttctaagatcacgttagatcagtcctggtcattcagtcattgaacagtgccgagccagagtatgactcgaagggagtggaggccattccatcacgcccaggccaaatgtccctcctccctccgcatggcgtcaggctctcacatggtgccaaaagcagtgatgctgtggacagaggagacttgggactggtcttgacaattaaattcaggagggcacttttgttgttgttattgttttgaatccatctagagataaac

SEQ ID NO: 52558 - DNA, 3171 bp, Homo sapiens
ctattcaagaggctgaggcaggagaactgcttgaacctgggaggtggaggctgcagtgagccaagattgtgcctttgcactccagcctgggcaacagagcgagactccatctcaaaaaaacaaaaacaaaaagcgtaaaattgaatagaagtgctaaagctaaagaaagtcctaaaataattggaataggcaagtttctgaggcttcatgaaagaggtaattctcaagcatatggaagaagattgatataattcaacttgtgtagtcaaggtgttccaggtttagagagtgacataaagatacttaggagtcgttatagacttctaaacaaaaaaatgatttagtagctgacttttcctgacacaatgcaaaagacaagttgactaagtaaaaatagctctagcctagaattacataaattaatccaaatggtagagacagccctgaaggcccagcaaatgagaaaactgcagaacttggcagtagacccagtgggtaaccaataagatatagtcagaagtgattacaaaggtgttgggagcaaattagatggtcaagggatccggaagagagaaatcatgaggtaggttttcttctttgaaggtggggaaagatcaagtgcagactgagctgtggccaacgtttgcagaccaggaatccacactagctctaatcagagagcccttggtgtgcgggaactgccagtttgccgacgtgaaaagagtcccagactgggtaatggtgagccctgaagtcgcaccccagctctgccactcagtgagcacgggtaagtcatccacctcctccaggtggccttgatggccctccctcctctgagactaaagagaggccacaatgcccagagcagcctccttcctgtctcaagaaaggaaaggatctcaggaacccatttcatgtggtagcagcttttagttgtgggttgtaaacaaccctctgttgccaggaaagtcaaattgcaaccataatcactgatcctgagcagtaaatgtgacattggttaattcttctgtgagggcctgaacgctggttccctggaatgttgcagacctttggaatcggggcagttacactgttctcattcacaagcttttctctgagttggcctcttctgagcactagagttggttgcagaagtgtctttctacagtttgccaagcactttatgcagacagcaagaattaccgtttttttagtactgtcctatcagtgtgtcctgactttttacctcataagaccaagttggctgaagcataggacatcactgagtgctttgaaacaaagctgtttgattcctgttcactgaatgccatttctttcagggtagatttaaggactttccccttaaagtacagtgctactgactctagattgagggttcaagccaccccgtgggttaacttcaacagatgaaaatttttccttggctacagcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtggcacagttttaggacaaaggtgagcagagatccaccgtggaaaggggcatattttcttatagagagaccatccaaggcatgcccctcggtaagcagtgttggtgggtgaccacggtcacacgcatggaggcttgctttcccctgctcctcatacccactccctagcagtttctggtattgagcacccccttagtcatgccttgcccagttagccattgatcagcctgtttccagagcaagccatgggtattagattgcagacaggacttagtctccctgttcagtgaagatgtttggaatacagaagtgaccctaagctgttctgaaaagagttgaggtaaatcctattcagtagaacataacagagcaaagggcagacttggtgtttgggaccattggtataggctattaggatcagagaaaggatatttagcaaggatacaaactcagataataattcttgcctgaagaagtgtggttaacatttcaaaagttgaagtcttagagtaccttagttttaaaaatacgtcattccagttctaccttttcagaattatgactgataacctgagcagtacatcagctattgaatgacgaagatgagcgcattggcaatgggataagaatggactaaagtttagagcagcccatgtaattcagtgtggcttttgtttgtggtatccagatacctgtctatacttggtaagactcatggtgcctgcctttttttacagggaaaatgacagcaacttcccctcattcttttgactaggtttgtgaggatagaatgtgaccagaggaaaatagttttggtaaagacaacacagtgcttgggatcagacgaattttggatttcagggttttttttgggatttgggaatgtttgtattgtacttaatggttgagcattcctaaacaaaatccaaaatgttctgatgagcaaatttgagcatcttgttgctgctcagaaagtttcggattttcgagcatttcagattttggattttcggattcagaatactcaacctattgcagagaaacattaaagaaaggagtttcttctcttacttgaagggtgttgtgtattgaatagtgaggtcatgctttttattctttcatatgcataggggaggaagattgaaagtgtatcgcagggctctttgtgtttctgtcaatccctgctgtggaggggtttttacatttgtcttagattctttctcctgaattcctgcatcctatgaattattgaaaggtgttctttgtttttaatagagcagaagaggaaggatttctgctgttagaattagagaaatttatctcttgggttgttttgtgaggcttattcacaagtcacaccagagatgtatatacatatatgtacacacgtgcatacatataatagtatgtatacatgcatgtgtgtattttatattcctttttactctgacagaggattcaaaaggagattgctttctgagaaaagagatttgtttcacgttacttgctgcaaagcacaaagggagtgttaagcttggctttaaaaggctctagtgttagttaccag

SEQ ID NO: 52559 - DNA, 1028 bp, Homo sapiens
aagaatcccaggtctttgggatagtcttggcaagttactcaactcctctaagttagtttcttgatctgtcagatgacagtaaacctcagagttgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacatccaccacgtctagatccaagtcttcatcttctttatgctggtctaatttttgctgagccttagaagcaaagacagactccgggggttgatatgggacctccagaatggggattgcacagaataatcttatttttcctctattcttctagtctgttatgttctgaacccacacatgttttcggaaggaccagatggctgacactggctaatgggaaccaaaagacgagtgaaagtaacctggttgtcacatacccccagcttagaggtgcttcaccctgccccaaggtcaatttcttttttctctagagactttaccccattatatcaaaaacctttactacagcctgactttatctgatgttagagtatcattaagtcaagcagcagcatttattgagtgaaaaaagattgtacacaggactggaagagaagcatctgcctttaaaatacagtagaaggccgggcatggtggctcatgcctgtaattctagcactttgggaggccaaggcaggtggattgcctgagctcaggagttcgagaccaccctgggcaacatgg

SEQ ID NO: 52560 - DNA, 2573 bp, Homo sapiens
aataatcaggaagtttttcttgaatgaataataaatagagataggactatgaattaagtagcattctgtcattgttttattagtaatataactattacaaatgtgatcaaatttttttttattaaaagtcactttttaaagtcaacttaccccccaaaaaagtgtattatttttttcccccaatatatggggaatttaatttttttctgtcattttgaaaaatcaatgccaagagataataccatattgagatttttgaccaaatgttaacagcgtaaattgccctggttcaagacctccactccttggttcttggtcccttcagtttgtggtatgaataaacatcatttgtaattatttgactaagtcatttaaaatccctgttcttcagtttaatatactgttttgctcctcctttctcattgaggtactgtatgaatttaagggccatacgaagtatttgtcccttcttaaaagataggcacaggatatagactcggtaataaaatgtggtttgggtttctagtatttttttatgcttccaggtacccagaaccgcaaattttactttgagctcctcagaagaaaggtgctccaggcatctgagagaataccgttggggtgatacttacaaatttgtaagctaacactgaaatcttaaaacttccgaaaatattaatgcatttgtatgacttatttttcaactgagtatgtcaaagtactttatgaacaagtgttgtccctagtttgtactgatggggaaactgaggcatggggtgataaggtgactggcccaaggttacaaaatgagttattgacaactccggaaatagaagattttttaaattcccatactagatacatgtgggcattgacattcaaagcttccctcatgctatttcctttagtcctgtcctttggggattgcctctgagggtgagagggtagttcaggtttccgggcttgttcagcctttagtctctgtagaggcttccagcaagctgacaagttactgccaaaagtgagacagatggtattttttatgatgttgtccttagttggagactgctagtgattctcctcctcaggctactctttgaaaagctgtaaggtggtatcagctttatcgtggttggctgaggaaggatttgtacaagtaaatgttctctgccttattgtcattcctagggccgtctggtcttatagtaccctgaaggtgagggattagattatgctctgaatttgtatgcccatagtttgaggaaatgttttacttgagttttctgtgtgttgagatgaaagtctcccaggctaaagatttctgaactgcacgcaatgtctgaagaagcgcttgaaaggcactttatttctcccaggtccccaaccatgggtttaggtttttatgccagaaaggggaccttcatgaacaaagacccccaagacctagagagaagaggaagtctgaaagagggaggtttgaattcagccttcaggaatgaagagggcagacagagcaggaggctcaggcaagggagtcaggaaccacagaccagaaacatggacttggaaaggttttcatgtaattgaaatgaagctattgatccatccattttaaaagaatttgaaaaattcattaaaatacttaattagtggcatccactaattaataaaagcatagggagtggcatctttaaccaaaaatgaaaatgaagaaacagactccagcccagggaccaggggcgattatgagggacatggtgcctcatacagccaagatgatccaagaggcatcatctttaatgaagctttaacacctggcagcctgctcattgtgttgtttaagaggtaagtatgaactggttttgtttgtagcttttgtgtggaatcaggtagtgctgtctgcagagtgtaaacctttatttctttaagtaggaataacagataaagtaattctatattaaatcccaagagttttattctaaattggtaatgtgactttcatctctcgagttttttcaaatcgtttttaatttgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttt

SEQ ID NO: 52561 - DNA, 1054 bp, Homo sapiens
aatctttagcctgggagactttcatctcaacacacagaaaactcaagtaaaacatttcctcaaactatgggcatacaaattcagagcataatctaatccctcaccttcagggtactataagaccagacggccctaggaatgacaataaggcagagaacatttacttgtacaaatccttcctcagccaaccacgataaagctgataccaccttacagcttttcaaagagtagcctgaggaggagaatcactagcagtctccaactaaggacaacatcataaaaaataccatctgtctcacttttggcagtaacttgtcagcttgctggaagcctctacagagactaaaggctgaacaagcccggaaacctgaactaccctctcaccctcagaggcaatccccaaaggacaggactaaaggaaatagcatgagggaagctttgaatgtcaatgcccacatgtatctagtatgggaatttaaaaaatcttctatttccggagttgtcaataactcattttgtaaccttgggccagtcaccttatcaccccatgcctcagtttccccatcagtacaaactagggacaacacttgttcataaagtactttgacatactcagttgaaaaataagtcatacaaatgcattaatattttcggaagttttaagatttcagtgttagcttacaaatttgtaagtatcaccccaacggtattctctcagatgcctggagcacctttcttctgaggagctcaaagtaaaatttgcggttctgggtacctggaagcataaaaaaatactagaaacccaaaccacattttattaccgagtctatatcctgtgcctatcttttaagaagggacaaatacttcgtatggcccttaaattcatacagtacctcaatgagaaaggaggagcaaaacagtatattaaactgaagaacagggattttaaatgacttagtcaaataattacaaatgatgtttattcataccacaaactgaagggaccaagaaccaaggagtggaggtcttgaaccagggcaatttacgctgttaa

SEQ ID NO: 52562 - DNA, 1187 bp, Homo sapiens
gagccaccacacctggcctattataatttttttatatggagaaggaccaaaataatccaaagatgtaactctttgcattttgggttttttagttttactttttttcacatacaggtatgggcatgtgcacgcacgcactctgtctctcttcttttcttttttttttttttaattaaaaaacccaccggccagttgtggtggctcacgcctataatcccaacactttgggaggccaaggctggcagatcacaaggtcaagagattgagaccatcctggccaacatggtgaaaccctgtctctactaaaaatacaaaaattagctgggcatgatggcgcacgcctgtagtcccagctactcaggaggctgaggcaggagaattgcttgaacccaggaagtggaggttgcaatgagcctagatcgggccactgcactccagcctggtgatggagcaagactccatcaaaaaaaaaaaaaaaaaaacctatctcctgcacagtctctcccttttcttatgcctctcctgactccttttttttttccaaacttggaatcatactataagttattttataatttgcttgtttcaccctaacagcctgatccttttcctttgtcattaagtattctcctacaacctggtttctaatggctacatagtactccaacatacatatgttatttaatggacataatcagaaccatgttgcaaggcatttaggttatctttatttttgtactattttatgcatgtataatactgttgaatatcctttatatgaatttttgtatacatttctttttgccttagggcagattcctgcaagtagactttgggagtcaaagcatatacacattttaatgcttttgctagctattccattactcggtaaattaatatttacgtttccacctgcggtgtttaagagctcctatttttttttttcttttttctttttttttttgagatggggtctcaatctgtctcccaggctgcagtgcagtgcagtggcatgatctcagctcactgcaacctctgcctcccgggttcaagcagttctcctgcctcagcctcccaagtagctgggattacaggcgcctgccaccacaccccgctaatttttgtatttttagtagagacacagtttcaccttgttggccaggctgttctcaaactcctgacctcag

SEQ ID NO: 52563 - DNA, 1687 bp, Homo sapiens
tgcactccagtctgggtaacagcaagacccccatctctaataaaataagtacaatgctgactttttttgctttttgatgaatagggaaaaaatatttttttaatgtcataattggtgttgaagacatggtccagtaagaagcaattatgaaaaataataaacaatctagcatggatcaagccttatgaagaatctagaaatttaacaacataaaccagaaacaacgactattagattttacactaaaaattcgaaatcaatgagtaggaattcaaaggctctggaaggaagaagtgagcaacccaaaaggaagatggagcgataagaggaaagagcctttcaggaccctaaatacctgggtggtttttttaaggaactgttcattcttacagttatgctgccaaaccatgatatgcatgaaatgtcattgaaagtcaaggttgaaatgaagtcattttagagtttcaaagacaggtatgacagtcaccaaacagcacacaatatgacctcctggcatcattgaggaatcattacagaggaaaacgacttctgggaagaagaccaatggtaaagatgtatttcaagcaaaaattgcctgtatggcaaaaacgctggagagtctgaaaggaaggagtgagtacaaaagaaaaagcataacttagctacgtatgtaagcttatagtcccctagcagaagggcagtggatctccctactgggaagcatgtttgaacatatctagattgtgattagtaattgaaactcagaggccgggcgcggtggcctgtaatcccagcactttgggaggccgaggcgggcagatgacgaggtcaggagatcgagaccatcctggttaagatggtgaaaccccgtctctactaaaaatgaaaataaaaattaaaaaaaagtagccgggcatggtggcaggcacctgtagtcccagctactcgagaggctgaggcaggagaatggcgtgaacctgggaggtggagcttgcagtgagccgagatcgtgccactgcactccagcctgggcgacagcgagactctgtctcaaaaaaaaaagtaattgaaactcagaaacagattttggatgctttagataggtctttgaagaattgctggagttcagatttgtagaagtgagatgtatcagtagatatgttaggctgaagggttgtaagttaagtttagaattaaggcataaaatgcttgtctagaccggtcacggtggctcacacctgtaatcccatcaccttgggaggccgaggtaggtggatcacttgaagtcaggggtttgagaccagcctggccaacatggtgaaaccccatctctactaaaaatacaaagattagctgggtgtggtggtgggcacctgtaatcccagctcctctagaggctaaggcaggagaattgcttgaacctgggaggtggaggttgcagtgagcagagattgcatcactgcactccaacctaggcaacagagcaagactctgtctcaaaaaaaaaaaaaaaaaaaaaaaatcttgtgtaataggaagatgaccaaataaggaaacaaatgagttcttcaaaggagatttagtgttcaggaaaggattctatggaccctgagagggtttggagaagaggtgtgtaagcaagagttcattgcctaccgttttattacaccaggcatcgctaatgtag

SEQ ID NO: 52564 - DNA, 1735 bp, Homo sapiens
gagctaccaggcccgggagcgcgatgtggagcgcttctttaagggctacgggaagatcctggaggtggatctgaagaacgggtgaggagggcgaaagagggtccggccgggcggggacagaccccataggtggtggggaggccgcggggacgggagagggacgcctggtccgcgcggagcggctaccggcctggccaggctccgccatagtggcggcgcctcgggggcgcgggtaggccccggttcccactgcgcctgcgcgggtgggggtggtggaggcataatgggagctgtgctgaggccctgagtgggacggggagaaggaaagcccgagtggggctggtgctccgggcaggggggcacagctccagggcgcccgggagacctgggttttcccttcctaggcccggaactggggccctattcgtttctgggtagacaccaacctttcccgctctgaggactactggaaataaacaggatttcctgctccctttcacctcttgcccggtctcatggatcagacggtcacagcgccgtcttccccgaggactggagccttggagggaggccctttttagccgtgtgccacgcttttttgggcgggagactccagtttgagtagtctagtgacagtttcgaaagtatcgtcttgccgtgctgaaagccttcaccgttccctctgcaagagtaaattaaagtcttaacttcttatctttaagactccgtgcagagtttccacgctgtggtttccgttttccaacttaccgaaaaattgcttggccgttgtagaatttgttaggagaatagtggccaccctggctagtatctgcgtctggttaacgcagacggagacgaaattgttaacttactgcctcccccagagtatgatctattacttgtattcttaatctacttcggcaaaaatagtgccagcatgagctacaggttttagggaaaactgttgaggaatcaggcctggagaaaatactcaacggggaaaactgggaaccagatgttaggtagggcttggaaggcatggatataaaattaaaaggactggggtgacattttagggcactaaaccttgggtgttagagaactcttggcttaaaaaagaaactctactttgcaacagttgtaatatagctaccgtttactccccagggttatactagtaactgacacctgaaacattttgaaagttacctaagtatgtttcacgtatgagaaaactggtagctaccgtattctcaaatgatgatttgggtttaaaaagccatttcaaattaattattagaatcgttttctttctgaggacgtctttagtaaagtactgatttcttttacagtaaaaggctttaaaaactactccttttctacagtaaaacgttcagttcttaaggatatattgaagtggcgggtagacgttattgtatacataccatatatgtgaaagttgaaactccagtttttttcagagcccagctaaattgacagcataactaacttttgtggacaaagtgtggattttgaagccagccaggcctaagtcaaatcctggttccaccacttactacgtatgggcaagttacttctctgaacctggttgttcattcatgtggaaaaggaagattagagataataaatgtaaagcatttggcttaggcagtaagtggcagctataatcagagggatgaggaaacatctttgcttgttggtgtttgataacata

SEQ ID NO: 52565 - DNA, 1509 bp, Homo sapiens
ctaggtgataagtaaaaagagctctgaactcagagtctgaaagacctgaatccaagtttaaatttgtatctgcagttccaaaatcctgaaagcgctggaaactgacaggttttttctataactcatttgaaggaaacgatctaacgaggtttttatgtggtctttattcatcccacttagcctgagtattcctacattttgctgcagaaacattcatgtatctgatcacagggtgctacaacagcccccattgggtatgtagataatacatggccccaagagttttggaaaagggattgtgaacctatgtcttgtcctgatcaattgacaaaaaatgtatgaaatggcttcacaaactaaacattagtaaactcatatgagatagtcttaaatagcatgatgtataattctgtacaatgggaatactgagcaagtgattttttttttttctggactaggaagagggtcaaaagatatcttaagggaagtaaactttgaactgggccttgaagggtgagttgaattcctcacttcatagagaagctgtggaagaaaacattctgggctataggaagaacgtatagaaaatgtgcagaaaaaatgtctttaaacagcttgagcacatgaattttgtcagcttacagaaaaactctgatgatctgtgaaaatacaggagagaagcactgtggataatacaaaggggcagctagtccgaaatccatttgctctgggcaggatttttcttttgaatgcagacttaatacacacattgagagtgaaacatcactatctgggctgatgcctccttgcttagtgcccacctgttagcgctccctccatctccccataaggcaacggcagccggtccagcctgtgctcatttcactgccctctgcttggtgtggggtcagccccttacctgctggcttctctagatcacactgccaggttcaaatcaggtcagccacttgctactttgtagtggccataagcaagttgtttacctcttagagcctttgttcctcagctgtaaaagcagaacaatagtatgagagctattgtaataggaaggctggcaggtaaagcacttagcagtgtgcctgactggtaagcactgaataaacagtagttattactattacaagggctccccgtcctccagctatgtgtaaatacatacattccttaattaagtagctgggactacaggcacacaccaccacacctggctaatttttgtatttttagaagagatggggtttcactaggttgaccaggctggtctcgacctcctgacctcgtgatccatccacctcagcctcccaaagtgctgggattacaggcgtgagccaccgtgcccagctattataaaacatttcttcaaaatcacacttttaccacaagatcaagcctccagtataattaaaaggtcagatttctgcaggaagtaggtggaattacatcagcttagttgggtgatactgttgcctaatgctaaaaaccttgttg

SEQ ID NO: 52566 - DNA, 1008 bp, Homo sapiens
caatgtacctagcacaccaggcatttcactgaatcacagaaggcagtttggtgaccaggggaccacagacagactggggaggaccacaggagggtcagttacattcacccggtgccctgtgatgacacaaacgttcttgattctgtactaagtcggtgccctgtgatgacacaaacattcttggttctgtactaagtagacgagaaagtctctggccagtgacaatttctccctacctcttcttcctgctcaaaatgatattgaccgtttgatgtgattgagtaaaagatgaaagataagtacaaatgattgctaattaaatgtggaacgcaggaaagatatctcagcagagctagctaatgcccaccttacacagcaagtataactgtgccagtccccagggtactggcctcttttcccccctctcaaaaggctctttcttctgcctgcttttgtctcccttgtacttcatatggcatcacaggtgtacagccttggcctcaaaggagccattgtgaccttatccaggctgggatctgttgattgaggacagtggcatcccctcgagttgcatggcgccattacattcacggaggacgtgaacggtatgggggaagcaatttgagatctagccaggctgggttgggtgcctcatttgtactccaaaacatagccactgtttcctttggtgagttttgtttgtttgtttttttaaagaacagggaagaaattgctatcattacactagaggtttaactcttggaattcagacttggtccctgttttccctcctgtctcagcagaatggtatccttgacaacatggttagcactgtctgcaggaacagcagtgtctgtggtattgatggcattccctggggcaggccaaggctggcctccctggtgagaggcagctggacccccccacccccaggcttgcagcaaatgtggggccagcccccgacaccatccacctgtgtttgcagcttcaacttaacttcccatctcc

SEQ ID NO: 52567 - DNA, 1067 bp, Homo sapiens
tgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgagtaagagacggcgccgaagccggggaaggggactggggtttctggaaggctttaacacgagctgcggactgggaagagagggacagggtccgaggaagggggcagagaatagcaaaccgaagccgaagcccagggcgtttttggtaggtcagaaagaccgtacttgaaggtagctgaagacccgagaggcaattatcagggtattaatggctgatgtttattgatcgaatattgtgtcaggcaatcccttgtttaaatggatgctctcatttaattgtcacaacaatgttttggggtagttattgatttatccccattttgcagatgaaaactgaggcagaagaggtaaaatcactcgtccaaggtcacacagccagtaagtgacagggtcagaattccaacctatgtctgactgacctgcgtgagttcttactattattattattatttggaagaagttttcagaatacttttacatccatttggatcttcatgtgtcagtaaagagtaggtcatagatcattgtttccagagggcaagggacttgcccagagtgataccgctaataagtgattggaacaggagactggaatccatggcttctgattccaaactcatgtttctctccactgcaccgtatatgcatcttggcttggttaaaaagagctgctttggtgccatacagacccaagtatctatatttggtcaaatacaggctcaacgtcttagtagctgtttggtcttagagaagtcattcaacttctcgttacttttatgactttgtcctcctcctaaaattctgttggatcttaattcatgctttttgcacgtggttgataaaaatagtatgtcagttgccaaccattgtaaatctgcacataaatagccattcagaagggctattggggccactgaagtg

SEQ ID NO: 52568 - DNA, 1333 bp, Homo sapiens
ggcctggggtccagggcagtgggtgggagggcatcaggagggggaacacagccagggtgagctggggcagcctcagagatgatagtagcattggccaccttttattgagggcctaccacacgtcacgccctgtgcttgtttcatttattcccttcaatttccctgtgaaacgggaaatactataatccctgttttacaaataaggaaactgaggcttgggagattaagattcctgcttaaggtctcagagccagtaattgcctgagcagcatacactcttaggcctccttgactccatagcccaggctctaccccctggtgtgtcctgcctcccatggtgcccagagactactggtaagccctgagactctaggttccctggctgccctgcctgtgccctatcccctagcctccaggaatccctccctgactgcctagctctgggctccccagttcagcccctgcccacctgctctgtgtttacagatgatcggcaccgagtgaaactgcacccgatgctgggagaccccaatgccgactacattaatgccaactacatagatgtgagtgccttgccctgtcatttctgcagacctggccctgcccgctccaggcttactatccaggcagggcagaaacctgtcgggataaatgggggttcaaatggctgagttcggagtgcccctatctctgcagtcagtgccagggagctcagaggagggaggacagtgagcagcagcttctggaaggctttctgtaggtgggagttggcctgagagatgaggtgctttagagaagcaaagcaaagggaagaggcagacagctaggccaagaggtgaggaaggcgggaggcatggagaatgggattctcatcgtgcaccatgaggctgaagaggtaggcaggggctggattgtgaagacctcaaatggcaggctcaggagtgggggctttttcctaggggcaccagggagttgttaaagtgttttgaccatgatcagagtggtcctttaagaataataacgcacatttatccagcacgtactgagtgccaagcactgtgctaagcactttacacccaagatctccttttctgtaatccctccacccaccctttgaggcagttagcaccatgacctcactttacaggtgaggaaaccggggctcagagacgtggagcgacttgtcccaggttgcacagctagtgagtggtaaagaaaggacgcaaatctcagcctgtctgtgtctctaaagcctttgctgctgtgaggctgtcctgccccctgctgcagcagcagcaggacttggatggattggagggaggggccagagaca

SEQ ID NO: 52569 - DNA, 1048 bp, Homo sapiens
actgtccatctgtctgtccctcctggacactcatgccattgcccaaccatctggtcctcctccagggtcccattcaggatgagcgggctctttagccaggccctctcctgatgctacccaacctcagggccctacaggcatgcgtcagctgcaagctgggtgttgtgggcagcatgaagcccccgttggggctcaggaggcctcctggcctggggtgtggtgctggatggtgctggatgtgctgacctggggtggagaccttgtctcagggacaggcaccctctgcctgcatccccagggccgaagcctgagatggtctatgacttctggcgtatggtgtggcaggagcactgttccagcatcgtcatgatcaccaagctggtcgaggtgggcagggtaagccgggctgtggggcgagctggggcgcatggcaggccaagggggcagcaaagagcccactgagtcccgtcctgtggggcctctaggtgaaatgctcacggtactggccggaggactcagacacctacggggacatcaagattatgctggtgaagacagagaccctggctgagtatgtcgtgcgcacttttgccctggagcgggtgagtctccccaccgcctgttccctgcagagggtgcctgagcagggattagagcccactcccacttcccccagccctgggagcaggagggtgaggagcgcaccactgcccatcccagcaaggaagctacttggtcactgttggctgggagcactctagaagggcaggaaggtcactgcctttgttggtgcccataggaggaagctgagacaatgaagggggtgacagtatctgccaggtgctggctcctactctgtgctgagcctgttataaatattgtttcagtcctggaaagctccgtgtgattagcccagatacagaaagtgaggctcagagggcttatgccaggcaggagaggccacatagtcagtggctggccagcgagtcctgtccacgatcccatttgatctgctctgtaaagtcctcagaggaaagatagttttttt

SEQ ID NO: 52570 - DNA, 1094 bp, Homo sapiens
ccctcctctcttcttctccttagtcccgggcttcctccccaaagctctgacctggtctggggctgctctctctccagcgcgggcaccggccgcacaggttgctatatcgtcctggatgtgatgctggacatggcagagtgtgagggcgtcgtggacatttacaactgtgtgaagactctctgctcccggcgtgtcaacatgatccagactgaggtgcggggacctggccctgtccccaccattattacttctaggactggagtttctcgtgaaggatcctggagccggcagagcatgcccaaagggtgtcctgaggctcttgccttccctcagatcatccctgaccttgggccgccaactgcatagggtcatcctgaactgctcccctgtgttctgttgggtggggtcagacaaccggtcctgtagctgacatacctgggattgcatcctcagtggatgtgtgaccgtgagctgtcccccacctctcagagcactcacagagttgttatagggggtagggatgaaataggagataaaggggcatgtccatggaggttgtttcaggtaggcttggtccagcctgtagtaacatggttggcctccacctcaggacaccctgcttcaaccttgagcttgcttaagccccatcaccacagatctccagcttctaggcccctcctcggcctcattctcatctcctgttccaggagcagtacatcttcattcatgatgcaatcctggaggcctgcctgtgtggggagaccaccatccctgtcagtgagttcaaggccacctacaaggagatgatccgcattgatcctcagagtaattcctcccagctgcgggaagagttccaggtgggggatgagtgcgtgtgtataggtgtgtgtgtgtgtgtctgtgtgtgtgttggggcatccttaatactgcaggagtcattgagggccaagaagcagggaccagcctgaggccacagctggagggacagagctgagctaccaggaaggactttgggacagcggaagatggggtgcatcaaagcagttaagagcccaggctttgaagtcagataaacccaggttcaaatcctggct

SEQ ID NO: 52571 - DNA, 1047 bp, Homo sapiens
gaggtgataagtaaagaccagaaggaagtgagggagacagccatatagacatttgggaaatttggcctaggcagccaaaatagcagatgccgaagcgcggaggcagggagtaagctcggccagcctctgccttgagctcagcctcatgcccaagctcccctcgccatacctttggaaacttttgctgtttagttctggggggtcatgggcttggtccccagaggcctgggcccaccctgtcaacccaggcctcagtgtgccaaccaacatcagaaatggcccactggaggcagcctggtcctgtggggcacaaccgtccaactcagggtgggcagtgcgggaagacagcctggggcagaggctcagcccaggccaggggccgggaacagggccctgctgagttccggtttccctgcagagctacacacggagtgcggccttcatcgtgaccctgcacccgctgcagagcaccacgcccgacttctggcggctggtctacgattacgggtgcacctccatcgtcatgctcaaccagctgaaccagtccaactccgcctgggtgaggcctccactggccaggccaatgggccgcctgctcccaggtcctctgtgtattcagggccatggtccccaaagccaaaagttgggtcccagctctgccatctatttattgtgtgatgaatcatacaccttcccagagcctcagtttcttcatctgtaaaacaagggtgtcagatgggagatcactagttgctctttttcttttcttttttttgagacaaggtctcactcttttgcccaggctggagtgcagtggcgcgatcacagctcactaagttgtgcagcctcgacctcttgggcccaagccatccttccacctcagcctatcgagtagctgggactacaggctgcatcaccacagctgtctgatttttttttttttttttttttttcagtagagacaaggtctcactgtgttgcctggactggtctcgaacacctggcctcaagtgatcctcccaccttggtctcccaaagaactgggat

SEQ ID NO: 52572 - DNA, 1063 bp, Homo sapiens
gcaggctgggcctactggaagctggtgcggagctgagtcagtccgggtctggcccccaggggttttggttctggtgggaaagacccctgagaaggggagtgagggccgcatcagtctgccattccccaggaggcaccccacacgtggagtcacagggaaggagggagaggcacggaggggatggagctctgtgggaggctgtgggtttgacttggggtttgggtacgtttgtgcctgtgtgcccacgatgccaggtggtgaccagtcttctcagcattcctgttccaccttgctctctgggtacgcgcttgctgctcctccgcccttctttgtcactgtctttgtctctccgggtgtttctcttggagtgtgtctggcctcctttctctcagaatccgcagtctgtttcgccttgagaatatgtcttctgagatgtcttagcctctgatccttcttaacctggtcctgctcctccctctgggttccctagccccgccccttacctctgggtcctctgccccgcccttctgagttccctagttctgcccctcaccttgggctctttggccctccttagtttcctagccccgcccctcacctctggactctttggcccctcctttctgggtttcctagctctgcccctcatctctgggctctttggcctcttccttctgggttccctagctccgcccctctcctctaggctctcgggcccctcctttctgtgttctctaactccgcccctcacctctgggctctctgccccacccttctagattccctagctccgtccctctcctctaggctctctgcccctccctcgtggttccctggcccttttcttaccttcaggttccaaggccccgcccctcagcttttgcatctctcattcagaaacgggggaggacgcagcggcaccttctgcgcctgcgccacggtcctggagatgatccgctgccacaacttggtggacgttttctttgctgccaaaaccctccggaactacaaacccaacatggtggagaccatggtgaggggctgtgtcccgtgcccagccact

SEQ ID NO: 52573 - DNA, 1083 bp, Homo sapiens
tgtgcctcccagctttaatcttgcgaactgtctgctgctcaaagctctgattatggacggtcagcgcttaaagactttcatttctaacctctttgcagatgagaaacccgaggctcagtgagatcagtaacttgcctagtgtagcacagcaagtgagcggcagggctgggattgaatgcaggtccatgagattccaggggtccactacctgtctgcaaatcttcctgttcccccattaggggctgctgccctgcctcaggcccatctgcagtggttcactatgctccatctgtgggttgtggctctctgtggccctgctcttgtggctggaactgcaggtgtgggtggctgccaggcccagctctgtgcctgcacttctcacagctgctgtgtgtccactagcctgatctgggaaggcccagaggcaggttctgagccagacagggccagatggctcctctggaatctcgatccctttcccaggccatgtggaagcgggagagggtgctcatgtatgcattttcccctgaactccacctccttgctgtctctgcacctccctttgcctaggcccctgtgagcctcctgagttcccgacttgcctttgggttctgtgtttctggagtgtcagctctctgaggacagggacttttgcttgccttgttccccagagcctagaacagaacccagaatatagtaggaacttaataaatactcattaaacgaatgaatgaatgtgtgcccaaagtttcactcatcatcgctgttacctgtgcccccattaactgccagagctgtgacccttctccccaagatgaccttgaacggtgcgtaaccaagtgtgccaggaactggcttgacctgcttcccatgagaccgaggctccagacctacctctccctctaatctgctgggtgtccctgggcaggtctgttctccctccctgggcctcagtttctccgtctgtatacggaggggattatatgcagtagtttccaaggttaccctgtctccccccagcaatgtcttgccgtctctttgattctctggctctcagctgcttaacttgacaatcgcaaccca

SEQ ID NO: 52574 - DNA, 1029 bp, Homo sapiens
attgtcttcactgatggccggagccaggactacattaatgatgctgccaagaaggccaaagacctcggtaggtgttgcctgcctggaccctggacaccactgatggccaggggtacacacgggtatagcccaactgtagtttatcttggtgtcgtctgattagtgccctaaacccaggtgagtttgaatgaggaggattggttagtccaattctctcttataccaatgacaaaattgaggccccagaaaagtaagtggcttgttttgatggtccttttgtaagtgaggcttggaacttttccagctggatattcccaagaacacatcaactattggaaggcaactctactttggaacaagcccgagtctgttttgtaacctattaaatgaggaaaaaataaccaccagatggatgattattagggttaaatgaagcttgctgtacaaagcttccagtacaggaagtcactatagggtctgacacagagcagaacctcagtaaatattgattttctcattgtccttgttccaggcattgtgcttgcaattccagcagctgccagcaggaggtgtctggtgttggctgcctaagccttccccaggaggctcagccatatggttgcccatccccatgtccagccttacttctcctgttcctcctggcaggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtgggtgagtgaggccagggctggcattgatgggatttgcaggtggggcactgtggaggtggagccatcctggaactgggtgtgggtggggaaaagcaggggccgaggtggcaccaagagttggcagaaccagaaggtgggctggcgcttacagctcttactaccagcaaacatgttgaatgctcgttacgtggctggcagtgttctcagtgct

SEQ ID NO: 52575 - DNA, 1040 bp, Homo sapiens
aataaacaccacctttagaagggaggcgtctcaaagaatgtgtggtaatatttgcaaatgaccacagaggcagtctcacctagggcgagttcccctgcatcagtcattggtttcaagctgcccctaggggagggaatgtaacctcccaggtattagtggattaggtggtccctgtcagccaaaatgatcttgtagagaagagcataggtgtggcccatgggcagctgacacctgccagctggggatgggccggtgcgccagcctgggaagcagatctggagatagtagccacttggcttttcttggtttgcccgtcagtgggatggggctgaaggtagcacctgcttcctaaggctgctgtggcggtcgaccaaggtgacggctgtgccacgctgtgctcgtgtgtgtgtggagggtgggatcattattcccggatgtgtgggtgctgttggaattccttatgtccagagacattgatgtggcccccaaatctgttgcagaattacctccccagccaggaggatatgcctcataaccagttcatcaagatgatgatcatcttttccatcgccttcatcactgtccttatcttcaaggtgagtggatccctgccctgcggctctgggaggggtggtgaggctgtgctgggcccaggcctgcccatgccaagctgttagaaggcagggacatgtgtcctccatgcctcctctcctgcttttagctcctttctcttgctttcccatgccagctcctctgactttacttgggatcctccgagacagcccatttagggcatgtgaatccgtaaaggccacctgcgttcagatgtctaattccagctgtctggaattagatttggactggcctgcgtttgaatccaagccccactgtcactagctgcgtggttggtcttcagcaagtcacttctctctgggcctcaggggcaggagtcttgttttgcctgtgttacagttttatgtaattcaggcatcaaaatgtacctgagattatgttaatagaggtttggtgatgagaaggca

SEQ ID NO: 52576 - DNA, 1021 bp, Homo sapiens
tcttctttggaaccaagttgaagaaaggaagagaaggatgattcatgccagtgagcgcccactgtggggtggcttgagggctgctgccagtcaaggacacagtctcccaaacctgcttttctcactctccccaactgttgtccttgaagagaccggggggctacatcatggaagggccctggcccgggagtctggagaccttggttctagtcttgggtctgccaccagctcttggtatgaacatctgtgtgttcatgtctctctgtgcacaggggacgagagtcactgatgtctgtagctgagacggtctctcaagtgagggcctactatgtgccgctcagtaactgggactttaattgctgctcctcattcctcctccttgtatttgtcctccccagagctcctccaagttccccctgatgacgctgcagctgctggacttctgcctgagcatcctgaccctctgcagctcctacatggaagtgcccacctatctcaacttcaagtccatgaaccacatggtgagtctggggcagggaaccatgcccatttgctggctgtgtggccttgaacaggttacttcacgtctctgtgtgtctgtggtttaggccaggttccctggagttggagcttgggaggaagattcttgtgctggtgatttattgagggagccctctcaggaagaaacttgtcaggagtgaggaaggcaggttcgagaaaaggaggaagccaagcaaagaagcaaagatgtggctgtaggagcagccctgcatgatcccagagagggctttggcatgtgaattgcaacacagacataatatcagtttttattgttgtctaatgaattatctctaagcatcatggcttaaagcaataaacatttattatttcacacagcttctgaggatcaggagcttgggagtggcttagctgggttcttctgactcagggactctggtggggctgcaccagagatggtacctggggctgtggacaactgagggcttgattagatctgaag

SEQ ID NO: 52577 - DNA, 1061 bp, Homo sapiens
tctgtgcctcagtttcttcatctgtaaaatggggatcataatagtacctctctcaaaggattgaggtgaggatgaaaggagtgaatccaggagcatgcctggaagaggcaggaaatgcctcctagacaatagctatttttgcagccagacagatctgggtttgaattctgccaccagtgctaactactgtgtgatttggggcaagtgccttgacctctctggacagctgtttcctcatctggaaatgggcttggtaacagtcctggcttccaaagttggtagtgttcttctagtaagcaagctgtgtgaaacggtggaaccctggccctggtgcagagaagggcatgatgaccgtgttagggtctgtcctctctggaaccccctcctgggaatggcagagggcagtggggtgctctgaggcaggctgctgccctgtccccactccccctccccagctgccccgccccagctgtgacgaccttgtccctgcctgtctaaggggcaggaaggaagtgaggagggcagccagcagcttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtggtgagtgtgcgggccccgggtgtgtgtgcgtgcgtgcttgtgtgagtgtgaatgtctgcggtgacccgtcatctacggagccccacaaatgaaagaactcctgctctccacctctctgggggaccctgggcaaatccctgtcctgctctgggcctcagtttccttctctgtcaaatggctgggggtaccctggggagatgccgcaagagtgaggagtaagggagctggaatccactttccaggcaaatgtaactgacgttcactccgaggctggctccgtttctgcctctgtgagatggggcacagcagcagccggaaggttatttgtgtgcaaagccaacagcagatgtgaaagtgctttggaagg

SEQ ID NO: 52578 - DNA, 1029 bp, Homo sapiens
tgaaatctgatttttaaatgttggcaacaatttaaaaagaaagaaagaaagaaagacactgtgtaggccaaacaaagcccatttgtgggttgcatttgagctcgtggctgtcactttgcaatccacaagatactcaatatctagaggcctcttcctgtccttgggcctttgataaaaatgactcacactgttaagtacttactatgcccaggggcatgagtctgatgccatttaactctctccccacctccttacccaccatgtaatattttcctaccaggtaatgttatcatctctatttgataggtgggcaaactgaggcccagagaggttaagtaatgcgtccagggtcacacagctaataaatggcattgctggggcagccttgctgagcagggctctcctgctccaaagctcacccatgtaaccactttcccatactgccacaatgaacttgacctcctgcctccagggctccccagtcctggcctcctggggactcatgcactcactggctgaccccaaggttgatctagcatagtcttggcccagaaggggggatgaccaaggcaggggacctcctgatcctcccaggactctgggttctcctctccccagatccccaggtgctgcaggctgcatgggacacctgctggcctgatgagaaacctgctgaagcggcatcaaggccatggcctcctccagcagcccagccacaggctggaggaaatgtcttctccttttggaaatcctggcggggaggggccggtccctgtgtcagccaagttgctgtcgaggttgcatatttctttctttcttttttttttttgaatcgcgttctatcgcccaggctggagtgcagtggcgtaatctcggctcactgcaagctccgcctcctgggttcatgccattctcctgcctcagcctcctgagtagctgggactacaggtgcctgccaccaagcccaactaattttttgtatttttagtagagacgggtttcaccatgttagccaggatggtctcgatc

SEQ ID NO: 52579 - DNA, 1047 bp, Homo sapiens
tgggaagcatcccacagtccggatccgctggctggacaggggcgggtgtctccgtgaggcccccaggctcgggttctgccccacccagcgcggccctgtcgcctcgccccggattatttacccccaacccgacctcactcctagcctgcagctaggacccgaggtcgggagtcagccagctctcattctggtcccgacccagcctctcaccagccgtgtgaccttggggagggcactgaaccttaggcgctccgagcctcagttcccgcctctgcaaactgggaataatcatagcgcaagcattaggattgttgtgaaactaaatgagttagttcaaggatgtagaacaggcacacagtaagtgctcaataaatgttgggggttgtttctttgcttggcatctcgaggactagtttgggagtccttcgggggaaggtgttgagcctggtgctgaaagcaatggtttgaatcccgttctgtcactatgtgtgtgacttggccaggccatttctgctcttggagcctcagtatcctcatctgtaagatgggggaatgtccatcttaaacagttatgcagatgaggaataaaacatcagctcccgtttggggagccaagcatgatgccacctgctctgtgcctccactaaactcacataatcctgggcatggtaacccctcggccattccttccacttacaaactggggcttacggggtttactcataacctgcttgaggtcccacagccagaacgtggggcagctgaggctggacgggaagtctctctgatgctgtgtggcttctcccagcaaagggaagaatgtgtgtctgttttgtcagccacagaactgggcagggcttcagagaggctggtgagccccaggcccccatgggagtgaggtaggtcaggcatggccgtgagcttggcaaagggcaggcttgacctgagttctcatctctgcttcttgcctgagtggtcttggacagctgctcattattgagcctcgagttcctcatctgtcaggtgggcacctcctgcttccttggt

SEQ ID NO: 52580 - DNA, 1036 bp, Homo sapiens
gctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatgatgtgccgtgtccagagtatgagataaatatggtcatttggggagggcagcccatggccgcaccctgggccccagccatcttcccccatcaaagaaattgagaaccaagcagggaaaattgaccaacagccccttgtgggaaccattatggtaaaagctgctgttggttgagagtgtccaggaaaccacggagccgctgcggtgaggctgggatgggggctgtggttgggaggggccaggcagtggtgagaggggcctgtggttcacccccaggggaactctggc

SEQ ID NO: 52581 - DNA, 1042 bp, Homo sapiens
ggtgtcctcgcattaagttcccgctgagcatcccaggtgggctcaggggtgactgggccgttcctccccctgcacaccctgccattggggatgcttgctgttcggaaagaatgtactcttggaagcaggtttggaaaattactgaggtggccccttccccagccttgcctcatcagcatgaggctaaattaggatgtgtgagttctcccctctgcctcccacccttgccttctctccttctctcgtacccccagcccaccctccccgtctctgcccctctgccccctggcctccctcagtcctcgactctctgtcaccgtctctgtctctgcctcccccttccctgtcatcctctcagttcccccgtgatctctccctctcctgtaccaccccatctctgtggggagctgcagctcctggtcgttagcatggagaagatggtcgtcatggtaacggttgtcatgtcgatggctactgagctggggatgaatagtatgtaggtgagcgctacctgagtggaggctgatgggtttccaggaggctcgatgcttgtctctgagctcagagctgcacagcaggcccagctcctcctgccccatgtgagtggctgtttttacccccaggcatgctgacacgctgagccctctgtggctgcttttaggtgagcatgtttcagtgtgtgtctgtgcatgtgctgtgtctctggggtgtgtcatttcaagggtctatgtggcatgggggtaggtctttgggtttgtacaggcttttcttggagcaggaagttaggggctaagtggcactggtcactgaggaatcttggggactcccttgttttggcacccacatttacttcagttgggggcttccagggaccacagacctcttagtatccctcctcccagctaaaggcctcccagccactgcccagcctactgggaaggatagaaagacagtgaagacagccctgggcaggggcaggagccggagcctgggtccctgctcagtccccattcttctgtgtgacttcaggctgcttgccaga

SEQ ID NO: 52582 - DNA, 1059 bp, Homo sapiens
ggtgagactgggtgctttccattttcctcccagccagggagcatctcggctgtgttctgtctgtcacatgggccctggcccagagtaggtgactattgatgtttacgcaggatctcaggggtggagagtcctagagagatggccagccctacagcctgacatcccacagctgatggcccagccacagcctggggccttgccaatggattggggctggctctccagccttagatggtcccactgagcctcccaccactcttgaggggctggtgggattccccttatttagaggaaggctcagagatgttaggccacctgccaaagcacacacagccaggagctggtggagcctggtgttcatttgccccttctcctaccctggagccccatctgatcttgtcgtcacatcccctacttagccagggttttctgggggtgcagctgggactggggataacactgacttgggccttcatcctgcttttggatgggccatgggcttccagggtgctgtctggtgctgcttcaccctggggttagccttggcccaggcgaccctagagattcctgtaccccctgcactgccagctaggacccccccatccatcctgccctcccccatccctgcctgccagcccagactttaatgagggtaatttagaatcaatcaccagcgggatctgggaaatctaattgcagcaaactgattgccaattcgattgcgggcaccagggggctgtgggcggctcattagacctgtccccctccctgggctggggcttgggggtgctccgtgggggatgcagggcctgagtaggcaaggctcctggagagctggggggaggtggactgttgttttgggagcaggggaagggcatttttacctgacagaagccatacactattccctgtccaggcccacagttggggtataggtgcctgtgtcagtctttaccctctgtcatccaccccttgcttaatgccccctcctcaaggcctggatgccattgttggggggtgtctgcagctgcatcttacctggttcctgccttcaagatg

SEQ ID NO: 52583 - DNA, 2736 bp, Homo sapiens
cctggatgccgtgcatggggccagaggggcctgtgctcatgcttgcagggaagcactgtgcagctggcgggtagtgggcagtgtattttcccagctaggatgcactttctccatgtgttgtcctgggagtggcccatggccacccagcctccagggtcctcaggccctgtggcaccactcagggtaggagctcctctcctcatctgatgggttgccaaagtgctagaagtcaggggactgggctgagccagtgaaaggtattgctgtaggggtgtgtgtgtgtgtgtgtgtgtgtgtgtgtgtgtgtgtgtgtgtgtatgtgtgtgtgatgcatgacatgcaaatgcatgtccgggaagcctgcccccaagtctcatctcaggccatgtaacacagactgtctttcctccccagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgggtttgtgctttattttaacctctccccccaccccacccccagtgtagttccccaggacagccctttcctgctcatgcttctttctgcttgttttgttgttttgtgagggtgggaggagaggtgccaaactaatggctctttgagcccaatttaaaccaaagatgtttggttcagcctgcccagtgcattcagaatcaagatactgcacatacaaatccagatttccaactctgcacatcagaatattctccttgggcccctgagatgagctgtctgggttacagcaccgtctgtctgggcctctcctcctccgcgtttcctctgtttgggctgctccatttgctccctgccaacctgtgcccactactgaggcctgccaagcagtccaatgtctgagcatgctcatctcttcagactggggagcctcttttagcttgtaacacaggaggctggagctcacaattgtgcccgtggccctagcctg

SEQ ID NO: 52584 - DNA, 1951 bp, Homo sapiens
ttttctattgctccaaacccagcaaaagaatcttttcttattgctgaaaaacatcacagttaaatcagaacattgcattctggttgttctggcggtgtgaaagcattcaggatttggtcccagtccttcccttttctgttgttagcgctgtcttttggagaggttgtcagttgacacacttgactcttaactaagtgtgtttttcatgactttgactagctatctgtttcttggcggcttggaaaagtccttttcagctctgaattgtgcacatctatgaattcctaaaatagataagcgatgagtttattgatacacacacaccttattatatgtagagagaacttaaatgccattaagttcatttgtgaagattagtgggataatacatatatatatatatatatatatatatatatatatatatatatataaacaatactgaagcattgaaggtggtgactgtcatttttgcttctcatttgtgtttgtctacccttaggtatttgccttatccacacatccttatggctgccgagtgattcagagaatcctggagcactgtctccctgaccagacactccctattttagaggagcttcaccagcacacagagcagcttgtacaggtagtggagttgccagtagaggaactgcgaacacctgtgggcttgtgcagggccagagtttgtgtgttttgtcagtgtaggttccagaagaggttaatgtgttttaaatacccttgaatcttgtggttgtatttgtattcagagcagcttggtttgtgttttatgaatatgggtagtgaattgagccctagccctggagtcaggagatctgacttccagaactctgtcatgtacttgtggtgtcaccttaggtagacatttaatccctctgggtctctgtttcataatcgttaaatgaaataagttgatttgttgatttcttgtttttagctttgatacattctctgcttataccactgattaaataattaggtatgcccttgttttttgttggacataaatatttccagtttttctctgttatagataggtgcagtgaaccatttgtatatgtgtttgagaaaaatgaatatttactgccataacactccctccccttttaaaaatgaatatgtatattctattgtctagtaataatatgttcctgttttgtaataatagagaagaacgttactacctgtcttaaaaattgtgtgttcattagtattcatataaaccgttatggtggtaaaagaaagacaggttttaattagatataaggacttaagtaacctgcagaactggctttcacatacattttatttctcttactgtttctcaaacaggatcaatatggaaattatgtaatccaacatgtactggagcacggtcgtcctgaggataaaagcaaaattgtagcagaaatccgaggcaatgtacttgtattgagtcagcacaaatttgcaaggtacgtgctttgagttacaaggactatttcccagaagagaggattagtagtattgaactataattatcttattttttaatgttgttgttgttgttgttgttttcaaagtatatatagcttaaaagtcaaatagttttattacaaagtataaactctgagaggtcccttagtgggcttcttactctgatagagtcagccactttgaaatctggggaatatgttactaaagaatgtgagtgttacactttgatgaactgaatattttattaacttgtttgtttggaattgtgaaatgttgtttattcagtttccctttttagcacctgaaagaaaggcagtttaccatatgcatatctatatataggccttagtattcttaggatctcttttccagtcttcatattgtgcaagctcaagaatgaaatgcagtagttattcccaggttgtgaaaggtgtcttaggtcacttataagtag

SEQ ID NO: 52585 - DNA, 1055 bp, Homo sapiens
ttatttttttttaagctctaggagttggccgggtgtggtggctcatgcctgtaattccagcacttggggaggccaaagagggcagatctcctgaggtcaggagttcgagacagcctggccaacatggcaagaccccgtctctagtaaaaatacaaaaattagccaggtgtggtggtacacacctgtaatcccagctactcgggaggctgagacaggagaattgcttgaacctgggaggcggaggttgcagtgagctgagattgtaccactgtactctagcctgggtaacagagcaagactccgtctcaaaaaaaataaaataaaaacacaaaagcactcttaagaggcttttctttgttttttgtttttacaggtgtgagatctttttggttactggttattgttacagtaaatttattgttggaaattttactgtaaattggctaatgtctgaaaagactcaggtcctcatttgtttccctgttgtcattgttccacagctgctattccactttcatcatcacagattctctgttcagtagtgctttcatgtttggtgaaaagaatattatttgtccacatgtttgcttgctgtgattctggtggtgctttctttgtctccattagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtaagtgacccaggagagaaataatggaaacaaatttatttcctttgtgagcagaaaacagagtaggatttgtggcatgttctcaatatgcttaatgtactttattttttttgagactggatcccactctgttgcccaggctggagtgcagtggcaccatcacggctcactacagccttgaactgccaggttcaagcaatcctcccccctcagcctcccaagtagctggaattacaggcacataccaccacacctggctcatttttaaattttttgtagagacagtggcc

SEQ ID NO: 52586 - DNA, 1351 bp, Homo sapiens
gctacagttgtgtttgtgctgggcagtgcctccagcctccggtgcttctcatctgagcctgcagcttttgggctctgaactcactgagcccttctcaattgaggggttggttggccattgtctggcaatgatgacccacttgccctcactgagaacaaagttcggtaatgagaatctttgttaatggactcaagttctgagccagacaagacacccaccacccctgagtcaagctaaaccaatccaaaccactgcactggtgttggcagtggcagttgaaggctgaagaagtccaaagtttttaaagtgataagtttcaaaggtatgtgccacgatgctggtgaagggagaaaggaatgttggagatagagcaggtctggagttcatttattcagtgcttagtactagagatgtagcattaataagaaagtataagtaattagaagcaagtgtgaagctattttaaattttcttttaatgttcagatcattgccaattttaatttttcttggattttcatagatagttgaattgttcttctttaattttcttgtttttctttctttctttttggagacaaggtctcactctgtcacccaggctggagtgcagtggcacaattgtccttgttgcagcctcaacctcctgagctcaagtggtcctcccatcttagcctcctgagtagctggaactacaggcatacgccacttcccctggttaatgtgtgtatttttggtagagatggggtttcaccacgttgcccaggctggtcttgaacccctgggttcaattgatttggcctcccaaagtgctgggattacaggtgtgagataccatacccagctgtcgttgtttcctgtgttatatttttgcacatattttttctggtcatgtttctctgtggtgtcttgttctgggcctgacttatgcttcctaccctttattattttactcttctctagatgcaaatttgccattttgggtaaaattaactcatctttgttggaatttttatttcttctggatcacaaaaatatccagggaagccatctctccttcattttgtttataagtattctttgactttatttttgtataagcttcattgtcataattattcccacaattcccatcattcctataattgtattttcagagtaaattattctcttctgggcccagcacagtggcttatgcctgtaatcccagcactttgggaggccaaggtgggtagattgctagggcccaggagtttgagaccagcctgggcagcatagtgaaaccccatctctataaaaagttggctgggcatggtggtgcactcctatagtctcagctgcttggggtgcta

SEQ ID NO: 52587 - DNA, 1548 bp, Homo sapiens
atgccaatctattttggaaatgtgtttcgaaaactggtgtccccatttaggacccagcacattatttcagattgttataatagtttcacaaaacgtgtcacttaaggaggaaataatccttgtaaagtagttttagcaggatcacaataaaatattgccaaaaacaaatttttctaaggttcttagagaattgtctttggacaccgactccagtatgtttcattatcagctagggtcacaagaattgttaaatgctgcttcttggctgatcgtttggccttgatttcttgttttacttctgttaatttgaataatgttcacttgttgtatcattgtctttggaaagaatgagattgttaggttgatgtcttttccctctagtgaggtaaaatttcagagaggcagggacttttttgcttaccattgtagcccttattatctggtattggcaaccctaaggtgtagatgcagaatggcacaaaacttcgagatgaggaggagtctggtatggggaggaaaatgctggaattctgcacattacctaccacaaaacaaatttgtaaatgtcttaacatctcatcctgtttgatttgtatgaagatgaaaaactgacgtactcaagttttaccttcccaagttttttcatgaagacttatgttttttcaccctgaattcttcagctttggactaagaaaccaatctaaacatgacttttgtatttttgattttagaatgactttgcactgccgttttgtcacatatataaaaatactgagctttctagttctggaggctgatgcaccttggggtgacaaaatgtacaatggattatagccatatgatttggaccaagcttgagaacttctctggatcttagtttcccttgggagaatgaggaggttggatgggctgagaattcataaagtctcctccaatctcacgattatgtgattgaaatgaaaataataagccaaggatggaaaatcattctaagtagaattttaacattgtgtagcctcacttcttgattctactgatttttcccctcccaactctgttaccttgtgtaaataggagaaaaaaaaatcaattctcttaatgatgtagaatactatttcaaaacagtgtgtccatgtgtgctttggcagtaagagtgtaggattcttttttttgacacacagtcttgctccattgggcaggctggagtgtagtggtgctatctcagctcactgtaacctctgccgcctgggttcaagcgattctcctgcctcagcctccggagtagctggagttaacaggagcgtgccaccatgcccagccaatttttgtgtttttagtagaggcaggattttgccatgttggcgaggctggtctcaaactcctgacctcaggtgatccaccctccttggcctcccaaagtgctgggtttaccggtgtgagccactgcacctggccagattcatttaatagtatgaattaatgacagctttgaggaattatgtgtttgcttagcagatattaatagtgaaactacctattgttgggtat

SEQ ID NO: 52588 - DNA, 1601 bp, Homo sapiens
atggggtctctctctgttgtccaggctggtctcgaactcttaggctcaagccatcctcctgcttcgacttcccaaagtgttgggtttacagacatcagccaccacgcctggcctgctatatgttttgatacgccttttggtcatatgtttgttttatctgtgattcacaattattcccttgtcacccatcaaaacagcattatcagtggcatgaaggttgttggaactacagtcatttcaggctgtgtcacaatagaaattgttaagagctgtccatttgtaatgaaaactcgaaaatttttcatttttaaggcatctcctgtcttgtactcattatgtctcatccatggcctggaatgtcttagcgattttcacacttctatttagtggcaaaatcattccttcaaagacagctttttcatgggatcccctgtataaaacagaccaatctggatgcctgattttttagagtgggtttcagatggaaatgggggttattcaagaatgaaaggaatctccgcagatctcagaatggaaaaccactccagtctgagtttgttttgcattttctgagtttttattgctggtgctcaggtgctaggttcacctggtcggcacatttcttcctcatttcatttactaggggccatgctaactgttgctccagccttactagcagtctaccatcaacggtaaaagcattcccttctcaatctttgtgcaaaagtttccttccaggttgttgagttgacccacgaaagtcatgacgctaatagaattgtcttgacacaaaaacaacagcattgaagaaatcagaaatggtgcaggctttcgggtgtgggaatgcttttttctctcttgaatgaagttgctgaagagtggtcttaagttatcctgttctgtaaccaacaggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccaggtgagtacttggctttggcactttaaggtacccgaaattgtaatgccttaactgtcttggctcagatgggtatctacttaaataaattgccatatagtaattttttaaaagcgtgcctcttagtttgcatcacattatttcatagggatttaagaaacaaacatgaacacaaagacatacatacacttcggctgctttaagcattatgaagaatcttttgctctcaaagagttgctattcaaatacaagtttgatctagggtgctgaggagtaagacagctctaccacctttctttgttgttccactctgtagaagtgacagtctatgtagagacgagagaagaaactattatagaagacagaatttggtttggtttaccccttcctgttgggctgctgcagtgggcttcacagaaagcga

SEQ ID NO: 52589 - DNA, 1943 bp, Homo sapiens
aatgtccttgtagtatgtacttgtctgacatctaaggagataagaggcaaaaatcaaaacttcacggtaaatgtattaaccgtttttgtaggcgtattaactgttgttcagtccagtcctgtgtgtggattagtcattatgtttttgcccataataacagaacatccaacaaagagtggcttaaacaataagtgcatttattggcctttataactggaagtatagtggtagggcagtgttcagggttggtttgtcttgtcattaaacattgtcaccaaggacctggctcctttataatttaccttccattttggtcagtgaccagtttcttaaaatccctttaaattgttttcaaaacattgtgtgttcgccccataccttcttctttggtatgtttgttgctattgccacactttccccatacctgccaacctaccctgttaccacctctttgtccatttctccccagcctcagacaggtaagacagaattgtttctgaaatggaataaagaacagtcttggccgggcgccgtggctcatgcctgtaatcccagcactttgggaggctgagatgggcggatcacatgaggtcaggagtttgagagtagtctggccaacatggtgaaaccccatctctactaaaagtacaaaaattagccgggcgtggtggtgcacacctgtagtcccagctacttggacggctgaggtgggagaattgcttcaacctgggaggcggagattgcagtgagctgagattgcaccattgcactccagcctaggtgacagagcaagactccgtctcaaaaaaaacaaaaaacaaaacaaaaaaaaacagtcttatgactgctgttttcttttcagttaatctcctttcttccttaaaaaaatcacttttcatttgaattcagaaatactgtggaatttgacaagaatgttctgtagaacaagaaaacttgatgaaactgagtcagaaaatgaatttcagaccccgaaagggccttgaccctggagtcaagagccctgttctgaattctggccatgacaattttgggttttgtatctttggatgaacatttcacctctctgggcttaattttctgttacataaatgggagttgcaaactccttttccaaaatgccagtgagaattccagagaaagtgtatatgaaaaacttctaacatagaattgggcttaggacaaatactaagtaaatattttacaaatttctgcattgagtcattttcttttggtttcatcactttgattgagacccagacttttgaagctgggccctggaattctgtgaagtccagcctgggtatctttttgtggctaccattaaaccccaaaccagacatttattaagacttgtgaagagttgagaagtagttaatattggatgacttttctcgtgggtttttaattgttattcatctaaactttttgtggtttatgtaatatttcttacctcctttggccttttgtttaaaaggaggtgggggaaacaaccccagaaaggcttggcatcttttttctattgcaatcaaaatttaaaatgaaataaaataagaactgttttttgttttgttttgttttggtttggttttttttttttttcagatggagtcttgctctgtcgcccaggctggagtgcagtggcacaatctcggctcactgcaagccctgcctccggggttcgccattctcctgcctcagcctcccaagtagctgggattacaggcacctgccaccacgcccagctaatttttttttttttttttgtattttttagtagagtcggggtttcaccgtgttagccaggatggtcttgatctcccgaccttgtgatcggcccgtctcagcctcccaaagtgtcaggattacaggcatgagccaccgtccctggcctgttattttgttattttaaaatactcataatt

SEQ ID NO: 52590 - DNA, 1074 bp, Homo sapiens
ttcttgagtcagttttgataatttgtgaccttctaggaatttgtccatttcatctaaaatgccaaatttgttagcataaaatgtactattttaataagtgaaatctctctctcaatcttcctctcccatcttccccatacatgcatatatacccatgaatgtgtacatataaaatatgttgtgaccctgaacaaggcagatgttgcaagtatttattttgtttgacttatgtgttacatgtctcaatttaacagtattattaatcatagttaataaatatgaattttcttaacaactagatctgtaactctcatttgtggtttatatgtgggttacatagaaaaccttaaactctcacctataactgaaacatccatgtctagtaaattctacttcccatctcaaagagaaaaaaagtaagggatgtggatatgagtgtccccaaagactgactgtaatggtttcatgccctgcctacccatggatctctttatcctactcccccgccctttctcacccctcatttcttagaatgcttctccatgcttacagttttttgcacaatcccctggctgtatcatttaaaaactcttaaacatcaagaggtagcaggtacagttttttgttgacgacacccaggcttttcatttgccctggaagaaaagtgttgtggttgttcattacttcagaaatgaaatatataatagtaaaaatgagctcaaaagttcataagctgtctagggcaaaaaaatgaaagcatttataactaaatttcaatttagttctaaacttagttctaaactaaaaagcatttagttttattattgtgatagaagtattatcttctcaaaatgtattctttctgtcctttatcttcagggttttatacgccttttagttttttaggaaaagcacagctcaaacagaaaatacctttctctgtccttgcttgaactgaaggagaagtttctaagttactggccagtaagcagtagtcatgtatgtgtttaggtatttccccattctgaattgaaatgaatattttgtgatttctcacttggttctttgaaggag

SEQ ID NO: 52591 - DNA, 4180 bp, Homo sapiens
gcagaaatccaagtcattattttaagataattttagaggaggggttgttttttgccacaggggcaggagtggaggacgtgggaaagagtagtgagaagtgacaaaataatacatttggttgggaggagtaatagttttttactttaagtgtttatatttatttattttttaattaagaacaataacaggaacatctagaagacagcagtgtgctaaaataggaatttgaaggatgtgtatgtgcattacatggttctagaagaaaccctcaacatagatatttatggaatttaagattttaggaagtagttgtatttaatggatacatttgatgtttataccccttttaatctgtatactcttaaaagcaaccagcatagtgaacttgttctagtggtattttgagttcaaattgaaagtagaaacagaaaatagaagcttcatatgaagggatcaaagacagatttgtatggtttgtgtctgttttgaaaagataggcagcattaaaagattttttgaaaaaagataaaaatgtagtttggaaatgtggccagtccctttcatagccaaacggtttgctttcttcttcatagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcaggtagaaattagactgatatgctcttaagactgaattttaattatttttacaatccttctggaatactggcaatgcatggaaccacaggcagatctggaccaagccttgtgggaatccagccatcccacataatctgtgagatgatagactattgaaatcaagttatacagatgggacctatttcaatccatgctcatgtggctacttacttaatcagtttctttcagggatttgaaatctagggaagatttttgctgtatttgggaaaaatattgagggaactgtagaaattgatatcaaaaactgagggaggaggacttactaaagatagcagagctgaaatactccacaattgagactgagccgagttcttggcctgcaggccttaaagagttacaagttttcttcagtcttttgagtagaatttaaggtagacatgtggaaaattaggaggaaggatattagaccaagatatttttaatgttttgatgaaaaaagcaggagtgtagtatggtgaataatgggataattgcagagattataaaaaacaaacaaacaaaagtgatccctaaatagaagggcatgtgtgaaagaaagtatcttaattggaattgagggcagcattaactctcgattgaacccactgagaaaacaggctttcatatagaagtcttgtgtagtggggcagtaccccatttacaaatcttttttctgtatcccatttttctacttgaaccttttcaattgatgaaaggcattcttctagtccattttcttccaccttttccatagttcatgtggccgtcagagctttttaaccctcccttatcctataatatacgacaccataggaaggtaaatttggcatatgtttgatggtcatgttaacctgagccatgtcctctttattacttatctgcccctagtactgctacattaacagttaggctgtctctgctgacaaatttgcggtggtaaggagtctggatcaaagtgttaggaacaggtcactgggcttgttcttcgaagaacaggcctgttcttatctgcattgttttaattccattttagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggtaagaaccattactctaacaccaccttgaactctagaactctcttgccaccgatgacattacaagaactttgcataagcaaaggacagtccctttatactagaagtgtcctgggtgttctgtgccttccgtaaatacctcatgttattcaggctgtacctatagatagtatagcagttttggctttattatagtttgggtacattccctgtatattcagttagctttagtatgaacattttattctttggctacctgtgagagtatttcaatgtaaacaatataaacacaggttcatttcagtgaagctaggaaacacagagacagaatttaatcacctagtatcaccacctgaaataccaccacaattaatattttgccttatttcctttcaaaatttcccctctgctatatgtacatataatatcttgctttttcacaaaaagcattttatttttaaaattttgccatattttaaaatatttgtaaatataaactctcaaaccatatagtatgttaatgaggagatgtatatttccctattaaatatttagattgttttatgcatgggattttaaaatattaccatctagattctagaaaatagggagagaaaaagaggatcccaagcagcaggctataagaatgaaaagaaaattatattaccttttttttggtggcaaatctctaaatctttcaggacatgggagatgttttcttatctcaagcatggtgcatactcctctcccgcagttatgtattaagtttaaagtactgatttatttgctagatggggaaaattgaatgctagatgtagagtcaccatataatgtatcatgcaaaccagaacacttttgtgagtggaagggggtgctatgaataattacttggtgatgataggcctaaatcaggactgtcctgggcaaatcagcacatgtggccactttaccaagaagattctgttcttaaccagcaagattaaaagtggcttcatggactcagaagtgagaacttgactaaaaacaaacaggatgccttcgtttggataggcagactagaaagtgatttataagattcaagagaagtctgaagtgggtagggtaatagacttattattctagacctaggagtgatagctttgagtttgaaagaggcgagtttcaagtcaaaactatgtttatatatacacattggcatgtgtgtgcgtatcctgaagttttatacagtaagaactttagttgtagaactcattttctcaggttatatatgaacatcactttataaaagttactgtgacattcctgattagtaggtccataataggtagacagggggatggggtacattgcacaacagtgtttcctagtgacacaatgcctggctttaaacactgggggttaatgcagaatctggagagagctgtcaaactcccagtttgatacgtggctagaaggaaggaagtaatgttcactgacctggcatttacctgctggtgttaatggttttgggtcctgtacatacaacactggaaggtataggtattatttcgtgtctcaggacttaaatatcttgcctagcctgtgtcatctcagatttgaacagatttagaatcaagccttttcgactccaaagcatgcagtttcagtgtatatcctgttacatgatgtactcaggatatcttgaaccagtccattaccaaatccagaaatatgtatcttttaatttcttggtttaaaaacatgtgaactatgtcatcccatactacatactaaataaactgaacctgctaagtttttttttcataaagagccagatagtaaatgttttaggttttataggccagatggtgtctgtagtgaatatttaactctgctgttgaagtgtgaaagcaaccacagacaaaatgtaaatgagtgaatacgtagctatcttctaataaaaccttatttataaaaatagatgggccaggcatgatggctcac

SEQ ID NO: 52592 - DNA, 1526 bp, Homo sapiens
aatgtgtttaaagtaagaatggtagaatgaaattccactctatgaaatgttattaattgaatttatacgctaacagctgtgacatataaaaaccattatagggaaacaatttacaattaagttttaaaagttgacccaacctgagcatagggtaggtcttctccaatgaaaagaaagtggttgagttatttctgtcttcctttcccaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggtgcggctgcattgttattcctaatactttggcagggaaaaaggctgcacgtttgaggtgattacagaggggaatgagcagtgctttcaccttgcttaggcttgtcatgatttggggactggcaaggatgatacacacttgccctcacttagactatagttcactgatgagagcattgttctgagccagtcttaagtcatattggaggtatctaaatgtccatgcagcttggaatatgtggtttttccttggtggattatctgttttctgtttcagaatcagggatagatggagtggccaagctagtttacaaggcttagtctttatgttgatgtttttgaacagcatgattagtgagaaatttctggtataccttgatagggtcatcccttacgtttttaaggtttctcttaaaccaatagtaggggtcctttttagctgtctacctctgagatacatgtttatatagatacatcttgaatatatgttgtttttggttcactgtcagctggtttggtgctttgcatgggattagatgtactttgatgttctacatgtgaaacaagtctttgagagatgtcagcgtatttttatggacctttactgatcatagagcatagccaatttaactgagccatttatgaattcaataaataactttaacctgtttcatttgttttttagttactgagcctttgtgtgttcttaggaagtcacctgcagtttttcatatggcttaaactgggatttggagattctatctcacataatattgaaagatcatgttatttaaagcctatctaggtttttcctgctattttgcaggatatttgttcttaaattattatgtagtatgaaagtactatgatttttataatcatttgtagcctctgtttattcaactatttaagtgatggagccagtatataaatctggccaattcaacctcaaagctgagtttgtgattattgacaatatgttggtgcccaggagatacttgtttgtttaacatatacatttctttgttggcttgatattcctaggttatccggtgttggctcctgctgcttactatgaccaaactggtgcccttgtagtgaatgcaggcgcgagaaatggtcttggagctcctgttcgacttgtagctcctgccccagtcatcattagttcctcagctgc

SEQ ID NO: 52593 - DNA, 1551 bp, Homo sapiens
taaaatagttcatagtgtaacagcttttcttagcaacacctttattctgtacccaggtatagtgtttcagtgtgcacccttgcttgtaaacagcttcttaatcttttctaagcccacaggtatagaaaacaccaaattagaaatgtcaaaacatatttatattgggcagtggtacaatttgacttatttgtgttttggaagcttaaaatgggggaaacaagaatatgtgtctatttattttggcttaatgaattatgtgtttctccagaattagctgtagcatcagagtagctgtaatatttgaaacagctcttcagaacttcagtcagtgtaaggaaggtttggttactgttaatgaatcaagttggaaatatttaactctctgctttaaggaagttcaacttggagatatgtttcagcagatttgaagaattgactttgagcccatttcctggttagcaaatgtgtctttggtgtttcttgctaccagcttcgtcatagaattctataattagatttctgccacacttgggttgatatctgcataattttgttatatctctgttgtgtactttatgtggccgactgcagctgtactttgttgccaaggaaaatgaacagataatttggattaaagcagaatgcttaatttttttttttttttttggagacacactctttgctctgttgcccaggctggagtgcagtggtacaatcttggctcactgtaacctctgcctcctgggttcaagcagttctcctgcctcagccttccgagtagctgggattacaggcatctgccaccacgtccggctaattttttatatatttttttagtagagatggggtttcaccatgttggccaggctggtctcgaactcctgacctcaaagtgatccacccaacttggcctcccgtaatgctggggttacagagaatgcttaattttgtttaaggttctcaacaggtctgtaacaagtcaaggtgttgtattttttgtttctatttgtgttcaacgttgacttaaatttaaaatttcacatatcagtgtctgaatgtagttgtgttgaatgcctttgtgactttaaaaatagaaataggggccaggcctggtggctcaagcctaaagtcccagcaatatgggaggccaaggcagatggatcgcttgagcccaggagtttgacaccagcctggggcaacacagacctctaccaaaaaaaaaaaaaaaaaaaaaaaaattagtcaggtatagtggcatgcatctgtaatcccaggtattagggaggctgaggtgggaggatcacttaagccggggaggtcagggttgcagtgagctgagattgcctcattgcattccagcctgggtgacagagagaccctgtctcaaaaaacaaaaaaacaaaaaaaacaaacagtaacagcaactttgaagttgcagtggaggttcagttgagtgtctaggttttgttgtcagactgatagatgttctttttctggagttaatgaaacaacagcactccgttaaatcaccttaggtgccattcttatcat

SEQ ID NO: 52594 - DNA, 1616 bp, Homo sapiens
ctttcccttgagactagatttttaaaagacaggcatctttgttatttgactgtgtgttgcacagttaccgtcaccgtgatgggaccataaatgtatgatgggttgaattcaacattaggacaaacaaaatgtcttccagtttagatattcactgggggaagatccctccaagtcaagttcatcatgactaaatattacttcgaaattttactacttattatgtaacatgtaatttgcaattatgaacttaaatgtagcctagcatttcttagattttttaaaaaattgtttacattttggcatggttatgatgggaagatagttaacatagggtcatctggctgtccgtggtcatcccccttttgggggaaaacagaaagctcttcgtaggagaatgatctctgctaaccatcattaatatttattgagcacttaacttttgtcaggcattgtcctgaatgcttttctttcatatgatttttcagatgatgattttagagattagaaatttgtggctcagacagctgccttatttgttgttttttgtttttttgagactgagtcttgctctctcgcccaggctggagttcagtggtgcgatctcggctcactgcagtctctgcctcttgggttcaagtgattgattctcctacctcaacctcctgaataactgggactacaggcacccaccaccacgcctggctaatttttgtatttttagtagagatggggttttgccatgtttgccaggctggtctcaaactcctgacttaaagtgatccaccctccttggcctcccagagtgctgggattacagttgtgagccactgcgcccaacctagagagaactgtctcatttgaagtcacacaatttaaatgttgtagagttggggtttgaaccaggtttaactccaaagctcatgcgtatgcttcactatagtatatagaatgcctgtgctgtctgtcttgaattgtcttttctgtactttctttagaagtctttactaatttatgttacttgaaacaaagaactggtcttagggttgacactgctgctgtcactgagatggtagttcggtgatcagaatcttgttttttgtatatgtcagttgagccagggtgaaaatgagttaatactttcacaaataacaggaaatgttaactgttaaaactatgaaaatgtgtattctttgagggtgtcagtcacacaggaattgaagtgggcatcctgatgtgccaagctcagttgatttgccctgggatgttttcctaaatttaaccttaggccatgtgaccagcgtatagtagtagaaatgccagttgagaaaatttagagagtaatgcagatgttaatggtaatagcagtccttgcccagtagaggctcgcttttgttggcttttgggagagcgttgggactattattgcaggttgcaaccactcattcaaggtagatacggctgtactcccaacatgtattacaggttgagcatccctaatctgaaaattcaaaatctttttgagtagtaacatgacaccataagtggaaaattccacacttgaccttgatctcatgtgatgggtcatagtcaaaaccacaggcacataacacacagtt

SEQ ID NO: 52595 - DNA, 1794 bp, Homo sapiens
ctgcctagacgtttcttccccctggaccttcttaaggtctcttagagtgcattaagtataaacaagtagaagtagaatttttttttttaatgtgtcaaaatggcatgattgagtagaaaggagatagctaatcttggatgtgataggctatagaagaatatacttacttccaacctaaataaataaaggccaggcataaagtccttgggtctgataatgtatagttgtagatggtaatctttataaatacccatacattttatttcatgaaaactgtttggaaaattgttttaaatagaaataaatacttcatcccattttaatattagtctttaaaattgttctattgtaggctgttacaattttaataatcttttagaaatgctgaatttataactatatacagttttaagttaaatatttctttagcaaaggtaaaatttgactatataaacatttcattataatctttagtatagcagttatctttttaaaatttctctttaccctcaacctgtcccgtcttctcttttttcattttttccttatctactgtctggagtgaatagcgaaactgtgtaggtatttgatagggctgcagttttagtcaagtttgtttttactgacaggtatgttttcagcaggtttagctcccgctgcgtttgtccccaatccatacatcatcagcgctgctcccccagggacggacccctacacagctggattggctgcagcagcgacactaggtgagacattctgctgcatgagggattttctcacctgctgaaaagtcatttgagatgggcgtgcattctttatactctttcccaaatccatgtctccagtggagattatccagattttcaatgccatctacctgccagcttaatatctctccgtagctgtatcataggcccctcagacttgaaaatgttcaaaggcaaattaatcacatacgccttgcatatgtgtttttgatccatggagccaccagatactcatttatattttgggaatttccccccttgcccagatctcctaccacctctagtctatcatatagttcaggtacttttactggtctctaatgtatttataatttccttgcctctctcacctcctcttcccctctaaattgttcaagaaaatgatttcaaacttagatcttacctcttcatctttctgcttaaaccttttattgatttcccttttttctaccctagtatgtcatactacagttattaccaaacatggctgatcattacaacttacttggagtcggggtgggggtggtggtgttttgttccttggaatcagtatttttaaggagcttccagataattctgtgggttagctagggttgggacccacagtatatagggctctatcaccatgcctcatacatacaggtctctacatatgtaccacccaattcccttcctagttgactgccattggctaacaccatacattgtagcagtacagatctgattttagtttgctgcagatactgcattggtttaggcccctgtctttggtcactgtggtcttctgtagtaagctctttttcccattctttgcctgtgaagtgccctagttggctaattactgcactgtttttatttgcttgtgggatgtatacatgagttttttcccctctttttttttttctctttctttctctctctctcttttttttttttggagacaggatctcactctgttgccgaggatgggatgcagtggcgtgaatacagttcactgtaaccttgaattcctgggcccactggattc

SEQ ID NO: 52596 - DNA, 2452 bp, Homo sapiens
cacaagctgatatgttaaatgttgcaaaaggttttaggccaagaaaattccagaaacccattgaagaggcaatacatgtttagtggaactatgagatgttttcacaaccttggaaataatttaaaagtaactttctactgttttacttatttcccactcctggctgcccctcttgggtggactgcctcctgttggagggaatactgtgtgagacacatctttagtaaaacagaaatgtgaaaccaacttgcagaaatcacaagcacactgttaccaaatagtcttgactggctcccttcctggaggacaaatgttttgataatgtctgtcagtagattcagttcccctatttctttttaagacttgatatttagtaatactgtttcttttttgccagcatcgcagtgaagtttttctttaacttttggggaaaaacaaaacaaaacaaaacaaaaaaaactaaagtatttttgaaatctgtgcatggttacttttgacattcatactccaaaagcagagactaagactaaagagttaacaggtgaaattggccaatatcttcaaagtattcactttttgttttcttttaatctaaaattagcctcatgtttgaggtgtagagggtagccaaatctcaggataaaatctctccaccacctaagataagagtaagtccagtcatgacaataattaagctgagttgctagaatgacattatctcctaatgtctgaaacaatcaggtctctttatgaggacatctgtaattcaagatccatggtgtctgttaaacatcatccagcaatgtcagctgagctgttgaaaaatcctgtaggaagagcaggtaggttgaaggtcctatccagggaggtcacttcagtaagtgctttcagtctgattttagcaaacattgaagtcttcagtatgactccttggaaggaggcccattaaggtgatccacaaattaggttactggcatcccctttctttataccaatactattcatactaaaatgtaatctccatcagggcaggattatgtattgttttattgactgtcatatccctagttccttgcacagtgcctagcaggtatcatttgtttcataaatatttgttgaattaatgagtgaatgactggttttgtattaacgtagaatcgtaagacattcttagtgttgttaaggcctttgaactttcttttctttagaactaagaagtgtgctaggtgtgagctcataatccaagttttgttagtagctgctgtgtttctgctgttttatttttaacatataaagaatagtatcccagaagactctggagctcccgaaagttgggcaggtgtcttaatttactcattaggataagctactagttgaggaagttattcaataccattttcccaggaagaggcagctcagaggatgaagtgaacacttttcatattcttctccaaaatgtgagtaggtgaggattaattcagttatttgtggggtcttgaaagcactgaaaggagattcagcactagggacaatgtgacaaatcagttggtagtacatttgtctaatttttaactttgccttggatcaggcaggacctgtagacctgataatctttagggcttttgaatgcatatatatgagatatatagatagatatatagatatagatatagatatctcatatgtgtgtgtgtgtgtgtgagagagtgtgtatttgtggttcaggggacatataatctgtgaagcggtcagctcatggaaccaggacacagtaaattgaagtaaagaaagagagacagggagaacagaagtatgaaacattttaatcccatgggaatgaagtagagtgtgagaacatttattgttaaggtgtcacgcctaaacaagtgcttattaaaatttttagtcagagaggtttttaaatgattttgtaagacagtttccctaaccacaccgtgtttttcctcttgcctcagctgttccaaagacctaatgcgcttgctgtccagcagttgacagctgctcagcagcagcagtatgcactggcagctgctcatcagccgcacatcggtaagtccttaagcccatagctctttcatgataggtgtggccgccattttaggataactggttgctgtgaaacccagtaatttaaactgattataaaagttcagacaaatccctcagacagagtaagtggcctcttccttttgtccagttgtctccagccacattagttttgacatagcttgtagacccgcatcataacatttcttcagtgttcagccattgccctacctcagatgtttcaggatttaaagtatttatcagagtaatgactggtgactaccattagctctttcggtaagatttggatgacattgattacataagttgtggttctatagactaatatatcagcttcttattttgtgaacaaacagtataaatc

SEQ ID NO: 52597 - DNA, 1001 bp, Homo sapiens
cttgaacaacttgtgaaatctacccaagtgaattataattaactgcgtcacatttatcattatactgacctttgagcatttcccccaactcacagtattttgtttctcagttatgggatattcgcttgctttgtgaaaaacatgaaaatgttagcagagctcagtgctttgcccagcagatggcatttgtgtgagtttttcaggatcctttggaatctgtcacttgccaattacccaatttgttttgaatactctgtatttccagttaatattgcaccatttacataaagagaatgtgccaaaattgctgtaatctgttctgtaatcaaatctgtctgctgtagatgtataatttacttttgttaagttgtttactgcaaaatggtctcaagaaaatccttttctattcaccataattactaagatattaatcagctctcaaacataggctatatggggtctcttgtaaggcttgtttgcttttagttaaaagtaatagttcctgctttcagaatgttttaatgtggtggtgaaaaccacaagctaatgttatatggaatgattacttttgtggtattcccacatgccatgtatttccgtgtatatttacagatacagtacacatacataaaatgacttacatgtaatattaaaaaaatatatagcccaggtgtggtggctcacgcctgtaattccagtcctttgggaggccaaagtggaaggatcatttgagcccaggagttccagaccagcctgagcaacgtagacttcatctctacaaaaaagttcaaaaaaaaaaaaaaaaaaatgccaggcgtggtgacatgcgcagctacttggaggctgaggcaggaggattgcttgagcccaggagtttgaggctgtagtgagccatgatcacgtcactgcatttaagcctgggtgacagacagagtaagactccgactcttcaaacaaacaaaaatatatgaagtgaggttaagtcagatggaatggcagtg

SEQ ID NO: 52598 - DNA, 4356 bp, Homo sapiens
gacatgtaggactacctctaggattaactgatctctgtgtttatttatttattttttaaagaaaggtcagctgtctgaactacaaaagaggggctgttagtttcccaatcttgttaagttctcccttgtggcggaagcagtttgattgaccatgaatttctgttactctttagtagttttgtaatagatcgttaatgcagacttctaggtttgaaaggttagcatctcattttgaagtttagaaattctatgtagggaaattagcttatggtctttggagattattatgccgtgttgtacctttagttattgtcataaatagctgatactaaatgaattttgattgatagagtaaaaagttaaacatatgaagtttccctttaagtctcctgtgtcgtttatgaacaataaatacctttaagggattgtgtgaatgtgcatattcatataaggttaaattaacaaaatatctttcagagagagtaaactgaaagtgtacactcttctccgtgcagttcttagtaggtatgcctgcctccccatatgaattgactctctgtgctttttttctctttatggccatttttggttcttagcttccattcccagtgtaatgcaatctaacactttctgtgttttttaagaagggtttgtctcagatttcttatgaacaaaaatatatggttctctcttttttttttaaactgttctttacttcataatcagagttgatattcttttttgatttattgatctttggtttcaaaataattttaccagtttttggagactggacaattattagaacttgaacagaaatgtacttctatgtacccacaagtagttagcatgattacatcatagctaccacttattcaaaaatataaaaccaagggtgccctcaccatatatctcagcagttattgaaagtaaacattattttgaaagttaatctcttgttggattcaggtttcctgtgcatgtcttggttgctgcaacatagaggcatttttacacagacataccactgtcatgatgtgagtgttgttttatctcatgggccataattcttttctgagtagtttgttttatacattcttgtaccgggggccctaatagcatacctgggaaccactggcgtaagcctcctatatctttaagaccctcaatctctcggtgttcctgtataagagctagtagttgtcaagaaggaacgattccttttctattggaaattggtgtttgtttcttacattttatcccttatccttttagttttcattacattttattccacttttcatttctaatttacgtccacctcatttgtcaaggttcagtactgtcaccttcctttcttagtctccaaaccaaaaagctgtcatgtctgcctccctagaactccatagcattttgtgtttcctttaagagaaggtgttaccatgttttgtcttgtgttgtgattactcgtctaatagtccttgccagattgtaagctccttgagggcaaagactgaaccttaccccatttcctctgcattgctttagcagaacaaggtttcaggggactttcccccatccctattataatatctcagtgcatcctctgtacgtaatatgcttcccaaaattaaaatttgaaactagcctttcaggaggtctggaggctactctttgagaactaccgtgttttctaatatgtgtgtcctttggatccagcttaccacttatatacaaataactatgctgtataatatccaggaaagttacttcttggatcagaacttaatattttaaggctcactctgttgtcatctgatcagaagccatggtctctctcatgagaaaaatgtacataattctctgacactcagttttgtagataacttcagggagaccacagatttgtgttctacagatacagccttctgttcatatcttttgttctttgtagccaaccatatctttcatgaatagagtaagattccctttcttcttcttgatttgctctcaggttagtcattgtaactcactttatcatttaaattgtgcatggaagtactcgatgacaagtgatgagaccatttatgcccatattcttggaaccctgcaactatggagagtgtactctggtctcttgggaagggaaggactttgtggaagaagtggttcttttttttttttttttttttttttttttgagacggagtctcactcttttgcccaggctggagttcagtggtacgatcttggctcactgcaacttccgcctcctgggttcaagcgattctcctgcctcagcctcccgagtagctgggactacagacacccaccactgtgcctggctaatttttgtagttttggtagagatggggtttcgccttactggccaggctggtttcgaactcctgacctcaggtgatctgcccgccttggcctcccaaagtgctgagattacaggcatgagccactgcgcccagccagaagaggtagttctttagctgtgccttgaaagacttttttatatacgaagaaaatgagaattctagtggaggaaatagtaaaacagatatgtgttcagtagataatgtagaagtagtcagtctggttggtggttaggttgaagaaaaataactagagaggttgaagagatggtgttgtgagtcttatgctgtgttgcctataggaaatgagaagacactttaaagcaggaattacttaattattatagtttgttttttttgtggttagtgtgagtttagcagcagtttgaggcattctcttactcttattattcagttaactgttgactgttgtgtccttctaggaaccttgggttctgaatgaaacagtagtggaatatttggggaactaagtgctaaattaatgggttctgaatcttatcagacaaggggagggctcaatgaggacaaaggttgcatgcaactgacttgaaggacaggtggaatacattttgttgcaggtcagagcagaggtatggagctgggaatgactgtggtgtagtcctaggctgaagagagtagaagacgagtgtacaagaggacaaggaggtacagatgcctttgaaaattgagtcccggaggccttgagaaccagctggaagtctcagacagtactgatgattgtgagggttggaccagaggtctagtgcagcacatacttttctgcacattctgctctttttatcttggctttctgaaataagcaacaaaggtgatcatttttcttggtttagagtttgctgcaaatggtaggtttgctttatttgtgattttttagaataggaatctggtttggaggttgacaaaataagtaattctctcttttgttatattttctttcaatcttggctttgatttggtgtaataagctggtttcatcaaacttattatcagcctataatgagatacatgacatggagcagcctgcaaatagggaaaaggtaattttcatttaattcattgcaaacttagttcttgttagctgtgacatgggattttgatgagtcagttggttgtctggtcactgttaatcactctgaatttaacccttgtaaggtttatttataagagcaggagtttctaattcttttttgtttgtttttgtgtgtgccgtgaacttcttaataagtgaaccatgtggactacttctcagaataatgtttaaaatgtataaagtaggattacaaaggaaaccagtggtataaaaatagctgtcatatttaaaaacaaagttaattatatatttacttatttatgatatgatgcatgaaatagaagtagatgtactagctgtcataatgagcacaagtaagatgttgagatacttgtaacaactgtaaagtaacatgaaagtatatgtgatttctgtttgtgataatgtcacaggtatattgctaaagttaatgtagtttgttgtctacaatcataattgaagaacatgctaaatttcaggtaaatgtgcatgagataaagatgcagtattacccacccaagtacaaatatcttgggttcagaacctctgacttggagtattttgtcagcttgaaatgctcgttgttatttctaaaatgttcttcctttgtctcaaattcacttcattgtcttcttaatcctggaaaacagctgtgagcagttcatgcataatgtgttcataccattttgtactgtgatgttggagcagtatttattttttacaaaatgctatacagttgcctgtttccttaaatgcagtttagaaaattattactaggttttggctaggcgcggtggctcacgcctgtaatctcagcactttgggaggccgaggcgggcagatcatgaggtcaggagttcg

SEQ ID NO: 52599 - DNA, 6776 bp, Homo sapiens
cttttcttttcgtatcctttattttatctattcttggagtagatcaagtgcccaccccacagctcactgcagctttgaacccctgagctcaagtggtcttcttgcctcagcctcctgagtagcaaggactacaggcgcatgccaccttgcccagctaatttttttaaaaactttttttttagagatggcgtctcctctgtgttgcccaggcttgtcttgaactctaggcctcaacctagatccttccgcttctgcctcaaagtgctaggattacaggcatgagccactgcgtgcagctgatactatctcttaataacagacttttgacagaatggtttcctatttgtgcttttgtttttactcagaagtcagacttctgctggccatttttatggagggccattgttgatttcttgagtttcttttttcttttaagtaaactttatattgaaatatgacctatgttcagagaagtgtacgagccataaatgttcgtcttgaatttctgcaaaatcaaaacacccatataacaccttcccagatcaagaattagaaacttcccttgggttccccactctctaaaagaaggagcccaccattttggttaggcatcaatagcttattcagagtagaaaacccggtattttgtaggaatggcctgtacgatattggtaaaatgcaacacattgcagggaaatatttgaaaatctggcccgtggcagtataactgagaatgtaaattagtggctgaaagtgtaacttagcagtcaagatttcaggccatgccgggcgtggtggtgcatgccggtaatctttgctactggggaggctgaggcaggagaatcacttgaacctgggaggtggaggtttcagtgacctgagatcgcaccactgcactccatcctgggcaacagagcaagattccgtcttaaaaaacaccaccaccaccacaaaagagatttcaggccagtcagcatgtagaagagctgagcaggttctcagtaaagcccttgtgaagagcccctgaggaaagataatgcagagcattgatatgactagtgcacatcccctgcaaccagctgtcttgcttgttgttgaaacttcctactgctgctttatcctcctttctttcctttaaaaaaaaaaaaaaaaaaaaagacgagtttcactcttgttgcctaggctggagtgcaatggtgtgatcttggctcactgcaacccctgcctcctgggttcaagcgattgtcctgcctcagcctcccgagtagctgggatttcaggtgctgcctaatttttgtatttttcttagagacagggtttcaccatgttagccaggctggtcttgaactcctgagctcaagtgatcctgccttgcccttccaaagtgctgggattataggtgtgagccactgcgcctggccctttctttccatttttgcctacagaccttttgaactccttttgagaaattggagctgaactgtttcttctgagccagtgatttgatttgtagactgcggaagatgatgacttaggcgtggcagtgggatgattcttgtaatattcttttgctgttgacattaatggtttctgattcaggcagagttgtcatctagaccatattaccacctccaggactcttatttaatgatgataaggacaacaggaagatcattcttattttaacagttcagttttgcatgatttttttgttccttttaattttcttcatcatatttattgagcttttatcaggcactgcagtcagtgctagggatataaaaatgagtacacagctttagtcagttttgcctctgcagtatggaggaagctattgcctttggatattttgaaagatctttttgcctttagaaccctatcatattcctatctctgctttgaggaatctcaatgtggtgcataattggttatcattcagtccttttaaatcaataacagccacatactttaaagattctattctgaagggcacatctcaatggccgtcaaagctgtggtttactgttttgatgccacatgaagctaagttgtatatcctttctcagttccttgtcatatttgttctttttttatattatctttttctgtatcacatttgaacagagaataactttagaagtaaaatgggctctaaagtagtagttgaaaggtttaagaatgtcagcctttctgggccagtgatctcttaagagcatctgttggttttggatctacaggcctgtccacagtcagtctatttataaccgagtgtctgctgctgtgtcctccattgttgatttctccccattgacatttggttttggtgactgggaatgctttgcagccactctcatcttctattgagtggatcttgccttgtaccaggaacttgaacttggtccatgtgcatttctcttccttaaaccaggagtcagtcgtggggaaaagcaaggctgcttccctctagttttacaagaacaaagggttaaacccttaaccctttggtgtaaggttctgcaaatctctctgtactatgtcaagtcactataccaaatcttttcctttggaaatcaaggtacatgtactttatatgtccagggcttaacttgggatgtcggtaagaggagatagacacttcagagagaaattcttttgtatcaaatgcttcaatttaacatactcccacttagagatctcatgaataatctttgttaccagtagatggtagaagatagttattagaatacttttggtgaaagaatctcagagttaacttgttttgaggcattaaaaaatttaagggtcatcagtgaattgatgcatacctgtgaggcttatagggtagagctgggaggtgatgcaaattgacagggcatatatcccaagatcaggtacagaataattgagttgatatgatgttagaccacacttggctcaatatttagaagtaagggaggaatttacatagtgcagtggagaagtatgaaattctttttacaggcttaataattttttttttctatgctattagctgtcatacctggggcttattaagagtcatgctattatacagagttaggtttgggagtagagaacttgaccaagagctgcaaagttatggctgggctttgggtaggaagaaaaaaaaggaaggaagaaaaaaaaggaaggaagaaaatgggttggtgggacattggatatagtaagactgttctgaactctgtaacataaatgtatgtctgtctccctcatttggcaagaccttctgcagtgttcctgcctctgtgttgtttgttaattagattgtaatgtgtgaaagggcacaacactatcctcttctgagtagcatctagtgtagtctggtgcccacaacggttgcccgttattattagttgatgacgattagtgaagctgaagctattttttaaacagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttaggtttgtatgttttacacttctgatttttgaatatgggctatgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgatagattttgcatttgcatagaactttaaaatctgaagaaagattccagagaagactatttcagtgattctcagatattaaaatcacctaggatagatgccttggaacctttcttaagtttctcccaaattaccgtattagagagctatggttactaatggaatatgtcatatccctctggtggtttagagggaaaaacagttgagaacttgtgcattatctcatttgagtctcatgagctctttttgaggtaggtggaccaggtatcattttccttattttgaagagccagagatgcagcttaaatgatttgttcttaatcatatctcttctgcagatgcctctcattccatctctggtcatgattaatgtacaggttttaccctattatttaagttacacagtattaaaataatgtatatttatcttccacaattggcacatattcttgaaaaatctataaaaatccttgtccagttatatatacaggtagaggatttttttttaatctccagtgtgatagtacaggtagagaatttaattttgagtaattttaatatcagtgtaaagctaatgtgtgtgcatgcacacactcacacccctctgcttattctaatgtctgccaaagtcaaaatgaaaatgtattttggaccatcgttgtaggacaagtgtcagttgttttgtatccctaatctaattattgttaatcttgcatgtgtaaataattacagtcttaaactttttaaaaattatttttatttatttattttttggagacagggtctcactctgttactcaggctggactgcagtggcatgaagttagctcactgcagccaccacctcctgagttcaagcagtcttcccacttcagcctcccgagtagctgggactacagccgcgcaccaccatgcctggctaatttttatatcttttgtagagatggggttttgccatgttgctaggttggtcttgaactcctgagctcaagtggtctgcctgccttagcctcccaaagtgctgagattacaggcatgagccaccatgcccggcctgaattacaatctttggaagaaatttaaggcacagggtaataaatacttacctaaggtctttcagatgagttcaggtgtcctctccaccttgaatatccagcagcctgtagcagtattttgttgtatttaaatgggggctggtggtggtggtggtgagtgtgtgagtgagagaaagaaagagaaggaaccagaataatacctttaatatgtaccagctactggactacaggattttttggggtagggggttggaggtggagaagaagggcattgaatgttgccacaggttacactcttctgtttatataatattatatattagtctgattttggatcatataatcctgaagtccttttatataaggtgatggtagaccctgggttacccagaaccttgtgtcctacaataattatcaatagtgccctgttttttttttttttttttaaatcttaggcatgtcctggtttggatgataaattacatcttcccattacttttaattcttagaattgtctccttaacaggggcatatcctagataatgagttcatcttgtactactttggaatagtctgcttatttcggtttcttagaaaggggagttagttttaacattggtcagtaataccaacgacatgtaaaaacttttttcattctgtttctttcctcacaaatatgccaggaagataaaaactttttagaatcactgagttgtggaatttcccccagaaaccaactttttccattgtctctgtatttaaagagtagatagagtagatgttgcattttgatgcattttgggatctgctttcatggatgctatagacagtgatttttccactttatttcagttttcctcaaacccggcccccttggtgaagggatgtaaattaatagcaattaatgtgaatttaaggggtgagttatatggaattgccggcaatagaagcatcaatttagaagatgtaaccctgtaagccctgtaaagtatctctggttattttatagaaatagttttaaatactgttgataatgagctatgttgaggacattgtccttaaacttgggttgctgtagtccctccccactgaaaataaggtttaatgccctttactttctctgtttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacaggtactgtgtgtgtctctgtcaccctctctactctccctccagccagcacgttgttcaagtaattaagaatggggggatgggggaggtggtggcattgtttcaggctatccatagctagcccttgtgaacctgttagtgatgtaggtttacagagtcccctcatgaagctggtccctatgctgaggtcactggcaagaggccaccgtcctctgtatgtacttcctttggttcttctctctcctcagcagctggggagtggatgaggtagtattgcctcttgtaacacaaccctctcgggtgctaaattaatctctgaagatttatgtggttgtgatgctgttggtttgttttgtttttaaaatagtaaactctactatccaccgctgtcaggagtgtagtgccaggtcatcttaccagttgtgtcttacagttaaacaagttactccagatagcatagacaaggatctggcatctttcaaaagtattagaatgcgatcagaggaaaccacacac

SEQ ID NO: 52600 - DNA, 6069 bp, Homo sapiens
tttcccttccagtaatgaaggaatagcttttctgtccttccaaaatcttggaataggttagtgttgtggttgggaagtattttggttaatggagtctctgtgtataaaggaagtgaattttgcctctggcattccatagctgaggttcatagctggttcatgctccagcttgagtaactttgtctggtagttagtacacgtatagagagaagtgttttaatagttgtaaatactttctttttcagtaagagtccacttagtagttagctaatagggtcactgttagttcccttccccactccttaaaaatcttggcatgggttaagcgagtaattctagatatttaagttcagcctctattggatggtttgatcagtgtccccacccctgccccccaccttgccttaggcctctctgtgacttttaccaaatatatagcagtgttctgaccacagttgtgtagttggaacactttaattaaagaccttcagggcacgtgagcatcttcagtacccttgtctaaaagaaagtgttgactgctgtactttcatcctttatgaattctttaaaagcatctattatttttaatttgcagcagctcttgccaggtaaaaagttttgggaaacagatgaatccagcaaagatggaccaaaaggaatattcctgggtgatcaatggcgagacagtgcctggggaacatcaggtaatctagatctagcatctgtactgtgatttatgcctgtcttagagctcctttcctcagcaattggcaagtcatgaattttacatcagtgacataagcatgtcaagcagtgtcctctcctgtagtataattgccattaaggagcttatatgatgtaatttattaaaacataattaacacaaaatcatatcttcaatattttttgaagtgctagccacaggggaatggtcttatttgaaacgaccataatttcagctgtaacgttttgttctgtactgctgtcagcatacttggaattagaaaatccacacctgccatttgaagttcatgtttctttttctccccttgcccttgtgtaccgtgtatggaatgatctatctttaaacgtgattgggaccaaatcaagtcactgggcatggacattcttctggcatactacccctgaagagggatggggagaacttatagaggcagacacactgacagcagaaaaagtgacagatgatagggaggaaggagacagaaaacccaaaagccaatgtcgtgtattacagtacaacgtaagcatggaacctcatgatgacagtgaattatcagaaaagaacaaattatattgtttttaaaaagggcagtaaaatcatattttgttttagtaatactaataaaatatattaaaaagaaatccttttacttataaaggggtaaaaattttatccactcagctagttaaaccagataagctagataaactgttgtattcctctgctatcctggataaatgaggagtgtgttccatttccttagcttatgttgaatatcatacagtgagggacatgataggaggttttggctcaactgaccatggcaagtttcctgattccattggttatccatgagacatcactcataatttgtttgagcctctggctgcactgtatcatgcttgtgtatcttttttgtagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttgtaagttggcttgaggaacttgttcctatctctctctctctctctctctctctctctctctttttttcccctaaagcaaaacatgcctgtttagtttccttagatgttcacagcattaattacagggtattttcaaacaacgtttgttgtaaatagaactcagcaaacatagtaggagatgtaaactcaacttttaaaaactaaagtaataatgttttggtggggggacacattgatagtattgtgagataagaactgaaatctggatcaaagttcattggtctatcagaaaacaccatttttactttaaaataaaagcaaaaggggggtggtgaaggaattaaaaaaataaagctgatgctgggatgttaacagggaattccagatttgagagcagtgatttgccaatacccgagaaaccttaatatagatcagattatagggctattcttgttttgttagctacgatttaattatagaatcctctttggccctccttgaacggctttgtttctcacacctggcctgtcaagaaattagggattctgttaattctttcttacaaatttttttgattcattatcactgacctctctgatgctaaactgaagtcaaataagtctctgtgtctatagcctttttctttttaagtcttaagcatttttctatgagcatctgtgatagcctttctcaaaacaatttctttctttatcattaactttctagatcgagaagtgttaagatgtatttccatttgagtcttcctcattttgaattctgcgactgttgtcatattccaggtcacagacaggaaggccatgagaggcacatgaatcttcttccctccctttctcctgtctaaacttgttttgtactttttcaaagacatttctccctgcagtcattttgggctgatatcacctgaaaacagtcatttaaaagattttaatgtaatttgtgggaaagaacagcagaagcaccttctttcccacaaattgagaattaatattataactgtctttctttaatagcatttgttgctcagtatttcttagtgttatacatcttttgctgggtatcagaggcttggtcctattttccctattccacattaaattttgttagagtaacagtagttcatttttggtgcagctttctcaagtgtcaagtacagttcttaagtactagctattctaaagctgacctgattgcttttcagtgttttgaccctgcagagacctaggtcaggtttagtagcttgtgaatcagataggagatggctcctgttatttgaaccttcccaaggggctgcttgggaagaacaagatctaccctttggatgtgagttacttctctttcttcaccctatccccagctcacctctttttctgtcctcactctttcctcatcttatgagcacagattcctcagcagaaattagtgttgtgcatcagtaggttgctagtgtggtgaactggaacctgtgactctagctgtgaattctctgtcatgtgtgtgatcagtttctaattcttgggcactaaccaggaggcatgtgcctgcattactgtgaagcttgtaggaggcagaaaaatagttggaattaggaggaagatacatggtgggattgaatcattttgccacttatttttctctctttaaacagtcatctcactagacggttattttgatgacaaaagctgtatcatttgtcttgggagactggtgatttacctcttttacaaaagaatcgtgacagaggaggttaagacttcaggctagatagatggggccagaagattggactttaaccatcaagataatttactgagctgctgaggtatgcataaagataaatgaaaattctgaagtatgcatgaagataaatgaaaattctccaaatctgtgttccagcttcttttagaaggaagattgtgggtaatggaatattatcccatagtttgacttagattgcatctatagagtgatacaagaggactgatctagtgacatcaagccacttgttggcatatacagtcttctggtggatggagacctgtggctcagtgaactgattattattgttattattattgaggtggagtttcactcttgtcgcccagactggagtgcaatggcatgatcttggctcatcgcaacctccacttccagggttcaaacgattctcctgccttagcctcctgagtagctgagattacagatgcctgccaccatgcccgggtaatttttgtatttttagtagagatccggtttccccatgttggccaggctggtctcaaactcctgacctcaggtgatcttcccacctcagcctcccaaagtgctgggattacaagcgtgagccaccgcgcccggccagtgaactgattatcagctttgtggttgtatcctcttgattttatacctaacctgactttgctctgcctgttggtcaggatgacacctgaccaaagctctttttgtggaagcctgaatcactttatttttgtcatagtatgcatacatcttcttgaggaaagtgagccttttcttttaaagtctagtctgtcatttaaagtgttgaattcagagaaccaggaagataggatttctgcttcttgtagataattgttctaaaggaggagtggtacttggtagtgtatggggtcagggcatccacgtatttttacttttggggtagctgtatcaacattaattccagtaagcctcactttaatcctgagagctgaaagcatcatctctgatggtatagtgattgtagacctcaaagcaagtaactaagaagttattcttaacacactgacaacagataattgagactttaacttttcaggtaaaggtgtttagaactaaaataaatctctatgtagtgttttaccattttcagtgaactttgctggttatggctagattgaagctgtttagctctttgtctagcttgaattcattttgattgtacaaatggtctcagtttagtggttttggcttctgtgataagaatacattctggctaacaagaagaatctggcaaccatattttgttctgagcattcactgtaaatttttggtagtattccacataggaatctcaaactttaggagagcagctttcagaataatagagctcaaaaatatcaatcaagtcttttatttttcttttcttttgtatcctttatttattcttggagtagaacaggtgctcaccccacagccccccatggttcagggtggttacaaaatcagatgtaattattttatttttgaggcccatgggtgagattgccatctaaggaccctgctctctggaataccagctgatctttttcaaataggtggaagcctagccagccaaaaaatggatcatgatttctaccttgctggtttatggtgcccagggaaatgagaagatcactctaaactttgattagggtaatgaccaccttaacctcacagaagaaagatttttagaaaaaatatattgggaaggtctttctgtttgttctgtagagagtatctgctttttgatctggaggatgtatacacattcgtagtatacatctatttgggccgtgaaacttgtttgtctaggtttcactgcatttactttaggtaaccagtgctacttaactttcataggttttgtttgaaaacttctgtacaatgtaatgcagatagaaatcaggggtttgagtttcaaatggaccttaattcatctgcaaaatgagaataatcaaaactcaacaaagtctaattcatacggctgtgtagcatatgtgaaaatgctttgtaaacattagaagtcttactaccaaagtcagtgggccgacagcattagcatcacctgggagcttatcagaaacgcagaatctcagatcatacctgagagcgaatgaatcaaaatctgcattttgacaagactacccagatgatttgtatgcacattaaagtttgataagcactgctatcatacgcgttatctcagaaaactcagctggacaaagagtctaatgattagagccttaaaagtttcctaggggaaaaaacatagtatgtctagcaatttttaagccttggtggggagggctggtgagggcattgtgaaaaaggcaatggggaaaaaatgtgaaaattggataaagtatttttttaaaaagacaactgtactttcatgaatttctttgtttagtccttggaacaacactt

SEQ ID NO: 52601 - DNA, 3454 bp, Homo sapiens
tgtgtgtgtattttaagagatagggtctcactctgttgcccaggcaggagtgcagtagtgtaatcgtagctcactgcagcttcaaacctctgggctcaaggagtcttcccacctcagcctcctgagtagctgggactgcaggggtgtgccaccactccggactgatttttaaaaagtcttttgtaaagctagagtctcgctatgttggttgctaagtctgatcttagactcctggcctcacccttagaaagcactgggattacaggtgtaagccaccacgccctgcctaaaacaagacagttgtttaagcctcatagttgctataggttaggaacctaggcatgactttcctgagtcatctgcttcagggtccttcacaagctgcagtcatgatttcaactttggctgcattcatctcaaagcttgcttggagaaaggtctgtctcaaacttgcttggagaaaggtctgtttccaaactcactcatgtggtatcaaccatcagaatccattctttgctggttgttggacggaggatctcagttcttaattgtgtgtaaatgacccagggcagaggcagagttcagtgggaagctgcggagcaacagctttgtatatgtagctgttgtccagagatgtctctctcttggcttcatgtggcgtctgtatagggcagctcacaacatagcagcagtcatcatcagagtaagcaatcaggacaatagatagaagaggacaagcaagatggaaatcacagcttttgtaacatcttgaaaggaacatcccatgacttgtcttatgttatttcttagaggcatgtcataggtctagcccacagtcaggggaaggggattactcagggtatgagtacttgtaagtgaagatcattaagagtcatttcagatgctgctaaccacagcagttgagtatagacgcatatgttttggaggaaagggagaaagactgagtaagattcagagacttttaagagctttgctaattttgcttctgtctttgcccaagcaccttggttcagtcttttgctttcttttttttttgccatagtggcaaaaaccacacttttgcaccaacctaatagcactttgcttcatgtttgctgtattgttgtttccttttgagagaatttaccctgaaaatagcctcgcttatgtgttcacctgcttctcctggctttgcacattatgacagcctggtatactatcatgaaaggtgacaggatcccagaactgatttttgaagccttgagctgaaaggctgctgctttctgtaagcaattttacaaattatggataagactatatttacatatggaggctggtacttttggaaactgttccttgaggtgtttttttttgtttctgtttttgttttttttttttttttttttgagacagagtcttgctctcttgcccaggctggagtacagtggcgtgatcttggctcattgcaacctctgcgtccctggttcaagcaattcttgtgcctcagcctcccgagtagctgggactatagatgtacaccaccatacgcagctaatttttgagttttttagtagagacggggatcttgccatgttggccattctagtctcgaactcctgacctcaggtgattcacctgcctcagcctcccaaggtgctgggattacaggcgtgagccaccatgctgggccctgttccttgagttttaaataaacatttacaagtttctgtgaggaatgaactcttaaaacatttaaaggacaagaatggttttgatcaccttagcgttctttgcactgttatgtggagcataaaacaagtgagaccctccttaggctgacattctttcttctggaatacaaaagagtagttgcttttgctttgcacaaaatacgggagaaaaaaaatcagaattttaattggagaaagggtataaccaatgaggaaagaaattttatttgtaatcttcggacaggattttttttttttttgaagatggagtctcgctctgttgcccaggctggagttcagtggcatgatcttagctcaccgcaccctcccactcctgggttcaagctagtctcctgccgcagcctcctgaggagctgggactacaggcacacaccaccacgcccggccaattttttttttttttttgtatttttagtaaagacagggtttcgctgtgttagccaggatggtcttgatctcctgaccttgtgatgctcctgccttggcctcccaaagtgctaggattataggtgtgagccaccgcgcccggccttgcaggggacaggacatttttgagactaaaaggagaaaaataagtttaaaaataattattgaattgtcctttgcatagtttacattaattttcagtatcccctctgtgacctggtttgaccgctgttttgcctaggtgtgatgtttttgaatacattattgagaacctgttgtgctaggcactcatcaacaatatttctaatcatcacagcaacttgaacgatattttcttcatcaataaaaagagaatgaggttcagggcagtttagtaagatttcctagggcacttcaaagttgtccagtttagtgcttcccgaccctaatgctaccctcgatcggggctctttcccattttaccctgatcctcaccctcccccaaatgcccttagggtaataagtggtacaccaggaagactgctacttataactgttcattttcaaggaaacttaggtatctgtgcaattaaataccagacaaatgttttttttttttctcaatcttgtttaattagtaaacaacaaattaggtccttaagagcaaaatgtatggcaaactgctttggtccaggcagtaacccaagtccatgagatagattatagagccacttaaaggtagatgaaaattatgccgagaaacccagaaattagatttgggaagcagagatttattttagtgagagcagagtttaattatttttccattatcattgggttatgggttaaatgggaaagttaaacctttatcgtcaaggagaggaaatgttttgtgctttctggttttttattgtgttcttctgagaaattcaactctccaggtatttttgtgctcaaaaatggtggttaaatactatctcaaacatcttagtttcctgtgtaatagcagttgaaaacataattagaggaaataagagggggcattttagtcagtaaagctgatgaccagaaccaagaatgatagagttctgtggaattttactttgtaagcctggtcactggtgctttgatcttatgcaaaactgtactgtgtcttgcttgaagggtactttgcatttttttgttgaagctagtataaacttctcatgttggcttatggccagcgatccctgtttctctgaagcatggagtgatttgtgaagtcactttaatggcattaccaagtattgttaaaaaat

SEQ ID NO: 52602 - DNA, 1045 bp, Homo sapiens
ataaacttacgattcagggtgggataaacagtgtacgtgtgtgtgtttctcccagagatttgagagcacacactattggtggggcagttaggaattccacttaatgtttcattacaagaaagagtacaaggtctatttattttattgctggggatgataggactccccaagtcatggttctcagtttgtagatcttgaaatggactgttattactaattcagatgactgggttgcgatattgaccccacactaaccagaacaacaagaggctaatgtatgaaaaccaaaatgcagtctgctgattttttttttttaaggaaaaaaaacaactcttagatggacaaggatggttgtgtttggtgattggcatggttggctataggaggaagccagttctttaagaaggtggcttggtaagcagagttggagccagggagattacttgggtgtttttagtgtccagtgtaattaagctactatctaaccagatgcattaattgctttgataagaataggcttctttgtgcatcatatgccctgcccttaaatgtgtcacctggataatactggctacatctgattccttgggtctcttttgcttttgttggaccaattcctaattcctgttatcttcttttggaattgtcacatcatttaatcctcttactgctaagttattctttaaaacaaactctacatctctcttgtgatctgttacttttcgccttgtcaaaaaaactagtctttatttccagattcttgatggggtggataggaactatcttttcataggttggatgcatttacatttttggttattgtgtgttaagtgaagatttggcaactgctggtatttatgccagtgggttggcaaactaggatattttacccaacgctgtggatgatgttacctccagagagcttactgttgaatttgaaattgtacttggataacacattatcatttggttttataattcagtagtttctaactccttttaatatgatcagatttgaacagttaggtatcttttagctgactgt

SEQ ID NO: 52603 - DNA, 1087 bp, Homo sapiens
tggctgtgacttttgatacgtatgtagtttctgaggcccttccaaaagaattacgctaaccaggaatgaatgaacttggcttttcttaaagatatgttttaataagttaaagctttaaataaagctttagtataacttaatatcagtatagttcttagtatttataaaagcacttcatatactatctcacttgatttcacaacaacagtctgtggtatggagagactacataagttgtgaaaaatacaaaatttttacaagtaagactaccacctgtgattatcagtggttaccaatcaaacttcctcatttcagttagttctgaaaggtcctttctctgagttgatgtcatcttctcttaatgtactgagagtgtggtgagatatatactaagagattaataattgttttggttgttggtctgtcttaccagctagttaaatatcaagcatttgtttcctgcattggctgcattccagtgaaactaagcttgtgttgtaagttagagatgctagataataacatgatcaaactgatcacgtctgcagggttgtaacatccatgttagtagtatttcttaagatgctcaatttctgctctgagagatgctctgtgcagcctgtattgagtgtgtaagcagttacctaatattttattccttttgagtacagagtagttgctggagagcccttttactgttgagatcatcagtaaacctcattgataaatccctattcaaatattagtggcggtatggtcaaacaagtccaggcaataattgtcttgcctctgcagttcctgaaaagccgtaatcatggttcttgtagtgttgttttgttggggtagttaatgtaatgaggtttgtactgacatggcctaggtgatgccatgatcactgtgtctgatagtttgacataggagcatttcattgacaaatcattagtattgtgatgtctattggctgctactttgctcttttaaagaaggatagtagctgattttttgtttactgtttcagcattgtattatgtcattacatgtgttatctctttcattgtacacaataggtcattttataggtgagaaa

SEQ ID NO: 52604 - DNA, 3204 bp, Homo sapiens
cttcagctaataatgtgctttgtaaacaatagctgctaaatatattgtattgaaagaatcatatcagtaaatattttttcctaagcatagtttcctctttatttttccttttacatcagaaattggtatccttgtctatcccccaagggagctcagttcaatttagtaaatattggttgtattttctgttcacatgacttttctgctctcagggatgttggagtgtacagggagagaataaagaacagacaaaactgaaagcatatattcaggctgtctgcaaatatgtacatttaaaagctattcattagctacttttgcaaaaatatagaagacaaacaataaatcagcagtgctgttacccaaattgaatccgatatataaaggcatttttaaataaaggatcttttgtttaatatagttgttacgttgttacagatcgatggtactttctctgggccatctgttggagcatggaaatatatcctcattatatatacagtaaccagacataatgatgtttagaaaaatagaattacttttgttccattgctttctcaagctggtattaaactatgttgtgtgtaattccttcttggttactgtaaccttgctaataaggaaccataacatcaaagcaaatccattgtattttgattaattggtgcatgatgtggttctcattgaggtgaagcatgtagcaaaagtttattttctgtgttgtattccctatatacatagcaggcatatctatgaaatatttgtttcctataatgaaggaaaaggggaactcagggttgagatccttgtctttttcagatcaaaaatttaaaattccctgaggctaactgggtgtgggtttattagagtatttggtcccatcttgatgtggagtattctttgttatctcagtcgggctgtttgcttcctgctttgggggtgtgagggggtcatgaagcaatctagatgttttcatcattgtatttgtgaactttacagtatcctgaggggtctggagcttatcttttgtatactgggctcacaagtactgtaatatgtaattattaaagtgaatacctattataaaatgaatgtggttatgctatagatcaaaccatgtagtcaaaataaattgttataccaaaaagacacttgcgcttgcatgtttattgcagcactattcacaatagcacagacgtggaatcaacttaggtgcccagcaacagtgaattggataaggaacatgtggtacacctacacccataaaaaaagaatgaaattatgtcctttgcagcaacatgggtgcagctggagtccattatcctaagtgaattaatcactggaacagaaatccaaataccacatgttctcacttgtaagtgggaactaaacattgggtacacatagacataaagaagggaacagtagaccctgaggactccaaaaagggaaagggaaggagggaggcaagggttgaaaaactacttattgggtaactatgttcactatttgggtgacaggttcagttgaagcccaaatctcagcatcacacaatatattatagccatgtaacaaacctgcacatttgctctctgaatctaaaaaaaaaaaaccttgtgtagtttattcatatgtaaaaacacgtgaccttatttataggtaacctgtagataacataacatcccttatatgctgttcctgtatcatgcagaaaagcccgattcactctgggaatttcatcattttatcaacatactttactgtcagtctgtcaggttttatgaagacagtagagaagagaagtttcttggctctgttccattaacaaaatgtgaaggtataaagaaacctttactttcagattcagaagggcacgtgtatgggagcctgttcaggttaattcatgacaaaataacatggagtgtaaggtgctaacagtatttctgaatgttctttaatggacttgctttatgaaagtatgaatgatatcttttgatgtgcttggtttctaggatgaagtcgttgacagacagggttgtattctttggtgtgtgcagaaaacaggaaacccctgtgcgttttgaagtttaatggtagtcatcaagtttgcaattctatctaatatctaatttgtggttgtcctaaaatttgtttatttatttatgtttttgaaacagagtcttgccctgttgcccaggctggagcgcagcggcactatgttggctcactgcaacctccatctcctgggtttaagtgattctcgtgcctcagcctcccaagtaactgggatcacaggtgcctgccaccacacctggctaattttgtacttctaatggaggcggggtttcaccatattggccaggttggtcttgaaaatctgggctcaagcgattcgctcgcctcagcctcccaaagagctaggattacaggcatgagccaccacacccgacctggttgtcctaaaatttaaaagctaccaaattcttatctcaacttgattgctctttttgctcttactgtcgcccagcagcctatagaggatcttcagggcagcctcaataccctttgaatgcataaaacttaaacttttgatactatatgcacacatttggatctgtttgtgtttttattttttatttttgaattttctttttcttcatgtaccccacaggagacttaatggattctgttttcatttagcttttgcactcagctgtctctgcagaatagattcctaattaaaagaactccaatgatagactggcttatgtatacttagtgaattcattcttgatcatcataatgggcaatgactcttctgaaatttatagcttttattttgttttactttatttaaaatttttgagatggagccttgctctgtcacccaggctggattacggtgccatgatcttggctcactgcaacctccgcctcctaggttcaagcaattctcctgtctcagcctcccaagtagcagggactacgggtgcatgccatgacacctggctaattttttgtatttttagtagagacggggtttcaccacattggttaggctgggtctcgaactcctgacctcaggtgatccatcggcctcccaaagtgctgggattagaggcgtgagccaccacgcctcgccagcctttaatttttttcatttttatttttttgagatggagtctctctctgtcatccaggctt

SEQ ID NO: 52605 - DNA, 1006 bp, Homo sapiens
acccaggaaatgtggtcataactgatttggaacgtagttcccaggtctgtcctgactttgagaccaatgtgcaaaccccacccattcttctgtctgtcttctaacctgcactgggaagaccaggaacatactactgtatgtagatgttaagctgtcttggaatgtttgaatgcagcaaatcatactcttgcagcagaagatccacatgctgcttactttgtcttcattaaatttcttccctttcatcaacctcctttggctaaaatgttactcttttatccatactagcatgctttattggagggaagactaataaatggtaacacttttcaatataatgatctatatgatatcattatcgatatgaatctcccagtaggtttttgagaggtattattcccatttttttttagatgagcagaatgagccctaagattaaatgactccagctaaattcttaagtgtcaagatggggattatcttcaaattctgttttttttttttttctaggctcggaagtaataatagctacaaaatattgagtgtatacaattttcccagaactatgctaatcacctcatgtatgttacagtttttagggtggtcctgcaatattatgatgccttttttttttagatggggtgaacaaggattagagaagttaatgtaatcattaagcctctgtttgaacccagatctcttataactcaaatcctgagtttttctggttggtttctgcatattcacagtctacttattcaagatttagcttcagatatcagctcccctattaaagcttttttgctccctcccattagaagctgtgaaggggaattcaagtagcaagtgatttgtagtattcttacaaagatgatacaaatgatgatctgtggcttatcaaagccccagatgatacccagatggtctgggctttatcttttgcatgctggactctaaagtactgtttcaacaatcatggcccagtttgttttatacataatgattt

SEQ ID NO: 52606 - DNA, 3037 bp, Homo sapiens
caccgcaacctctgcctcccgggttcaagtgattctcccacctcaacctcctgagattataggcgcctgccaccacgcccggctaatttttgtatttttagtagataacagggtttcaccatgttggccaggctggtctcgaactcctgatctcaagtgatcctcctgcctcgccctcccaaagtgctggggttacaggcttgagccactgcgcccagccttttttttttttttttttttgaaaaaggatctccctctgttacctagattggagtccagtggtgcgatcacggctcactgcagcctctagctcctgggcttacgtgatcctcccacctcaccctgctgagtatctgggtgtgtgccaccacagcccaactaatttttatattttttgtagagaggggaattttgccatgttccccaggctgggagcctacgtctttaataaacaaaggaatgtactcttgaatcccttgcccaggggtaggtggtgactctagcctcagacagcagagacatgcttgctgctcataacaaagaagaccagtaaactagttgaattataactgttttgaataatctatttcacacatcatccttgatgttattaccttgtaggaatggctttggagatagataggtaaattgaagcctaaagagattgttatgctgtaggtaggattacatttaacaattagtaaggtttggagggattcttgtgacatgttattttctccccctggttaggtttggggagcccccagggatctcccaatatggagagatattgggatacttcattatagggtttgcatccccctttcctgaggtttaccaaagagaaatagtggattgaatcaaatgcactccctaatttaacttaactgttcacaactggggaggagccatgatcttttgactcattaggtcacatagtcatcttgaaggcatcattgctcttcagaatgttggtcttattaaattaaaaagtatgagaaatagctaacataattctcatgatggaatttgctttttcattcatttggattttgtgtttttcatgttttgaaaatataagggaatgggaggggagaaagtaggggtcattgctgaaccctgatggttaaaggtaagtgaatgtttaatctcttagtcacttgatcattgctattgtctttgccaatgtctgaaagtaaacatagaataaattttcaattgtgtgtaatgtgtatgtaaaattcaagatgctgacttgaagatttttccttctctattctaaacaataggtgcgttccatggatgaactgaatcatgattttcaagcacttgctctggagggaagagcgatgggagaggtaagtgaactggtgtgtcagaaaagtgggtctgtttttaagggaaggttggagttgtctttcatcaaatgtgtccaaatctagtctccagaaatatgtgcttgcttttccttgttgccattctcatgataggaacgggatgctggagaattttgccaaaactatgtcattaaaagaagaatgttaaccataacctaatgtcttaaaagcaaaacaaagtagccaaaatgtgagcacaaattattgaatattaatgtcagctataaattgagacattttaagtttaagaagtattttaattttatatgcattaaataaaaggccaacctttacttcattttccagtggctaggttttcccccaacccaccccccccgccaatggcaaagggagtcttagattggctgctaatcagaaaatgtcagtaacctatttttagagtagtgcctttttttgaggaagttgtttagagctccattgtgaaagggaagttgttaggtttctagtggaggaattacagaaggtagagagctgagccagtcatccattacaggaaattcagaaataagaattttgctttgactgtaatgtttaaaatttgcagaaacaaaatttacttttatccattacatcaatagagagggttgctgtaagtcttaaaaaggaaggggagtatagatatctaacatgtagccaactgctggctattgtagctgtgacaataagcatgtattgatgacaaaggtagaatatacagtttgaattaactacttaaaataccacaggcccacaagtgacatttgttgtggctctcttgttctggaaagtgacgttaggttttctcttccatttcattttttgtgtatctaatatttgatagctcctacatcgattttaatatttcacaagagggagaattactttattctagggtcctcatttataccatttattagatacatttgttctttgattcagcaaatgtttgatccccaggcactgtgctaggttctgaggtcaaaattaggataattactcttctgagtttgaagcaaatattccttgattgcctttgtggttaggcagtgaacagttaaaaattgttgatgtttaaactgagatccttgctttctttgttacaagattttgtttccaactttctgaatcttcttgtggccacagagtccagtgtcctatcatcttgagttcatgcatttttggtctgttttcctcctagagctttaggagatgattgggagatgtccttgtgtttcctgtgcctgcctaatgtcactgacacaatgcaaatcaataaaccctgtatggtttagaaagtctaaaagactttgtcactaagtttttggagcagatttgaacagaaagttaacatatttgttggatattaagtatagaaagagaaactatatgtattgtctttcttactcctataattctaagctggtgtattccaccaaaaatccaattccaggtgtttttctttcttttttgaattttttataaaaatagagacagagtctcactatgttgtccagactaatcttgggctcaagtgatccttctgccttggcctcccaaagtgttgagattacaggcatgagccactgtgtccagcctgtttttatttttaaaaaattaatgatacaagataagaataatgc

SEQ ID NO: 52607 - DNA, 1005 bp, Homo sapiens
ttattatatgtatttaaaatcaccaaattgggtgttaattattaagaaatgttctctgtaatcccagcaatttgggaggctgaggcaggtggatcacctgaggtcaggagttcaagaccagcctgaccaacatggtgaaacccccatctctacaaaaatacaaaaatacaaaaaaaaaaaaattagccggacatgatgggggggtgcctataatcccaggttctcaggtggctgaggcaggagaatcacttgaaccctggaggcggatgttgtggtgagctgagatcgcaccattgcactccaacctgagcaacaagagtgaaactgtctcaaaaaaaaaggaaatgttctttaatttgttagagtttattgagtcaaattgcttcccccacccagttgtcccaaattagggagataccacttttaagggtcagaagccttgtaaaatacaaaacaatgaaattaatatgtcgttcctttggagaaacttagtttcataaagagaggagggaattataaagataattgtttctggctaggcgtggtggctcatgcctgtaatcccagcacatgaggcaagtggatcacctgaggtcaggaattcgagaccagcctagccaacatggagaaaccctgtcactactgagaaaaaaaaagaaaaatcatctggtgcatgcctgtaatggcttgactcttggaggtggagtctgcagtgagccgacgtcgtgctactgcactccagcctgggcaacagagcgagaccctgtcttttaagaaaatggtctttaagttcagtgtagcccttaaaagtgatgtacatggattaaggactggaagaaagtactgcaaagtgtttatatttgtatgcatggagagattacaggtagtatgctttgctcttgtccattttgtattttctgaatttcaaacagttaaaaaagaaaaaaagacaaaccttataccatctgttaagagcttggtctgccattttgagtgaaagcagat

SEQ ID NO: 52608 - DNA, 1148 bp, Homo sapiens
ttatttttattatgtattaaaaaagagctatcatggtttctttcattggggtggatgccttggataatccattcaaggaagatcacttcgtccaacttaatgcagcccaatttaatgaaacccattttcttcgcttactgacagaaacactggtggggcatattgaggccgtaatttggatcagatcttgctggtctgagcatacgcaacaagagagagaaccctggctgaatttttgcgagtggctccagtagagctgctggtgacccatcttgctctcaggagtgcagtgagacaaaaggaaagagctccagttaatttttataccttgtaattaacagggactactatgttaaactgggagggagcccaagtatttcccaaactggggagtcttgacattccctagaaatgtctttctgttgtacctgctgatggactctcttagacaatgaatcttgtctacctgggtagattgccttagcatttgtgctagtagcatttggttaacatgttaaagctgaataatccatctttcatattttgtttctcttacacatgtactcttagagccttttcattatgctcagaattcacaaggcttaacattatgtgcttggtcaaaggaatcatcagcaggccttcttcaactataactttttcttttttttgagacagagtctcactttgtcacccactggcactatctaggctcactgaaacctctgcctcctttgtacaagcaatctggtgcctcagcctcctgagtagctgggattacaggggtgtaccaccatgcctggctaatttttgtatttttagtagagacagggtttcacaatgttgtccaggctggttttaaactcctggtctcaagcagtcctcgcaccttggcctcccaaagtactgagattaaaagtgtgagccacgtacctggcctgactataattttaacctagcctgattataactttaagaattaccttgttccagtgtaaacaaaagaagttcggctggttgcaattggctcacgcctgtaatcccagcactttgggaggctgaggtgggcggatcacctgaggtcaggagtttgagaccagcctggccaacatggtgaaaccccgtctctactaaaaaatacaaaaatt

SEQ ID NO: 52609 - DNA, 1076 bp, Homo sapiens
ggagttcaggcactccagcctgtgtgacagtgagatcctgtctctttgaaaagaaaaaaaaaatgaaaaaaaggaaatttaaaaaacaaatactaggaaacactagacacatcttcccacccaaatgagttatgtatttgaaaatgttactcattttgggctgggcacggtggctcatgtctgtaatcccagcactttgggaggccgaggcaggcggatcacgagatcaggagatcgagaccatcctggctaacacggtgaaaccctgtctctactaaaaatatgaaaaattagccgggtgtggtggtgggcgcctgtagtcccagctactcgggagtctgaggcaggagaatggcatgaacccgggaggtggagcttgcagtgagccaagatcgcaccactgccctccagcctgggcgacagagcaagactccgtctccaaagaaaaaaaaaagttacttattttgacagtaatttttatacctttagatttttttctttcctgaataacattgaaaatttcattactaaaagcctaaggtcaagtctttgacttgagagtgttttattcttgtattgtgaaatctgttttctctgtaaactgctgtgggatagataaactggttgatgaaatagggcaaaaaaattaaagtcgattggttgaactgtagcctctgtactggattatgagggacagaggtagaagctttgccctgggggaagggaaatttggaggacagttccacagagcttacccactttgcttgcactcttttagcactaggatatatcagtatccatcatagattgacagcctataggagataattccagagaaccaggcaaaaaaaaaaaatcagtgggtgaggccaggtgcagtggctcatacctataatcccagcactttgggaggccaaggcaggcggatcacctgaggtcaggagttggagaccagcctgaccaacatggagaaaccccatctctacaaaaaatacaaaattagtggggcgtggtggcgcacgcctgtaatcccagctacttgggtggctgaggcaggagaattgcttgaacctggg

SEQ ID NO: 52610 - DNA, 1342 bp, Homo sapiens
aaatctgtaataaagatctataagatcttttgttgtgtttcctaatgatagactgatgggtggaagctgaaaggagagtcaaggtgcctggcaggttctttgctaggtgagcaaatcaaactctaggtcagtccttggcagagctctaagatctgattattgctgtgcaagttaagaagcgtttattgaaggcttactcaggcctctgtcttacactgagccctatcataaggaatcacatctgacttactgagcagttttatccaggtcagttagcaaacttgagttaataatagtaaatggcaaaacctgtttcccactcaggtggcctaaaccagtgaccttggaattggcattcatcattacaacacaattctttgggctggacgcatgaaataatgaacaacgttggggaactcagggtagttggtatattgcagttgtggaccacccacaggttacttttctgtagtcattatagtgtattgtactggttttagtgttgttctcaccttctggactgaactattctagatcagagacttgtgtttttcatgccccttttccaggaggtattatgaaactttcgtgttgattgaatgagggaagacgagaggttcttcagttttgcgctcaggtaaaggagtgggtcttacagctcagtcatcctgctgggaaacacatggcaacaggtagaggccacttgataggcagctgtgctaagggtagcataattgaagagcaaaggggcacatctctaggtggagaatctctgcccttattagccactgttacggataggaggtgtaagagggtgcctgatctgtcatgtgggtcagagtgaaaaagaggttgagaaccactgatgataacggaaatatttatatgttctaggcattgggctattgtatttcctatatataatccttacagcaatcctatgaaggagataaatacccttttttgaaaagtgagaaactgaggctttgttaccaggtaatacctggtttttgaaatcagtctttgattccagtgtccacgttctagatctgtttctgcttccctaggcaagataaaccagacaaaactgtgcaaccaagtggcacattacagggccaaagaattgttttgccataattttgcttgaaatttagagactgtaaacttaataatgagatgaatacaaatgttgaccattctcctataattgcaggagtacttgcccccaactcccaaaagcagtaatggtaaagtccatttttcttcagttctgttttttattacatatgtgttctaagtggtaatgtggatggaaaattatctctgtagagacagaatgact

SEQ ID NO: 52611 - DNA, 1200 bp, Homo sapiens
agtaagttgggtagactgatagaagtctaattctgtattgctatgtgttggttaacaacataaacttctctgaagtggtagtattgagttctgatcccaataccttgccagagtgcatgccaccaacgacatttatttattgtaaaagacatggggttcatgtttttatcttagtgtgttttatgtttcaaaagatggaaatattaaatatttgtaacctgtttgtccttaggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtaaaaaaaagttcactattttagctttgacattcctttataatcactgtccacttaggatatctgctttcaatgaatgtctttaaaaacttaaattgctgatttcatttggtacaaacagttacttgttataaaggttgatcattgtaatactgttactgggtcatttatcattctggtgctaaatagtaaatagccaattcattcattcattcattcatttgagacagagtcttgctctgtcacccaggctggagtgtagtcgcctgatctcggcttgatctcggctcactgcagctgctgcctcccaggttcaagcagttctcctgcctcagcctcctgagtagctgggactacaggtgtgcaccaccacgcctggctgattatgtattttcagtagaaacagggtttcaccatgttgtccaggctggcctcgaactcctgacctcaagtgatctgcccgcttcggcctcccaaagtgctgggattacagttgtgagccacccacgcccggcctatagaatgcatttttttttttttttaagacggagtctcactcttttgcccaggctggagtgcactggcgcgatctct

SEQ ID NO: 52612 - DNA, 1111 bp, Homo sapiens
accccttgctagtaggaaaatctagatacacaatactagttttagtcctcacaaacatgcttggtaaacatagatcatttgttttacttgtcagtaccattcccacgtcaagtgaggaatacactcctgtaacttttccctcctatagcccccccccccccccccgctgaaaaaacaaagccagaaacccacacacagcattaccagagaaggctttattctcccgtaacttagattgttaccttttattgttcaattaagaaaacactgttctcagccctcgataccattttgctcaattcctgttattactgggattaattaagaataagattttatgaagcttttcctgggttctgttttaaagtcagttaacttctgaaacaataggcttagcattttgtttcttgaaagcacctaaaaacttactaagacaggcccaaccccaagaaatgtggcttccgatgcagttttcgtaagcaaaataaacattttgaccctttgctaattttaactttataaaacactggggggctgttgattctttatctgggctcttgggaaacgctctccggattctgaactttgagttagtgttttgctttagcgacaattgaattcattttgttcaaggccacagctttttgaagttggaatttgtttagtttaggtttaaaatgaactgttttaagataaatttatgaccacagaatgtttgttaagtgtggtaaaaataaacaccttttaaaccactaagcattttagtaaaaggtgagccatggaaataaagtaaaccgtgttcctttgaattcaactcaattagtgatattttaaaaaactttgtaaacatttgaaagctgtgaaagagtagctggactgagcacttctagttgcttaaagtacttataaggtgtcatttgtaaaaaaatcacattttaaatgctacacgtattagtgagcttttctgatatttaggatactgagtttttaatttttgtgccgtatttgccaaaataccacaaaactacccaagataacatgttaattgcttaggtatttgctcactttgaaactgttctgccaggttttctctggtttgagaaactgcctt

SEQ ID NO: 52613 - DNA, 1050 bp, Homo sapiens
cttcattgtacaaatgtggaaatggaggcaggtcgatttaaataaggccgcagagctagaaagctgcagagaaggggtttgaaccctgcacctctggggccagggcagtgcgggtggccgtccgcgaaccctgctagctgtggtgctcgggggcaagcttccgagggcgcggcgggcgcgaggagcgcgtccgagactcggtggagcgtcaccggcgcaaccccgcgtgcccagctccaggccgtgttctcccaggtgcgggccggcgggaccccgccttcggccctggcggcgcgcgctcgcctagcgggcgggcactcgcgcgcagcgtttgtgttgcctgcgagtttcccgagttcacacaggccctgggttggcatggcaaccaggcaacctgttccagagccgccagccttctccgcacatgccgctgccaccgccggggccggggccggagcctatcccaggatgcaccgcgccaacccagtccccagtgggccgccatgttgtcggagtgaaaggtaagggggagcgagagcgccagagagagaagatcggggggctgaaatccatcttcatcctaccgctccgcccgtgagtatccgcaccccaccggccccaaacgctgctccggacccctaacgagcagattgtcccttcatattggtgtttgagagtggttgtgggggtgagaagggctttggaaaagccgccggggccctggctgaggcttctcactcgctgttcctcgtacatgttttggagtcagcagcaaggcccctattgttatcaaaggagggagggggtggggagcggggtcgaagctaggaaaatgctgggggtttaggcccgagcccagggcgtagacgtgcctctacatttttgcctggccctgttgggaaccaccgaagattgatgttgccattcgggttgctttttttgatgggtttgcgaagccccgagtcttctgtgtggccatgaagtgtaattctgtgccaccccgatttcttcgacttcttgagcttccgtggcagcgccggaggaggagga

SEQ ID NO: 52614 - DNA, 1069 bp, Homo sapiens
ccctgctggcttggggaggcctgggcgtcggggttgcgaaaaggaggggatggaggagtgggcagggcaaccgggtctctccgcccccatacttttgggatccactctccctaacctgcctttgtttcccgcaggtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcct

SEQ ID NO: 52615 - DNA, 1026 bp, Homo sapiens
gagattacctagtccagtgacttccatgcatggaagaggagccccaaacccagcggggaaagtgggctgcccaaagtcacccaggagtcagaggcagacttcccaccacaatttacacctcttgactcccttaccagtgccaagatgggaaaaggtggtgccaagatgggacaggtggctgagaaaggcctattctgccaccaacctgctgtgtgaccttggacaagtcacttcccctctctgagcctcatgttctctttcctcaaaatgaaataatgattccagctctgcctttctgccaaggagcatccagtgagagatgagctttacaatctgcacatccctgggaggggagtcaccgacaagaggcaggctggtgccaagtgggtaaatgccaaggttgggcctggcaccaccaggcttccctcaccaccttacccaagcctgcagcttccttggtctctgcccaagccttgccatctgtgtggtagcatcagctccacctcctcctgcctccctgcctggaaaaaggcttcttatatcttctcactttatctgaatattccctccccctccccagccagaccctcttctctcctcttctgttgtagttaggactctttgttgcaaatgacaaaaatcagcaggacaaggagggagaaccagctttaggcatggctgtattcagaggcctgaaagatggctcaggacattcccttgtgtgttcagtcttcctcccacacacactctctctgtaccttagctatggctttctcctcaggcgggccatccacctgaggtggccaaggcagccaccaacagctccaagctcacaccacacccattcaggtatcctggcaggatagcagctctgttctgattgttccagcaaatatctagggtgattctcaggggcagagcatggggtgagcgcctatccctaaattcatcattgtctttgattatttggctagacttggcttacctgcccaccccagaaactagaaatgagtcagccccactcaa

SEQ ID NO: 52616 - DNA, 1553 bp, Homo sapiens
agtggagcaatctcagttcatggcaacctccgcctcccaggttcaagcaattctcctgcctcagcctcccgagcatttgggattacaagcacctgccaccatgcccagctaatttttgtattttagtagagacagggttttgccatgttggccaggctggtctcaaactcctgacctcgggtgatccacccacctcagcctcccaaagtgctgggattacaggcgtgagccgccgcgcctggccgtttatggagcatttctgatcccagagccgctgcttttccccagcaagtgtcccagcatcaaggagtagccgcctgagagcaggtgttcctccctccctgaagaaaagaggacaagacgcagggaggtgccaggcactgtgcatctcacttcagatgcatttcctcagttggtcctgcagtaaccctaagaggtagacactattatatggatactatctcccatgtacagatgaggaaactgaagctcagggagtgacagagcctgcccaacatcacacagtatttgttcaggactctaacccaggccttttggactccaaactccttgaactttgcacttcaccaggtttgagggtgcagtttgctctctcttcctttcccctctcctgagcttcagtttgggcctcagttgttctgagcttccttgttggggagccttgaaaagctgtttaatgtgctcctctgcatccgtctcctggttgaagaggatgcattgagtcctcctgttcctcttcctctcaccctgcaccagctgaagaaagaatgggagagccccaccactggtgacgggtcaccacccccagatgggtccataccctgccttggcaaaggaaagtgaaggcctggcagatgacagtctctggcctcttgaccctctgtaggactgtgccccctttatctgagtgacaggtggtcaccctggcaacaggccctttgcccagcaggggtccctgacttcccagtagccacttccctttcacgtgtgaagatacacacatgttctgcagccacagcagctctgtccagctggagggagtctccatgtcaggccagctttcagatgtgggtttttaccagcccctcaccagactgccctggacccagcctgcgcaagcaatcttaataaaatgcagttctgctgggcacagtggctcacgcctgtaatcccaacactgagaggccgaggcgggtggattccctgaggtcaggagttcaacactagcctggccaatatggcgaaaccctgtctctactaaaaatacaaaaattagccaggtgtggtggtgggcgcctgtaattccagctcctcaggaggctgaggcaggaggattgcttgaacccgggaagtggaggttgcagtgagccaagatcgcaccactgcactccagcctgggtgacagagtgagactctgtctcaaaaaaataaaataaaataaaatgcagttctgatactgcctcgcctctgtttaaaccctacccctggcccctcattgccttcaggataaagtctaaagctgtgtttctcaa

SEQ ID NO: 52617 - DNA, 1053 bp, Homo sapiens
agtctgttggagagggacatttgggggctgtggtatgtttctgtgtttgtatgtacagctagctggtccccagcttacagctcacagtggttcaacatggttttttgacttacgatgggtttattggggtgtggaatgcattttcgatttaggatggcttgattgggatgtggccccgtcgtaaatcaaggagcatctgtattcgaaactgcacactgctgcatgccccagcatttgtggggcggacactggcacgtagagatttgtggatcaataaacatcccttcccgcttcctccctgttcatttattcatgaactctgaactccttggctccagagaaactgcctggaagaaagcaattagagcataattagaaccactcctatcatcggctctcagagggagggaagggggctgctggggcatggggggatgtccccaacctctgcagctgcccattcagctcctactcaccccatggagctcagcctccccagagtcctggacactggaaaccgctttacagggagatgcctcatccctggaggcattcaagcaattgataaggctagggaggagagctgtctgtcttgcatactgagttagagtagatgatctccaagtcccttccttgctgagcttcttgggtgctccctgccagggactggaacaggcattgcaggaaaactaaaaagtataacatagctcctgctttctagaaaacattcgttcagcagattgtagtgaatgaagactacaaggacaataggaaatgcagattacctggaggaagcaatttaccaggcagggttccattcattgccaggtgattaatggtaataataacagtaccagcagtcggctgggcgtggtggctcacgcctgtaatcccagcactttgggaggccgaggcaggcgaatcacgaggtcaggagatcgggaccatcctggctaacacggtgaaaccccgtctctactaaaaatacaaaacattagctgggtgtggtggcaggggcctgtagtcccagctacttggaaggctgaggcagga

SEQ ID NO: 52618 - DNA, 1102 bp, Homo sapiens
tcctaagcctgttttttgggaggaggtgggcatgttccacagccccagcctgaaccagagatgtgggttttcaattacacaattaaatgcacaattaggcataattaccagtgctcagagcccgagactgctcataataggcgtgtaatctactgcagcctctgtttatactactcagcgcgctccctaatgatgccaggatgccttcacactgcactgttgccatggagacaagcccgccaccaccatgcaaagctgacaaatggtgttctggtcttgggcctttggattgtttctgaggcttctaacagccagcactggagtggaggggctggccagggggacaggaaggtggggcaaccctccctggactctgacacaccccactggttcaggccagcgttggagccaccagggaggacaggggagaggagcatcagccacctctcacccctagagtcctcaagccatgagcaggatggcccggggccatgaaaggtcttgtggttatccattcatacatctcacgctatcatggaatcaaaggtctggacagggggtcctgcctacaccaggttcaaagataggcctggctctgctgtgaactggctctgtgaccttggttgggcaagtccttggccctcttgggggctgtgcttccccgtatataaaatggactgcagggtctctgcacatggcatagtctaatagagaagatttactgagcacttatgacccacctcattctgctgtaactgctttacctggagtggctcattcatcctcatggcaccctgtggggtgggcacagctactacctctatttcaccgaagcagaatctgaggctgagagcagtcacatccagcagtggcagagctgcgcaaacccaggtcttgcccttaaccccaatgccacatagcttcacatgtgccacctgaggtcatcctcacaacagccctagaggtggaactttgtcacacccatttccgtttcctagatgaggactctgaggctcagagaactgaagtcacttggccaaagtcacgcaacgaggcagcggcagagcacagtctggctggtgccaacagccagggttcctac

SEQ ID NO: 52619 - DNA, 1053 bp, Homo sapiens
ataagtagttctggccctggtaagtctggggccccatggaaggagctcatggctctagagagaaatgaaggtggtagagtgtctctctgcctcccacttcccttcctccatagttctcccttgctaagctaaccccactcttccacttagaggagctcaccagcactagaggcttgagttagatgagacctgggtggcattctggtttctcccacatcccggctgggtggctttgggcagcttgtgaaggttgcacaagatcatttgcgggaggaacttgaaaattgctctcttggctctgttgcactatctgggctcattgcagagtgggccctccagttgtcactaacctccatgagcccctactgcctgatagcttccataatgtgccccgggatgttggaattcaccagcctgaggggagaagggagtcttggttttctcatccaagggactgaagggaaaaaagaggctgttaaatatctttcagctgaaaacttaggaggaactgtgtcatttttctttctcaaatggagtttaatcgttacaatgaatcaggccaattcgaaacattcttcctcagttgggatagatgtgatttgggtgagggagtgaggtgtgagggtgccatggggtttaagggaagcaggtagggactgtgcctttcagatggataagtgtaggatagtagttaaggctctgaagtttgacaggacagacctggcttttagacctggttctgtcacttcctggctatgcaattttgggcaagttgcttaccgtctctgagccacatagttttgtcatctgttaaatagagagaatataaaacagttcctaatccttagggttgttgtgaggactcagtccatataatgaatttagcactctggcaggtacagagtgagtactcattaaactgtagcttattgttattatcttaatgattcatatcatgggatgtgtctgtggcactgtagcccaaacatatccaggtgaccccctgcactgtcctttgtggactgtcctttgtgggaagtagcaggtagttgg

SEQ ID NO: 52620 - DNA, 1755 bp, Homo sapiens
ggcgcccggccccgccgcccggcgcgcccagcggggaggacgtggagcccgcgcggcgcgagcaggcggcggccgcggagcaagaagggcgccgcggcgtgcggcccgcgcagcccccggagccatgggcaagtgcagcgggcgctgcacgctggtcgccttctgctgcctgcagctggtaagcgtcgcgtgcccaggcagtcggggcagggtggggcgcggcggggcgcggtcccagggcgtgcgggtggggttgcgtgtgtctctgtgtgtgtgtctggtgcgtgtgcccgggcggggggtggtctggagtctcggagcggtcgggcggagcctgctcccgctggccgggctgtctctttgtgtgcgcttctcgctgctgtgcccggcgctcctccggtccccaagtgcgtcctgtgcgcgagtccccggcccgcccgcactgtacaagtggcctcctgttgggggatgcgctgtgggacggtggcttgctgggactgggggtgtgtctgaggctgatctgtggatccgttgaggtcctgctgtgtgtttccctctagatccctcgtttgcatgggtctctcccttcctctgggtctctgcctctgatcaccacccctgtgtgagcgtttctcacaaagtctctgctccggcgtgtgtctctcagggtttctctttggtgtgtctctaaatcgctgaccatttctggcccatgttcatctgtgttctgggatcttagactccaagaaccctccaatcctttgtgttgtttctgcctcccttcaccttcctgaccgggcagtcctgggaaaggagagccacctccctggagagggtcaccaggagctgccagatcctgggccagcctgacccagcctggaccacacttcctgctttggtctggccgctgtggccatgggggttccatcagtcatcagttccacccaccagagcagctcctctgccggggccagcaacagtggggatggggacacttgggtgccctagggaggaccagagcatctgaggacactgtgcctagccccagcatagggaactcaggttcttgtctcagggaggagtgactgtagtggactagaagaaacagcactgcccttcaaatcaggccctggcaggggaatttgggagggtggttaaggagaggcaggggtctcctacctaccctagagctgagattgaacaactagggaggttgaagctgtgcttctcctctaggcagaggtgcatggggacctccatcgccgaacccaggtctgagagtgggcagcgaggagcctgagcccccctcatgctggactccttgttctgggtttccactcttgcctgcatccatcacgccctccccaccacaggagccaatgataatgtagagtgaagttttgagcctggacatgcagacctcctcattcgtcttgcttctctcctcctggggacaccagcttcaaacatgccatccacagacctggcctgggcagtggtggaaacagccctagctctggagattgtagccctgctcccagctgtgggagactggacaagtgacttccccccactggccggcctcagtcttcttatctgtaaaatgattatccctgaggattgcagagggaattaattaagatcaggtggaatgggaactccagaagggcagagattgtctgtttttctttatctactttgaggaacatgaaatgccaagaaatgtttaaacctttcagaggattcttctgtgtt

SEQ ID NO: 52621 - DNA, 1020 bp, Homo sapiens
ttttgctggttaatttgctgctttcgtggagggacaagcttttgtcattgtttattatactattttcactgacataccctctatttttttaaatgtgggttgcagcctactaatgaattagtctctacggtttgaaaaaattgtctgatatccttgttgttctaaaaaatatatgaactaagtagttaggggaattccattctaagagtatgttgatttaactctgttcacttcaacaaagaagtctgaaaatataaccgaagttttgtttcaccagccttcaaatgtcttggcaaaattgagcacactgcttaccatgtgtgttattaggatatccaggagttagtgatataggatcccaattatagatgtgttcatgtccacaaagtcctcgtacttaagggatatttgtactgtgcaattgcttcttagaatgatgttgctgatagactgtcttgtcctttgcttcagctttgggacatccggaagaaagcagccatccagacatttcagaacacgtaccaggtgttagctgtgaccttcaatgacacaagtgatcagattatttctggtggaatagacaatgatatcaaggtatgtttgatgtttatgatatatttccatttcatctatctgcacttagaaacgaattttttcaaacttctgagattgtggtagctttgcacttaataccaactgaaaggaaaatagtaacttggaacttattttctttttctcctgtcttcattgacttcctaaattaaagtttgcattgcagatcttataaatgctgtcagggaccaggcacttaatgtgaagtgtgaagtctctgtagggggactatgtaaaaaataaagagtgcatttccttttaaagacattcaaaatctttttttaaccatcttggtttaaagagagcagtgaatcagtttgtgattctgtatcctcatctctcactgtgtttttctttttgacactatggaaagagagttttctaagtttctctaagaatgagagaagg

SEQ ID NO: 52622 - DNA, 1129 bp, Homo sapiens
aaaaatgaaagaaagaaattgtcctcagagacaaaagaaaaactttggtaaagagaaaagattggagtcactcagctgtcaggtcggtaccacagtctgtctgatctctgcagcaccagggagttattaaacatttccaagtgagagggtgtcttatgtttaaaatgttagctatcacaaaagaggaaaagatagagcaaactgctacattagatgtatgtcatggggactcaaagaaggggaattttttaaacttcacaggggtagatcttttatctgggccatctgggcctagaggacaaataggattttggtagggtgaggcattccagcatcatgggcaaactggcgtagcacagcaggtcagtgatcttgaaaaatttggcaccttttgtcaagtaggaaagatagattgttactgtttatcttcacttatttcttttttattctttctcttactttctagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaaggtgggtattgtctctccgtgttccagtttctgaggtgatgtgatgtgaaccttatcttgccttgccacttgtactctagcttcctgtgcaaaacttaattttagcagtcatctcccataacacacttgaaatttttccccatttaaaataaaacatttaatacaagttttaattaccctacagaataataatagaaccatagaataaattgttacttgaaataggccgggtgctgtggcttacgcctgtaatcccagcactttgggaggccgaggcgggtggatcacgaggtcaagagatcaagaccatcctggctaacacggtgaaaccccgtctctactaaaaatacaaaaaataagccgggcgtgatggcgggcacctgtagttccagttgcttgggaggctgaggcaggagaatggtgtgcacccgggaggtggagcttgcagagattgcaccactgcactccagcctgggcgacagagcgagactctgtctc

SEQ ID NO: 52623 - DNA, 1045 bp, Homo sapiens
ccttaagcttactagtggccaaacgtctggattgcttagggatctttgcagaacatatatgaattattgataggcttaatttcatcagacaaactacatagttttttttgtttggttggtcggttggctttttagagacggagtctcactctgtcacccaggttggagtgccgtggcgcgatctcggctcactgcatcctccgtctcctgggttcaagtgattctcctgcctcagtctcccaagagctgggattgtaggcgtctgccactacacctggctgatttttttatttttattaaagatggggtttcgccgtatcagccacgctggtctcgaactcctgacctcaagtgatccacccgtctcggcctcccaaagtgctgggattacaggtgtgagccaccgtgcctgacctgagaactgttgttctgataaatttataagtaccctttgcctagtaatgctcacagaacccatctccctaacagtactgtggaatgtctatggtgactgtgataactatgccacactgaagggacacagtggagcagtgatggaattgcattacaacacagatggcaggtgagtattctgcataatggaaggacagcttctcatactaattcttggcgtcctttcacctttcatcctttctcaggagaccctgctatcaaaaactactaattttgggtagctactttagtatccgatttatcactgtcaccccaagtgaggtgtttatagtctgtgtatgcaaatataaagatgttacatcggtcatttcaacaacccagacaaatttttctttttttaagacataaaataaatgtgatttttatatgtaggctggagtgcagtgacacaaacatggctcactgcagcctcaacctcttgctcgagggatcctcccacttcagcctcccaaatagctggggccacaagcccacgcctccatgcccagctaatttttaaaaatcatttgtggagacatggtcttgctatattgctcctgagctcaagcagtccacctgcctcagcctccca

SEQ ID NO: 52624 - DNA, 1057 bp, Homo sapiens
aagcggtaagtgaagaagcaggcggcctttggccctcagctcatcttcctcccctcagagcgctgtatctggtgatccctgaccctttcccgcattgcgggggcagaacgagagtttctacgcagagttaaagcacataaacactgtaaaagctccccatagcctgcgaatgctgcgtacgtgttcccccgtttggcgcccgttttcagcctctcgactgccctgagatagcattagaattagagttgaggaccttgggctcaaaaccctgacccgggtttaagcatcctgactctaacatggatctggcatagaacaaaaattccgaagagtgtgtagaatgaatgaatgagggagggaagaaaaaagggaaatgatttgtgttggctcgttttgggactttgggcaagttgcttttccctttatttctctgcactagtattattaacaactaaatagcagctaacattcattgactcttgtactaaagtgtttcgtatatgaaatttccattgatcttggtagcagcctgttaggaacgttattaacccattttgcagatggaaaaacagacttaccaagtacgtgatagaagcagatttcgaactgagaaaccatgctcctaactacattttttgtaagatagaaatagtgatcacacttctaatgtcctgtttaggctcagacgaggaaatacgagtgtcctcacatctcctcaataaatcctgctggcaccgtcctcaaaataggtctagaattgctacttctaccatctccatcattgcctcatggcctaagccattattatctcatctggcatttttgtagtgggaccctaactggtcttccactttctacctttgtatcagcacctgttaccaagccaataaccaaaggaatccttctaaacatcagatcacattacactctgcagaaaactttctggtggctttgtacttcatccagagtaaaaaccaaaattcttgtaattatttgccctctttccctttacctctctgaccaatttcttattgctcacctggcttcagttactctc

SEQ ID NO: 52625 - DNA, 2881 bp, Homo sapiens
cacatagggcagcaaagttatcaaatatttttaaaaaatgatttaaaacactcctaaaatctttgagattaataaatattttaaaagattgctgttaatacccagtgttagaaatggatacttttactctctatcaggagcataatttcacagactttggcaatgcctattaacatcttttatgtgcttattaccctttaatccagaaattctttgaagaatttagtgtaagtagagaattacataaattatgtgcatctgttttgtagactatgcagatgattgaaagaatgactgtatttctaagacataattatgcctcatcttaccagaaagatgccatggaaggttttcatacaattccatcacactgctacctgactgataacagttgtaaaacatcattgattatgagaagcactccaatttcagagagattaaagtgagaggaaaagaaagtgcatcttagaatcaatgaaacacaataaatgtcagtttactgacatgagccaggagtggtggcatgcacctgtaattccagctacttgggaggctgaagtagtaagatcacttgaggccaagagttcggggccaggctgggcaacatagcaagaccccactgatggcgatggaggcctgtctagagtggctgctgcaaagatgccagccatagtgggggctgtgcggccagggctgcatgttctatggagctggcaggagccctgcccccttatgagttagtggggtgggagcccaccctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctgagcctgggcactattgcaacctggctgggtttgcacaccttggggtggtgctgccatgccagcttcctaccatcttggccccctctggactttgggtgccagtgagcacaggagggaggccaaaggggtgctgagggtggctcagcatgggcctgcaggtgcccctgggcacagaacaactgggcgtcatggacaacatgattgatggtgacaagaggcagacaggctcctgggtggaaaggggcaggtctcggtgaagccgcaccttcaagccagggatggcctaaagcataggggccaggctgtcagttccaggtggagtctgtggcccagagtgagaacttaaggtgcttttcctgggcctgcccatggaccagtcagcacacacttctgaagactgtaaaaatcctggactcagccagacttgggcagacactgggaggacttgcctgtggaaatgggttacccacactgggtctcctctccgtcaagggctgcagatgttgggatgacctgcctgcagataagagctgcccattctgggtctcctctctgctaagagctgcactcaacaggttgacctgcctgtggaaaggagctacctactttgggtctcctgagagctgtaccatcactcaataaagcaactctttgccttgcttaccctccagttgtctgcttacctcattcttcctggatgcaagacaagaacttgggacccgttgaatggcgggactgaaagagctgtaacagatccaagggctccctgagccagagctgtgacacctctttggggctttatggttcctggcctctccaagcttctgggcaccaccatgttccccagagtccacagtggaagccgcttgtggtatgcctggtccatccacagcctcacatggagctggtgcctgtgccagcacctggagctgcctgcccagccacagcagccagtgtgcctggctgtgcacagtggctggaccccatgctcactcactcatgcatccctcgccactccgagcctggctcgcccttggcaggtgtgggatctgggacggcagcatgagccaagcgcagcccattagaccaagtggatggaacaggcctagtggccccaagcaaagctgaatgcagcctgccaggccaagtgggcagaacgagcccagcaggtccaagcaaaactcgggcaaaggtgctgctggccacagcagcttctggctggaaaagtgacacctgaagaatcttgtgacaccatctttacaaaaagttagctgggtgtggtggcagaaggatcacttgggcccagaagttagaggctgcagtgagctatgattgtgccaccgcaccccagcctgggtaagagtaagaccctgtcccttaaaaaaaaaaaaaaagaaaaaactaacatggaaagaagtctaagataataaaatttaaaaacatgttgcagaagactttgtatagcatctctcttccccttttaaagcaagtgtgcatatgcctttaatatcttttttctttatatagtttaaattactgcctatgtttagaagaaaggctggaggaatattcaacagattaacaatggtcacttctggggagttggttttgctaaggaagggatgtacatggaagagggactttgacttctggaaattttttttaagttttttctgttaaaaaaaaaatccaagaggtgatctttggataataaatccatgcctctaaccttgtagactactattctgcaaattgcatctttgcttaagaaatggtttaccagcagttttcaagctggcagtcagcagtctgtaattaagtttctcattttatgttgtctggaatttaatgacatcgaactcttccccaccccacaggacattcatctctttctgtctgagcacaggttttcttgttagtatagttgccatagctgccagtgcctgaaagt

SEQ ID NO: 52626 - DNA, 1033 bp, Homo sapiens
atctattaggcagtgcaaccctatacaattataaagttcttttttttttcctactgtcttctgccatccagcactaaactatgaaattttgagaacagatttttcaacattatactttcagagtttcttgcttatgatagaagctcaaatatatttagcagtggattcagtttagcaaataattattgagttctattttctgattagcttttttggtgggaacacagaggtaagagaaacataatcccttgctgccctcagattgcttacagtctagtgatgtaaacaaattagagtggcgtgtaataaaaatgagtgttgttgcacttagtccatggaattgtggaacggttaggctgtttggatgagtcagggcatagtacaatacttgaggtatagtgggtgggtgttcagtaaatctcactgaatgaatgaatgaattatagcctcagttctaccattaactggcttcttggcaagtctcctagtctttgagccttaatttccttatccctgaaatgggaatgatgtgcatattttagggtcttgagtttttttgactgggaggaccatgtttcattaacgcttggatatatttttgcctataatatagtttaagcgtttagtaaatgttttagtgaatccttaatcccaacaagaataaagggtgttaaaacactttcacgaatgtgcttatattattgtcatataccattgattgggagatgaattgacttaaactgtggagagggaattaagattacccaagggtaacagtgaccttttgttttgacatttttttggctgcagctgtcctctaatgatttgagattttcacttctttcctttattgccagtggaagttgtggaagaaattaatgttgaacctaacgcagttggggtaacggttttaaggggactataatgggctcactctgttactctcatgtggtgattgaggagctagccctttccaagttgtcaggtttcgtttttttcctgtttttaccagcagacactcagatgggactaa

SEQ ID NO: 52627 - DNA, 1107 bp, Homo sapiens
gttagtgttgggaaaaggaaaaagaaaaaattctgatgattgcattgtaataaatagcttctgctccaaaaaatccaatgctatatggactcattaaaaaatagtgaaatttcccaaagccacccttacagtgataaaatataaaacatgtaagataaaagagctaaccctgtttctcagaaaatgggtagggaagggaaagggctccctggttttgggctgtctctgtgtagaactatttttagtaataatcaagtggctgaaacagtaacttttgttgtaaattatgtctatagctgcatccaggaaggaagcatggcataatggaatgattagaggatttagagctagacttgaatcagaaagagtactggttctgctccaaactaatatatgactttgagcagattaattagtctatctgaatcttagcttctttactataaaaggagacagtaacatatatctaaggaatgcttgagtgatttaagtaaaatcttatttgtaaggagccagcttcatgtctagtctatggtagacatacatgtagctacttgtagttattgttttaaatgccgctttgttttatcctctaatatctgagattatagcaccttttcttttttcctcatactatggtgtacggaaccacacctttgcttttgaaagagtgtgtgtgtaagacccacaaaaacagagaccatgacttgtctgccattgtgcctgatgtatagcatccatagtattcatttagtttttttgagatggagtctcactctgttacccaggctggagtgtagtggtacaatcgtggctcactgcaactctgcctcctgggttcaagcaattctcattcctcagcctcccgagtagctgggattacaggcatagtccaccatgcctggctaatttttgtatttttagtagagacggggtttcaccatgttgaccaggcaggtgtcaaactcctgacctcaagtgatcccccgcctcagcctcccaaagtgctgggattacaggcatgagccactaccgctcagccctagttagtactttcatttactcatttgttcaacaaatataaggcaacttgtaataaatactaaa

SEQ ID NO: 52628 - DNA, 1041 bp, Homo sapiens
atgagaactccctcactatcacatgggggaaatccgaccccattatccaatcacctcccacaaggtccctcccccaacactgggaattacaatgtaacatgagatttttgtgtgtgggggaacacagagccaaatcacatcaacatatatattatattttggtaagaagtctaaaaatgttttaaaaggctatgagaaatgcaacaaagagattaattctgtctgaggggctcagaggaaaagacttgatagaaggagagctagtaactgaactgagccatgaaatgtctaggtatagtgaagtggtgaggtgagagtcaagtggggaaacagagcatttcagagagggggagaactgcctgagcaaaagcactgagccacatggataagagaaaatagacttctttggccagagcatattgtgtgagtaaagatgaggctggaaaagtagtttagagacaaactgtgaaagaccttgaatgccaaggtaaagaatttggagctgattttctagaaagcctttgaaggtcttttaaacctatgagtgacctggtaagggttgtagggtgtttagcatgttgagtaattatatattttcatcctctgtgcattagtgagatgaaggttagtctcattcgtaattgttaatttagggctatttcacatcattgcatttactgcctgtctcgttctgtcaaaaactttctttctttctcccctttccctgccaaaaacaaaaaaccaacatacaaccttaccttgtagtatctctggccatatctcttaagggggccggcagtcggtatctttttcattataggcaagaagagaggcggaggcgatccttccaggattacactgggcagaagatcacccttgaggctgtcttgaacactacctgcaagaagtgtggctgtaaaggtagggtgaagcctctgccctttccacgtttctctccttgtggatggacccttttctggaagaaggaggcagcccagtgtgagtttagtttaccctgttttttagccaagtgatggcctt

SEQ ID NO: 52629 - DNA, 1108 bp, Homo sapiens
tatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcattcttgtactcatgtgggacaggggtccccttgaagtttggaatgaggtgcctagctttggtggggatgtgatatgcaggaccaaattctcagtggcagctgaactatggtgaggccatgggtctggctctatgatgccagaccggatagtgggaggtacagggctctggccctggcactactctaagttagggaaggattggagttagtagccaaacacagtcctttcctgagtctctggatatttttcctatttgtcaactatatgccaggcaccatcttagacactaaggatgaaggaagccaaatggtataagggaaggaaaaacactcaggatcttgaccaaattacttcctctctaaaggctcgttttttccaaatctctaaaataagaattacaatgcctatcttaaggatttgctgtgcatatcagaaaaaaaaaattatgtatgtatacacacacacacacacacacacacacacacacacacatacatacatatagccggcacatagtaggtactcaagtgacaattatcaggaggaagggagggtagaatgctcgcaatggtgttcctggctccaccccccatctcactctgtctttccttccagacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctct

SEQ ID NO: 52630 - DNA, 1095 bp, Homo sapiens
caggaagtctaattatccaatacttcctatcactaagggtcttttagacattatgtggactaaccacaaggctggataaagattctcaggactactcctcctcctcagtcagtctttcccagggatagactagtaaatcccacctgtatctgaggggaccaggctacgggaatcacctagagtacagataagtgtctgtcttgaaggcttgtggtacttctcagagccaggctctctggctccaccatactgcctgcctctccctccttgcctaatatctgaaggcctcttccccagaaaggcagtagtggagcagaggctggaggtgaactagatgtcttgcagggatagctgggaggcggattgcctgagctcttgtcctcacaccatcactagtttgggtcaaaggctgtgtgctctgtggcccagtgtccagaccccaccctgcccctcaattcctgactaagatcacagctcaggcctctaccctctttccacagtccattgtgacactggatggagggaaacttgttcacctgcagaaatgggacgggcaagagaccacacttgtgcgggagctaattgatggaaaactcatcctggtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctcc

SEQ ID NO: 52631 - DNA, 1912 bp, Homo sapiens
cctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgagcaagccgcggggctcaggatgttggcttggggactggctggtggcgtgcctagccccacgcagcactcctgccgcatccctcctggttaagactggggaataggggagcgcggagatggcagcctggcctagagcaggtggggcctgttcagagggggctttggtggtccaaatctggttagagaccacggtagggaggtggtggaaggaggcagctgtgtgggaggctctttccaggaagagggatatgtgatttggaggtaggaggagggtttggataaagaacactgatcacaggaaagggagtgtagccaggggagaaaaagaacaggggcatgggtagtttagaaattggaggagactgaacccagaaagggaatggggcagccagggagtgtacaatgatgtaaacaagtaggaaatacctaggaggaaaaagattagtggggaaaaaactgtggatcagtgaatcagatatgagaaggacgtaagacaggaacctgcagtaagcagcaatccccatctctgcttggttagggaagagaattcttgctggagaatgccctttctcaccagccagtctgaccttgtcctgcagtctatgtatccaggccttcatcactgtctgtgagcctcgtggtagggtggggcaagaggcccatgatcagctgggcctttcctgcaacccaaggctcacctatctgtgcgaggggtaggcagagaaagccattggacttctgatgtgcagtagagggtcccaaggcaaggtcaagacctgggagggaggatcactggtttaggaggatgtggagaactgctgtggtgttgggatggagaagaatcaggattcaaagaatctcacaggtgaggaacttggagattcccataccatctagttcaacagggaaactgaaaccaggagagtagaaatgtattataacaattccacagcagagccaatatgaaaatctaaggtttctagatctgtaacccagagctcttcccactaccctacaggccctgcgagtgggaagaaaagtagaaactgcttagctaatgattgacctcagcccttcttctactgctttgggcttagatggagaggtcaaagctctcaacggcctctaccctatcttgggcgctatgcccagtaattctaggcaggcagtcattcttagaggagcagcccccagcccccacgaacacagcccagcagctattgggaagttggaatgcccagatttagttcctccttccaaagctgggccagagctgagtcttgaattgagctgca

SEQ ID NO: 52632 - DNA, 1094 bp, Homo sapiens
ggttttagcctggcctggtaagttctgaacagaggaaggaaggaagcatcccagtgaagagacaggatgctccaagagaccttggagtgacagtgactttattaaaatagcatttaccaagtgctttttctgtgccagtcactgtgctaagtgctttacatgatcacccgttttaatccttactagaacctacaagttaagtattatccccattttagagatgataagatagggatagtgaggctaagcaacttgcccagtggctgactccagagcaggtcctcatacctctgctgtactgcctctgatgtctgccccaggcaaggtggtcctgggagctcaggcttccttttggaatgcaaacgaatcagagatgattgcggatagtccgttgtcgtctctgcaatcccctgagcctcagttgaagagacaataatggagatttggagaaagagggatgagggccttccacctaaggggagcatccagacacggtccctgttgtgtttctgacatcttagacagacccttgggatttctctaccctctttgtgcttctgtgcccatcctctcgaagttccttgaactgttgtgatccagtattcctgattgatggaggtgctcatggcaggtttttgtgtgtctggtctgtgtgcccctcttctccagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggcca

SEQ ID NO: 52633 - DNA, 1104 bp, Homo sapiens
gatggccttcacaccccttcctccaggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataagtgagtctccgccttgcccttgggcctgagctggggcagagccacctgatagtggacagtaggtgggtaggtgggtgggtggacattctgaagagaaattcattgaccagggaggactgtggggaggaagctaggttcagggtgagatcccctagactgagagctcttttcctgagatctttcttaagttctagaccctgcctagttacaggttaacttagtttcctcttctgtagaatggtactccctcccctgtaggaaacagcagggaggggtcaggtgccaagcctgcagagaaaatgcagttctggatggggtggggctaaaggtgtccagagtaggaggacggtgcaacgcttgatgtgggtgtctcaggtgcaggcatctgggcctcagggcttggttctgtgaagtcgcctactccagcctggagagaagggctgcctcaatgggtcctgagggggacccttggccttcagtcttgaagccttcctcccctcctttccctcctcaccttcagacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaaggtgcgggtcatggccggggcacgatgggcaggacagagctagactcttctctttacaccctaagatacaacaaaggggtttcctcttgttaccgaatgtccacctgcactacaaaatgctgttctcagtgcaggcctgcatccctcaccccttctttgacccagctggggcactgagccaagagccagggcaaggaaacacctgggtccagaatcagggctggaccctggagtgctgggtgagacggccccagccaca

SEQ ID NO: 52634 - DNA, 1082 bp, Homo sapiens
ttgtttgttttgagatcggatcttactctgtcacccaggctggagtacagttgtgtgatcatggctcactgtagcctcgacctccccaggctcaggtgatcctcccaccttagcctcctgagtcattgggactataggtgtgcgccaccacacctggctaatttttgtattttttaaatagagatgtagtttttctatgttgcccaggtttttagtagagatgttgtttttctgtgttgcccaggctggtctctaactcctgggctcaagcagtctgcccgcctcagacttccaaagtgctgtgattacacagctgtgagccaccacgcctagctgttgaactggcctttgaaagcattgtatcgtattgccttaggaatagggtctcccctgcctgcctcacagagttgtgagtgaggatagggaaatgtttttacatcagggtaaggaagacatgctgtggatgaatccatgctatagctatgtcatttgtgactgatgagggtcaggggtgtgtgttagagactgcgtttgccccatgagttctgcagatagagatgggagtaccacaggatgggcatttggaattctgtttgattcatttgcctattcattcatacaggaaatatttaccaagtatccattctacactgggagctggggataaagtgacaaaccagacaggatcctagcccttgtggagccccttgatgtgcaggaaaggagagttaggaaaggaggatttcaaccctgactctgcaggtcattggcggggtgactttgggtaactcgttgctcctctggaagcctcagtttgcccatctgagcagtgagatcataattccaaccctacctataggatcagttgaaaggatggtggtggaagtgctttatggttgtaaagtgccatactctgcctagtttctggcctcatcattctgactgatatcttgctcttcctgcagggctgcccaggagctgcaggacaagcaccaggagcccctccgggtagctactaccctggaccccccaatagtggagggcagtatggtagtgggctaccccctggtggtggttatggg

SEQ ID NO: 52635 - DNA, 1083 bp, Homo sapiens
cctgacttggagtgctgggagatttgggttcctggagttctgggcctgctctgctgttggctcacttagtgaccttggcctgggcctcagtctctggacctcagtcttccaaactgtatgctgggttgggggcctccaggcttcctggggagccagggtcagaaggcaggtggtgaaggcaggatctagctgatggtccagagtgaggactataaacttgctccctcccaggttccccaggcgtccagccgtgcagcaaccttggcctgagcgcacctaatgcccccctgccccttctcttctaggtgcacaatgcccaccttcacagcaggaaggactcaaattggaacacagtagtagcctgccagccaacgtgactggtgagcacccaaccatctcatcgcgccgtccctgcaaccttcctctgggagtgatctgtacccctctccacctgctcagctgagctcttcacctgatgtctcccccaaaggcttcaacctcatccaccgactcagcctcatgaagacgtctgccatcaagaagatccgcaaccccaaggggcctctcatcctgcgcctgggggcggcccccgtgacccagcccacgcggtaaatgcatccatgtgaccactgagaatcaacactgacctcagccacactcctcagcaactccagatgtggggcttaagcccaggggcctgtctgtgggtcattgcatcccagcccctgccaggagtcaacctggtctccacccctgggcttgcagggtgggctgagaggtggtacctggcagacctaccttctgtctttcccctgtctctggccagcagtgggtgggaacaggtctgcatcctgtgggcactgtgagaacacaggatgtgggcgggaacctggcaagagtcatgtgcgtgtgtgcatgtgtgtgtgtgcgcacatgcgtgtgtgtgcacccatgtgtgtgaagtccaaattcccacaagccctggcctggcccctgcttgcctcttcaacctcagctctcaaaatgctcttttttatctcttgctgctctggtcatgctgaaccctttccatctttttttcag

SEQ ID NO: 52636 - DNA, 1138 bp, Homo sapiens
gaactctaccacgagctcaaccagaagttccacactttcgaccgctaccgcagccagtccacggccaaggtgagggctcctcccgtggctgcccctgccctgaagctcagggcctgacctggtgcagtggcccctggggttggagcctgaccggtggcccccgttgcagagggagaagcggtggagtgtgtcctcgggtggggcagccgagcggagcgtgtgcaccgtgagtccccccgggctgggtggggtgaggtgggcctgagggacccgtgccctccctgccctcctgcccctcccaggcaaccccagcctgtctcaccaagggcctcccccacggcatgggcaacagtctggggccgcctgggggtggggaaggtgctgcagatggcgaacaggggtggaggtcctccaggattgggagggagagtggtcagcaggagacatgtcctgggggccactgagaacaggggtcaggagccccaccctggaaccaggcaggtctgtatttgaattctgcttgacacctgattgctccataactttgggcattaccagccctctctgggactcctcagtttgatcgtctgtacaatgggtaaggatattggcccatctccacggcccctcccgctccctccacaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtggatttt

SEQ ID NO: 52637 - DNA, 1887 bp, Homo sapiens
tgtcccccgcgtgctctgcctgtttaatctttctgtctgggtgtctctgtcgcatgcgttctctcactgtggttgttgttgctttgtccctcttccagtccccctccccagcctacccagttaggctctggggatgccgtcccggccccgtgcatttttaaaaagctcctcaggtgattctgtgcatctgtctgcctcctcttctctctccccgtccctttccactgtctgtggctcggtcccactgtgtctgcgtgtccttccccaccttcctggtccctgctctgaccccgtagttcgctgctttcggtctctgttctgtttctctggctctggctcctcagcccctctctgcttggggacattactgaggccctggggtttggggccctcccagtcttgggcagctgaagagctccagctgagtggaggcctaggctcaagccatcctgtcccccggagtgtcactctgatgggctctgccactgtcccctcagggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtggggctgggcctctcccgcctgtgtgtgcccaccacacctgccaggcccttggcttctcctcactgtgcagaccgggaggatcgaggccccgaccagggtgccccaggccccatctgggcagcccttactgtggaagctgatagcccggggtacccgcaactgtcccttatgcttatccttggcctcctgggtctcctcctcccgttgcaccctgcccaggtgtcatcaccttccccaaggttggatgtgttgccttccttctacacttgcctgggcatctggggtgggaagcacagccatctgtggtcgggggccctgcagtggcctcaggcccagcaggcgccctctgtccccaggtccaggatgtggtgaagtgccagatgggggtgtgccgggctgatgagagcgaagactcccctgactcgtgtaagaacgggcagctgcagatcctggtgagttaggggcctgggcagggcctgggcagattctgggcaccccccaccccaatcctcctgccctagaccatttaccttccccatccatggcagggttgggacagggattgggtttgattcaggctcagccactaacacctgggtggcattgggcaagtccttcccccactcagttttcctagccatcaggtgggctggggtaggccatgcctgggctctgctgggccatgggctatgggccatgggcagccctaaggcaggcagactgggcaaagctggctggggagggcctgagcctcctcccaccctgatacattaatcctccctctgcccacctgcccctccctttctgcctatagtcagactttgaaaaggatgtggatctggcttgtcaaacaggtgagtgtgccgtggcagaactgagaatggtcctggggttggagaagaaggggaggccttgagccccatcatgggaggccctgatggagttctggctgctggagtccagcttcgaagttagacagccctgagctggacgcaaggctgcgaatgtcccttactgtatgaccctgggcaaacaacctgcctctctaagcctcagttaacacacctgtaaaggagagaatactgtcctcccagggcaggtggggggcttaggggcatgcatgaattcggggacatcgagttcttagcaggacccatggcacagagtgttacgttattatatcatttccagattcttaccagaatctttccattt

SEQ ID NO: 52638 - DNA, 1047 bp, Homo sapiens
aagcaagtagagatttgagagtagatggtgggcttcttggacatgctgaatttgatggtcaggagaactgctcaggaggcaggaggatatccaggaatggagcacaggagaggcagggcctggggatgatgatttgggagcattggttcagagggggttaattaagcctggtggggagcacgtgcagtgaaaacaggacaaagcatggactcctgatatgggaaacagcaggaaaatagacccctcaaggagatggggacagagtagctagagaggtgggaaaccaggagagtgcttcaagggaggacgagtcagcaggaccaaatgctgctgaggggtcaagtgagaccaggtctgcaaagtatccacaggatttagcaacaaggaggacactgatgactttatcaagagcacgttcagcagagagatgtgggcagaagccagactgcagtggattaacaggggaggtgatatttgagccaggaagtgagtgtcaggtgaaaaaccagagtgctggctgcagagcagtcactgacggaggagggaaacagagggtcagaggagggcctctccgagagcgaaggaggcctggatctgttcctgggctgccgcaaggggagaatgctgacagggtgccgatgagaagggataatgggtggagccctcctgagaaggctggaggagggggatgcaggcccaggccacggggctggcctttgtggggagaagggctgcagggaagttggtagttggagaggctgggcaagaagctgggggctcccgatgttgaggtcatcgctgagagagtgggcagagatgagcttgaggagagaggacaaggtgcagtatggccacagcggggaatgaggaaggaacagagccaagaagggccactgagaagtcccgggcgcccagcggatgtggagcccctgaagctgtcatggtgccagttggcacagccatagatttcttcagcagcctgggggtgggcgtggagagggtagcttgtcacaaggctccagggctgggggaggggatcgaggagct

SEQ ID NO: 52639 - DNA, 1085 bp, Homo sapiens
gtgcacaaaggcccaaggctgggaatgatcgtggcaggccctggcgctgcaagttgacaagtttgcctggaggctggagtaggcagggagcagggatgcattcctgtccacacaggtcagtgagttttggcagttgccccggggtcagggcagagagaggcaaggaagagtgtccctgggtgaagaggcctgagcttccaggctgccttggagggctgggctggctcagctcccagtgtcccgtcttccccctcaggacccatgtcttctgggaccgaggccgccagctgctagagcttcctgctgactgggcaaaagctctgcgagcccttgagtcctgcctgctcccgctcccaccccagctccctcagccacggctgccttctacagaccctgcttcctgcagcttcaaggccctgagggcctcagctggatcctgtgtgcccgctgaacagtgctgggccggggactgaccaggagacctggagggaacagggactgatgacatggggatgggaaggaggcaggtctggggtctggtctgcagctctggtaccgacagggaggcctctcctctctctgggcctcagtttccccatttgggatacaggtgctggcttatcctcatgaggatcaaggatgcagggatagaggatggaaagggcatctggatttcactgggagagtgtttacaaggagacagggtatcatgtgagggctgctaggagtgctggaggagagcggcctgtccccagccctgctctgctggctagagccctggagttggcctctacctttgactgttaccttgagttgatccctttatttttggtgggcagtggtttctttgtagaatggggaggtatccctgaattaattagagggggtagttatcttgaaagtagcctaacccagtactttcgatgggggccttcttggcttctccaatgagacatctgacatcgtgcccatccacggcaagtgcccggtggctttgctgtggcctctctcccaggctagcttggcctctaacggcggtcaatgaagccgtccgagtgacagccgggccgcgggtaggttacagg

SEQ ID NO: 52640 - DNA, 3091 bp, Homo sapiens
gacaaaatcaggatggtagtgcacagacaggatcttgacattgatctggaataacgaatcatgctattttgttatccagaattctttgacaatttttgtcttgccctttccctttcaacccttcctttaaaaaaagaaaacgaaagtagaaactattctgatctttattaaatggttaatagactataatgacagtcagcaagaaaaatttttctattccttctaggagggcttagaaagttcatgttgcaacttagctctttaagaattgttgtagtatgggaaatatgctggttttcagctgtgtggaattagaaaggctttaggatgtaaataatgcatttcagtgaatcagacagctctttttttacatgataaagtttgccattcttgtattttcagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctctttgtgcatttttttcctccatcctcaagagtttatgtctgtgcttataaagcggagtttaagctgggtgcagtggctcatgcctataatcccagcacttcggaaggccaaggcaggcggatcacttgagccccaggagttcaagacca

SEQ ID NO: 52641 - DNA, 1024 bp, Homo sapiens
tagttcagttaggcctgccgtgtgtactgtgtgcaggtattctgtattaggatgttaatcatggagaaaatatcaatttaatgtaaaaggtcatttcttttcaggattggccatttgatgatggagctccaccccctaatcagatagtagatgattggttaaacctgttaaaaaccaaatttcgtgaagagccaggttgctgtgttgcagtgcattgtgttgcaggattgggaaggtaaactcttacctttattaccctttttgtctgaattcattaccatgcctaagttagttgaaagtttcactttggtagacatttgcatatattatactaaataacattaaattacctgaaaggaaaggaaatgagaggaaaaactagtgtaatgatttctcaaaagagcctgttcatttcatctggttgtctgattctgatgccagcctggattgtgggtgttttatttttctccctatttcaagtaatcaaaagttcaggtcactgaaattggcaacaaaattaaaataattttagagtttgatgaatctatacatggttaattttggactgagatgaatgggaagttaatagatagcagatatctgaactttaaactcttgaaagaagatgtatggacaagaattgactttgatcttaaaaccttttcccctgagcattgcttagaatggtgttgcaacgctgtcatcagcagcagattaaatgccaatttaggatgcacactttgactcaaaacattagtgtaggctgccattgcctcaaggtggtgattactcaagctgttagttctgctctgcccttttgtttgctatttccttttttgtagtgtggtactgtttgttcataaggttagaagttttagtccttatcctgaaggttgaagataatgttgtaacgtgagttggcagttttataactagtagctatcctagttttaggtagcccaaaattggtgccctgtaatgggctttataaaaacatcatttcctttgttaaatttttttaaaa

SEQ ID NO: 52642 - DNA, 1031 bp, Homo sapiens
ttttttttttttttttgaggcagagttttgctcttgttgcccaggctggagtgcaatggtgccatcttggctcatcacaacctctacctcccgggttcaagcgattctcctgcctcagcttcctgagtagctgggattacaggcatgcaccaccacacctggctaattgtgtatttttagtagcgacggggtttctccatgttgatcaggctggtctcaaactcccgacctcaggtgatctgcctgcctcagcctcccaaagtgctaggattacaggcatcagccaccacacccggctcgagtctctgatttttaaaactcttcataatacccctttatccaattcttcatagatggtaataacgtataattggtgacatttcacatcgctttgggcttataaagaatgtattttgacttcaggcatttgtgtttactgtgccatcagcctctagttcattttacttattcttttcttctccaggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcact

SEQ ID NO: 52643 - DNA, 1027 bp, Homo sapiens
gaaagaaagaaagaaagaaagaaacaaacctgggtttttgttcttaagctgctaccagttagcagtgcgatcatacttaagccattttaacctctctgagccccaaactttgttttaaattttttttttgacagagtttctctcttgttgcccaggctggagtgcagtggcacaatcttggctccctgcaacctctgtctcccaggttcaagcaattctcctgcctcagcctcccgagtaggtgggaatacaggcatgtgccaccacgcccaactaattttgtatttttagtagagatggggtttctccatgttgatcaggctggtcttgaactcctgacctcaggtgatctgcctgccttggcctaccaaagtgctgagatacaggcgtgagccatcacgcccggccaacttttttattttttaaaaggtcagggtagttgatgtttctgttggttctaaaatttcttgactgtacaaggagtactttatgaaatgttttcctctgtaatctaaggtggctatgttttggggttacagttagaattttgaggtaggaagagcgatggaatgtatttttgtttttagttttgagggtagacattttgtgtttttactgtagcgagtaactcattctgctgtagtattattgaagttcttagaatgccattttgaatttcatttgtgtcttttatattattttagttttatgtttgtgtcagtggttatataatcacaagtatgcaatttacacaataaaatgccataagagtatcataaaaaaagcttgaggatagatgaatagtgttgaagctttgtaggcctagctacttacctatatatttcagtttcttcctgaaaatggttccgtagtcattatctttcatacctatttctgtctggttacagctattttttagagacttctaaataagcctttattggtaacttagggaaaaggcaagtgaaagaacttaagctttgtccctttttccagaggaatttatgattatgttgatgttctctga

SEQ ID NO: 52644 - DNA, 1245 bp, Homo sapiens
tcttaatttaaaaggacttctctgtcacagactatcctttctcatccttcattgaagttgtattcttttgttaaaaatggaaatgttgcctaggaaatggaaatatcccaaattcaacattttaaaagttaggttttatgataaaattaaatggagagggagtatttgggtgtatatttgaatttaccactgttatatgtcaagtaaactagcctttttcatcacttggtaagttaaaacaataatttatttaagtagatagagcagaattaatgtcagagagacaactttaggagaattttcctgtatggtgtacatgcactgaatttatgttaaaacatagggttctgcaacttttgagtactttctagctgtgataggttgtttatgattttttacacactgtttgctttgcattcctaagtgtgtcacaggaattaacattagtttatctgaattgacaggtgcaaaaatgtaactgttgatgtgtagttgaactcttgatggagggggagggaacagaagcttgtttttatcatgtatctgttaaaagtgctagaacatactgtttcttttggcagaaattcctttgctgggttctcagtattaagaattgaaaatcttaataatgaattatctttattcctggaaatggtctttccaaaatgaggttgggagagtaagatgggataaagcttgttctgtttgctgagcagacacacactggagactaggtagaaaacttaatgctggagctgtagcctttaagcctggctgtcactacaatgcaggtctttcagtgcctttactcagctgacacacatttgcagtgataacgtcattgaaccaaagggattcaaataggttagaatttccttgtgttttgctctgcattgcatgcaaactattgttctttgagtagttactttaataaactccacccagtctcccaccttattttaaggtcgcagagttggagatgaacatccaagcagatatttggaaaaaaaattatacttgtatggaagattgcaacttgaaaaatatgtggggctggacttagtggctcacgaggcctgtaatccctgtgctttaggaggccaaagctggaggatcgcttgagcccaggagttttagaccagcctgggcaacatagcaaggcccccgtctctccaaaaatactttaaaaatattagctgggcgcagtggcatgcacctgtagtcccagctactcaagaggttgag

SEQ ID NO: 52645 - DNA, 2526 bp, Homo sapiens
tggcgtacaaatgattttgtcacctcgtcaccagttagcaagcatagtacctgataagtagtttttcaagccccactctcctctcaccctccaccctcaagtggtccccagtgtctgttgttcccctctttgagtctatgtgtactcagtgtttagctcccacttataagtgagaacatgcggtatttggttttctgttcctgcgttaattcgcttaggataatggcctccagctgcatccatgttgctgcaaaggacatgatttcattattttttatggctttgagttgtcactcttgagtgaaacccttcattggcttcatttggagaggcatcattttctgaataaaagtcaaatgcttttagtggcctataaggctctcttttatttctctgactctattcattccattgtcctctctgttccagtagcattggttcccttgttcctagcatactctaagcttgtccccacctcataacctttgcagcagttaatcctctgcctaaaatgctccccaaatacctgtttggctcacactctcagctcttggataaaaagtcacttttttcagtgaggcctttcctgttagccttatttaaaattggaacccccctccctctggcactgctaattcccctacttctaatttttctccagagcagtgacatttttatttctttttttctgcccagtaaagtgtaagatccatcccaacagaaatttttgttttgcttattgctcttgcacctgtaagagtatgtgacccatagtacatgttctgtaaatatttgaattaatgaaagaatttgaggaaaatgcctagctcttcaggaggataaattctttactgttgacagattagattttttatacttattttaaggggaaataaaagtggctattgacatgaagggaatttgctttaggaaaaaaatgttgcaaggtgttagttgtatattacattattaggctttcatgttgactgattgttgaaaccaagctgactcaaatttgcattacttcctgtaaaatttctggtaagaaaagtagcagtaaatatatgcatactcgttttttttagacctttgcttttagactgtatttccttaaatctagaattcttttattgtacctttatattttaatgtgctgttttaatttggtgaatactggcgtagctcaccaaattagagggtttattgtatcatttaatttggaaatgtaaagggatgatttcttagaaatcctgatgtgagtggattgataggagagataaatatatatatatatatatatttttttttttttttaattttttgaaacggaatctagctctgtggccaggctggagtgcagtggcgcaatctcagttcactgcaacctccgcctcctgggttgaagcgattctcttgcctcagcctcccgagtagctgggattacaggcatgcgccgccacgcccagctaatttttgtatttttagtagagatgggccagtatggcttcgatctcctgacttcgtgatccactcaccgtggcctcccagagtgctgggattacaggcatgagccactgtgcccgccaattgataggaattttaaaaggatgcccggtaaaattgggttaaattaaatgaggctgcttttataaaattcccttatacttctaaattcaccttttttttttttgagatggagtcttgctctgtcgcccaggctggggtgcagtggtgcgatcttgggtcactgcaagctctgcctcccgggttcacgccattctcctgcctcagcctgccaagtagctgggaccacaggcgcccaccaccacacccgactaatttttttgtatttttagtggagacggggtttcaccgtgttagccaggatggtctcttatctcctgacctcgttcgtgatctgcccaactcggcctcccaaagtgctgggattataggcgtgagccacggcgcccggcctctaaattcactttatttgtagttagaattacagttgccaaggcaggacgtgaattttactcatttagcctctttaacaggaaagaaaacactttatggaattgtgtaggtacagacctgcctgggacagaggactagccctctggagcctctttctaatcctatgattatagaactgttaagaacgtagtttgattgtaaatcattatagggttcttatcaccttagaattttttttaaaggtaataccatatgtacatgggaaaagttaaaacagttcaaaaggtatatgttaagatgtagtaaatcgtgctgttgacctccagccttcagtcctgtgttcctggccctgccccaaccctaggaaaccactgttatctcttatctttgtaatcttccagatatcccatgtgcatgaatgcatacagtactcacacatatttctaagcacactgttgatactgtcatgtactgtgcctttttttacttattagtgtcttttagctgtcatttcatatcagttcatacagatgttttctttttaacctc

SEQ ID NO: 52646 - DNA, 1046 bp, Homo sapiens
ctggccactgtcttggcacttgaagccttttaggttgcttagtgtagagctgaagtgcatattgtgtgaaaatctttttgctctttggagtggtagaggtctaggctcaaccagaaactgtcactaccctagcacctccatgaaagaagctgcacagcaatactagctgtctgctttccacagttccccattgtggagttaccaggacttaggtgagagaatgactcgtttcctgcactgtttgttcagtcagtgtagatttacaggacacagaaatctttcccagaaaaatgactgtgaggagttgacagattatacagatattttttatgtgacttgaatgtagacggtttttgtttgcctatactgattttcttgcccacaggttatgttaacacagcatccacttcattttaagtggcctaaactaaatttcatcatttgaatataaatttaccttacacaatgttggctttttaaattcttgagaattttaagattaggcttttttgtgaccctttctttgctagttgagcctggtttgaaaaaatattttgaacatttagaacagtctttacctttagagaagtggtgcatttaattcctctcatagtattttttatttgaacttttagtcttctcaagacattaattcttttggcataaaatgtacacatgatatatttgttttagcagatcagataaattactttatatttttatttctgcagtggccagatatgttggctgttaactaatgtattgtttgacaggaattcaaattcacaatcaggtctgttttcttccagttgtcctttagtttttgtttaaatttgaccaactttttattttccccaccgttttacaggaaacattcactaggttgtatcaccacagtatttgtaaattggatttatatacaaatgttgatatttgttgtttttagtagcagaacaaattgttgtgtattgtattttccattattggtgaaaagcctttcattaggggatggagtgactggttagtgcagaaggatatgagtcacc

SEQ ID NO: 52647 - DNA, 1053 bp, Homo sapiens
agagctgttgaaactaatggagaaggctggaggcaaggggatcatttaggagatgctgactggaggctctttggggcctaagctaggcttttatgtgggaggagattatgccttgaaactctcttggggccccggggtgtgtgctttgagacagtttttatgaggcacctgggatatgtctgcgtgagggaagtctgattaaagaaatgcagcagcgtcttatgttttttattttttggaaaaagaggagagtatatttattggggccaagagtgaactagaacttaccactgtatcaaagtttctctgttgagctgtgtgggacacttaaatcagaagaagtgagaaaatacacgtgaaagcactttgttaattataaattgaactacagattcaaagtattattaccactaagatctttctactaaggcaacagattttgtagctggaaaaggctggcattttagaacacctttatagatgaaaaatagttttgaactgctgaacggggtattttctgactcagaacagcaaaagtcaggccactccctctgtgagtcagtcaagtaaaatttaatttgaacgaaccaaatttataggcagaaaccatttacaacatcattgaactttgtagcactaggaagagtaaatgtttgaatacttttgtgtatagctttaaaaaacagtatgagagccccatatatagttgacttgaaaaaagtttcaaacaaggtaaattggatttatttttctttagaattaactttttattcattttgtcctataaaggtagtatttccttatgcagtaattaaggaacactttacaattttcagacacaaagttgaaatttagtagggatttattttacaggatttgactatactttttcctttttgttgtaatgtgggggttggtaaccactgaagcctagaaaacgaatgtatttacaaataagatggagaggagcaggtgcatacatttttagctgttgctcttggtcttggaagaatgaagcttaagtttttgtgaaactaagtttggttgatttat

SEQ ID NO: 52648 - DNA, 1075 bp, Homo sapiens
ggtataagtctcctccagcggcactatgatcttctggctctgggattttaatttttttcccccagaaaggatgtgatgtgtttttttgttgttgttctatacatttttttctcccacgtttcatgacttcaaagtaaattttcaaatttgtcaatgatgccatcctatcctagtctggggcccctgagagctaacgaaaagaagtttgtctgttgcccaaaatcctacactctggcctgtagagtgttcaggagcataaacttttgtaaagtactgctagtttttcaggtgaagagtattttattgttaggtaaattgaactgtagtctggtttattatttcctggaatttgtcaagaaattagcagtgactagcaattctagtgtcactgtaggcattcagcaaatgtttgtctgtccggagtcgccaaactacattacactgctgagttggaatatggtacttgctgtcatgctctgtaagagagagtagtttcagagggaagtgagtgaagttatgccttgctgagtgtgcaaaaggagattaaggatacagaatgacacattatcagggcttcagaatcacttgccagcacaccattgtattggtgaagatggtgagaagttgtttgctggtattctgatcttggcatttttaagtttcataatgaatggactaattattatcatggacttttcccattcttgtgttgtaaaagtagggattcttgaagagtagtaccttgatagggattttacacattgatataatcttaaaaatgatgttatcttaaaaataatgtctcctagaagttggtagtctttcacttgatcttagccaaaaggccgagaagcgatagaagttggtagtctttcagtataagcaaagagtagtatggtccttttgttttttttttgtttgtttttgagatggagtctcgctctgtttgttgcccaggcttcccgggttcaaatgatcttcccgcctcagcctcccaagtagctgagaatacaagtgtgtgccaccacacccggctaattttcatatttttagtagagatggggtttcaccttgt

SEQ ID NO: 52649 - DNA, 1033 bp, Homo sapiens
caagggcggtgccggtggctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcaggtaagggggcctcccgtgtccctctgggtcgcccggccatcccgggcatgagtggccctggctttgttcctctcgcttcccgccccctcgggaccgaggcagtcgggagttccggtctcatcctcatttttgggagcctggattccacattcccacctcagcccggagtgcgtgggagaatttctaggctgcagtggaggcccgaaggcgactttgcgatcccctagcgctaatgtcttgatggatagtgctgagctccccgcccctttcccgactcttccctcctccctcctcttgcggctgccgggcgcgcagattcttccagaaatgaaccttcatttccccctttccctgaagggaaaccctttttgatcgcgggtggcgatgagcgcctcgaccgaggtgtaggaggtgaagacagccagagcggggagggaccgtgggaggaagggccgaggtgaggtggg

SEQ ID NO: 52650 - DNA, 1084 bp, Homo sapiens
cttaaggactagtatctagagtactaatgtcaccgtggaactttaatggaactatccattgtatatttagattatttacttttgtttttttcaaggtaagattatactttgtcttgatgcagattttgatttttttgtttgtttctttattctcctttcccccatctcacccaattaattttgttaaattgatttaagaaacatttaaatgtctctgttgtcatggcttcaggtgagggtggaagagtacacttcttttattagaagcaggctttgggctttctagtcaacttcatatagctttagtgctttcagctagtttctttctgaaattggcacatttgtgtgaactatttggtttcactatatggtattccatgttattgctttaagcagacttcaaaatttgcatttatttaccagggcaaaaataaattgtttttcctattcagaaattgagaagattcagaaaggagactcaaaaaaggatgatgaggagaattacttggatttattttctcataagaacatgaaactgaaagagcgagtgctgatacctgtcaagcagtatcccaaggtaaggcaaaaagtgctttggatctttgagttatctttatagttatgagagagtcatgggctataataaagactcctggggattgtgatgctttagaaacttaagcctgtgaagcttctctttcatgcttgtagtacctgttactgagagttgaaatatctaagttcttaactaataacatagctatagccaggaaggaaatataatcatctttttattatcaaaaagtttctttctcaaatgattgctcaggctacaagttcaaagaaaaaaaaattaaaacctgaagagttgctctttgtcaaaagactaacctgaaatctaaataaaaggaaatataatatgaatcctcaattggttgaagttaattttattttcttactaaaagtttacttttaagtaaatgctttttttcttcctttttttttttttaggaaagcatttagttacatttagtttatccagcgtgttatcaaagggtgctatatagtctcttctgttctgagg

SEQ ID NO: 52651 - DNA, 1615 bp, Homo sapiens
agattgcttgagcccaggagttcaagaccagcctgagcaacatagcgaaaccccatctctacaaaaaatacaaaaattagcctggtgttgtggtgtgcacctgtacccagctactctggaggctggggcaggaggatcacttgagtccagaaagttgaggctgtgatgagccatgattgtgtcactacactttggcctgggcaacagagtgagagcctgtctcaaaataaagtaaaaaataaaatagtaaaggtcttaatgtattatggaagagcaccagaatacatcagaaaagccaaattcaggtctaggaactgccactttctagtttcataaccttaagctaatcactttattaatatggcttcagtgtccttcagtaaaatgggaatggtaatactctacctttgcagggttgtttaaaatcaagtgaggtaatttatgtggaaatgtttttatatagtagcatgtatatttagaaatcctctattttctgtcagttcaattttgtggggaagattcttggaccacaagggaatacaatcaaaagactgcaggaagagactggtgcaaagatctctgtattgggaaagggctcaatgagagacaaagccaaggtaagctcacattagtgaggcaagaggacatcctaatgccttctacttgcccagaatgcagtatggatgtcttatagaggcggcaagaattttgtatgtgtacagaatgtggctcctttaagtttgcactggatgcaagagattatacaccaagttaatttacttggcttggcaaccctggaagagcctaggtgtgccctggtgatagttttcttttggactttttgactgtgtagtaatggaaacagcagtagcatgttgcgcattggtaggattgtctgtgaaaacttgaaaggggaactgaatatactaaaatttagtctaaagcagacaaaagacgctaaaatgcaaatagcacacccccttttttgtaacctggaaaagtgagaacaataatgtgagagcagatgagtttgaggattagttggtttgttttatagccggtttggaatgtgaggctcactaaaagaatgtattccaaaaggaaccatgagtaatcctgactacagaatctaatgcgtcttttttttccccatgccatagccgcgtacgctgtgtactctgtgacaagaaacttctcaccaaaacagaatagtcttagccttctggggtcaccttatttgatgagatattcctgctacagtccaaaaaccaattctttcaaccctccttttatgtagtctaatggacacatgtttgttttctcaggtcatttcttgctagatgcatatagttacggctgaagtgtgttctaactaatgagatttacatgagcttttcttccctctgtcctgacttctttcttcccctaccactccctagaccatataagcagataagcagagctcgtggtgattaacagctctacctgtgatttaaaaacaaatgcttggcaaacagctattatctgaatagactagaattaagtttttcttctttatgcttttagtaggagctccaatggatatctcagggatttaagacaacaattaactgta

SEQ ID NO: 52652 - DNA, 1882 bp, Homo sapiens
tttgaagattaaactgaaaaatctatataaagcttattatatagagccaagtgcatacagctccattaatggtagtggcttttattattccaggaaaaggaaactatttgcaaagaatggatatgtaagagtatgccaggctctgaactacaagttgttcagtctggcttgtgagtaggttatatatagagagagaatggaagtgatccggagagctaggcagagaccacattatgaataatgaggggtctaccatcaagacttttctcaaagaggtgacagatagggtgccatttgacttcagagaaggaatgacctgagacctcatctgggctctcaagagctcttcttagaattcaagtctcccgtggaccagatgatttctcagtagaaagtgtagataccacacaatactccttgtatctttcgttcccaggatatgatggatgatatctgtcaggagcaatttctagagctgtcctacttgaatggagtacctgaaccctctcgtggacgtggggtgccagtgagaggccggggagctgcacctcctccaccacctgttcccaggtaaaaataatggagacacccagaaataggatgtgaatttgactactagtgtcatctcttttagtggtgctcttatgtctagcttaggaagggtctcaggatttgtatgttgcataaagaacagaattctacaaccatactctcacacctgtaatcccagcactttaggaggctaaggcaggcggatcaactgacatttggagtttgagaccagcctggccaacatggtgaaaccctgtctctactaaaaatacaaaaattatccaggtgtggtggcatacaccacactactcaggaggctggggcaagagaattgcttgaacccaggagacggaagttgcagtgagccgagatcatgccactgcacttcagcctgggagatagagcaagactccatttcaaaaaaaaaaaaaaatagagttctagatcttgggcactttgaccatagccaagtgctgcagtctagctgaaacttttggtcttctaattttggacagtcttagcatttgttaatggtctgactttaaaattctaccttttgtgactgacctttatagagtattcagactctccagacctacccaaggcagtgcagtgatgaattggtcctctataggacctgggggatcttgcagtgtgggtcctttaccctgtacattcctctgtgctttaataatagcctagttaaggcttcataaaatctgcctaattccagaatttgtaaacaaatcagaacataaaagtggcctgtttataaaaagctccatttaagataaactttcattttgtaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatgtaagaaatttgaacaatgtgccatttcccagtacctagaaggctgctaaaggaagttgaatgacagggcctcggtcctttatgtaggtgtcatggactgcctgtaagatttgcaatctgccctcttctcttgcagtgaatgttgaactattagaagatttttccattttaggcagggttttactatacgcctgtagattaaacaagaaataaaatgtactttaatgtagtattttataatgaatttcttactactagtactgataatactaaagctcgattttgtactttacttcctgcccacacttcttctgtggca

SEQ ID NO: 52653 - DNA, 1009 bp, Homo sapiens
ttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttag

SEQ ID NO: 52654 - DNA, 1052 bp, Homo sapiens
tcagcccagattaatcagctaaatagggcaccttgccagaaatttgggtactatttctgatcttaatattgcattaagatgcctgaattggctgttcccctgtcaacctctggtgcccacctcagggtatccagtctctttcttctaggcactgtgatgtgtgtgaaaacttgagatagaagagtttgggttcagatacagagctaattattcccaggggtcttctaactccagcagccttcatggttcctattcatggcctagctttaggtataagatggttgctcctcaggtctcaggctctctggggttggaatgtagcaaacaaattctgcatctgcctttgagaaagagaaatatcttatgctctgatgtgattctttctaagcttctctctagaaatcagtacaaatgtctcctttcattatttttaaaaatacattcactattatacattagaacacctactatgtgctagacactggggatccagtggccggtgaacaatataaaatggtccttggcttcatggagcttatagtctatttgtggaaacagatactaaacagataatctcataaataacataatttcaattgtgttaagttctacaaagaaaagaacagggtgcaatgagggtatacaacctaatactgtggttttccttgaggaaatgatgtttaagccaacatataaaggaggacttagctaggcagagggcttggggaaaggacatagagcagcacattataggcagaggataggactgaagcaagttgaagccgaggtacgaatctggaccttttttatttttatttttgagacagggtcttgttctgtcatccaagctggagcacttatcaatatgatggctcattacaccctcaagtgatccaggctcaagtgatcctccacctcagcctcccaagtaactgggactataggcaggtggctaattttttctattttttgtagagacaagatctcaatctgttgcccaggctggtttccaactcctaggcaaaattggtcctcctatgttaacctcccaa

SEQ ID NO: 52655 - DNA, 1152 bp, Homo sapiens
ggatgcgagcgcagacgggatcccgccccctcctgtcgttttgcggggtggggcctctgttgtgggggcgggacattggacggtgggcggggcttctaagacgaagccctgtgggggcttgggctttcgtgaggaccagctcgtcggggctagaaaggggggcgggacttaccagtgggcgtggcttcagcgctaagggtggagattctgggcagggggcgctagtgcagtcggcgtttctgggttggaggggttacactgggggcggtggagcggggagacttccgactgagggagcccattctggagtggggcttctgggctgagagggcttttattggcttgtgggcggggtttctgggctgacagttgtgtgtaggcggagcttctgggctgaggggctttatgtgggtgcagagcttctaaagagaggagagtgggtgtgggcagagcttctggactggactaagggtgtttgtgtgggattttctaagccaagtataacagcgtatgaacagagcttctggtctgggggtttatggagggcagagctcttcgccaggtactttttagagacttgtggaggtttataattttgggcatacatccaagcccaaaattggctccgaagtgtgggaaacgcttccgagctgagatgctacggcgtggggtgtatgtgaatggaggctgctgtgttactgtgaagaggtatgaacaggttataactttttaaaaatatgtatatgtatgtatatatattttttaatagagaccgggtttcgccatgttgcccaggctggtctccaactcctggtctcaagcgatcctcccgcctcggcctcacaaattgctgagattacagtcgtgagccaccacacccagtcaggttgtgacttttttaggtgcttaggagctttgtgcagaacttttgtgcgaagtggtgcgtgggagcttgggctagactgctcagcctagtaggtccaatttttcagtccacagccacaggattctcccagccatatccttgaccctttatttaggccctgggtcctgcccatgagatcccagaatgccctttgagctgaatcatggggccctggatgaaaaagctgtcccaaagttacccagagttataggcctccagaaacttat

SEQ ID NO: 52656 - DNA, 1047 bp, Homo sapiens
cactctcattctctggcatggaatggggtgttgcacaattcttttttcttttcttttctttttttttttttgagacggagtctcactctgtcgcccaggctggagtgcagtggcgtaatctcggctcactgcaagctctgcctcctaggttcacaccattctcctgcctcagcctcccgagtagctgggactacaggtgcccgccaccacacctggccaattttttttttttttttgtatttttttttagtagagacggggtttcaccatgttagccaggatggtcgcgatctcttgacattgtgatccgcccacctcagcctcccaaagtgctgggatcacaggtgtgaaccaccgcgctcggcctcacaattcttaaaaataaaaaaataaattagtaagagtgggttgctgagagttcagagcacctgcccagcacttcatgtgtcctgtactagtttagcacttgcctggtctctggcccctaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggtatgtgccctctcctcaatctaggtcagaacctgagactgtaggcctccaacgtggtatacatatgttggtggtggcggagtgtgggttgggaagcatccatagcttccatgagactgatgtctgtgtcttcagaacagttaagagctcctgccctagccaagtttcaccatccacagggtttcacacgttaccatgagtataatcaggatgtgctgagtagctggggtacagctaggatttggatttggctcatcttttgagttgagagttgtctctcaccagtttcttctccttctaaggagtgataggtcagttctctttctgataggctgtacctataagagtgctggattaactcatcactcatccctgagagg

SEQ ID NO: 52657 - DNA, 2022 bp, Homo sapiens
agcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgcca

SEQ ID NO: 52658 - DNA, 1485 bp, Homo sapiens
catgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgcca

SEQ ID NO: 52659 - DNA, 1066 bp, Homo sapiens
ggcgggagcaggcggctggccggcagcagttactcggggtttccggtgcgaggccagaggtggggaagccatcggacgtcggcggtgaggtacgtgcagcggcggccggtgggcgagactatttgagagtgtgcgggccgggatgttctcggcctgtggggaaatcacgccaactccccgcgtgggccgggggctgtctggggatatgcgcatgcgcgggcgtgcctcgcggcttgagggcgcgcggggcgtgggtggctgcgcgcgcggggggcgcacgtggggcctgaggggcgggggcggtgccgggagtcccgccacgtcagtctccggccctgagccaatcccgcgcccggcctgccgcgagggggccggttgtgccgggaagtggctccagggagaagaggcctcttccctcacccgctgtgggagctgcgccccgaaagcctgccccggcacgtcgggctctcctgacccgccaagaccagagagccgttggcgccctccgcccgggcctgccggtccgtttattttaagaagctttgtgcgcctgctgtggggatttctgatccaggctgcgaagaatttcgaagtctggaaaatagcaactgtgtttgtttctaaaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggtgtgtgccagctctgcgttgccagcgggcagggggaggagctgtggggtcggcctcgcttctggacttacaggccgaggccaggttgtccgggaggaggagatgtagaatgagaggacagtgctgggggccgcggtcccccctgcgctctggcgagttggcggagctgccccctctaagcacaggaacagagttctggagagaagctccgacgggattaagtcaggtggcagccaaac

SEQ ID NO: 52660 - DNA, 1014 bp, Homo sapiens
cacctcagccaccagcagctaactgcccttcctgtttgaggcatttctagaatgatctgaatggcaagaaatggttttgtgggggggaaggagatggactagaagttgctccgtgccatccctgtgtgctgatgctttacatacttttatgatctaacaaatatgttcgggtggtagtgagaaatagttgtgtcattttacaagtaaacagacttaaagaagttaggcaacgattactataatttcttgatttaaaagatgtttcgaatctaaattctgacaggaactagatttgctgaatgatactccattcttgcttctcagtttccataaaaaaaaaagttaggcaacatttaactcaaactgatgagtttggctgggcctgaaaaatcccaaccagtggtataatcgtcttctttctcactctacccctcatcctctcctgctgtaggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttgggtgagcagagggcggctctttgtgaagctggtgaggagagggagtttggacttgacgttctctgggccagtctgttctgccaggattcaaaggaaaacggtacttctcagagcagcaagtcactctagtctaatcaaagccagggatgtgggggccacggcatagagagatgcaggagttaccagcacaaagccttctgggttttggagcaactggagcttggcatg

SEQ ID NO: 52661 - DNA, 1038 bp, Homo sapiens
ttttgaaggaatgcgagggagcgatgggggtctgtctgttaataggcacaaggtacggtagcaggtggtctcatcctcgggcatgagtgtccagcaagttggggaaatgcaacagcttgaagtggctctagtggcccagagtcagagctggaataggaattggcatctgctggctgtgtggcccctgcttgccctagtgagttaccatttctctgtccctacggtggagcctttggggttattgtgagttcatgggaggagcgtgtaagcaccggcacagcatcagcccatgagagtgctcctggcctgagagggtaagggtcagggcagctcaggagaccctagacctgcatagtgatccccccaccaggaaggccccacaagatgctcacctgccctccctatccctgtccccagctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggtaggcctgggccccctggaacaggtgactctggtttccttgacttccacttaatgtttctttcatgggctttcctcttaaaaagtagtgcaggctagggccaggcgcagtggcacacataagtgattaaaaatcttctggccactaaaaaacagaaattaattttagtaatatacttaacccaatatccaaaacattacaatttcaacatgaaatcagtgtaaaaaagcaaggctgggtgtggtggctcacacctgtaatcccaacactttgggaggctgaggtggatggatcacttgaggccaggagtttgagaccaacctggtcaacgcagtgaaaccccattctactaaaaatacaaaaattagccgagtgtgctggcaaatgcctataatcccagctactcaggtggctcaggcatgagaattgcttgcacctgggaggctgagg

SEQ ID NO: 52662 - DNA, 1736 bp, Homo sapiens
gctgtctgtgatctgcagccagggtgggggtgtgcacttagcgcatatcaggccctttcctgtatgttctacccatcagtgacacagctagcatgaggtagaggtgagatttgcacacaatgtccaagtccaaagttaatgctgttctctccccatgggaggtggtgagcccagtggtaggtctccagtgggagtgaagggagcaaatggaagaaaggaataaaagagcagaaaaaaacgggtgccagtgatgtgcctggtttacatgtaaagcagcccaggtagtttgtgatttcacagcttgtaatgtagaagaaaggaactaacgatggagcagcaactgcaagccagaccttgctgaaagtttttgggttttttttgtcttttttgctgctgaatgtttttaggtacgttgttcattgaaccttctcttgagctctgaggatggtattagtagtcctgttttatagatgagacaggctcaaaagtcaagtcctttgccaaggtcacgtggtagataaatggaggaatacgttatctccaagccgtgccccttttctgcaccatgctgccccacctgacagcctagtcatggcttcaactaggactgtttcctagagggggccagctttggactcggtctgctctcagccttgttaaagtgtttgccgccaagtggtgatggtaagtgggaggttgatggggcacggcactgaaggtctcatttctttccctagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctct

SEQ ID NO: 52663 - DNA, 1032 bp, Homo sapiens
gtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctttgtttctggatctgatccattcagccccttccatcatcactgacttgttcaggtctgctgcagagcgcccatggtggttccctggtatcttacatattccacagtgtctttgagcagtcgccacagcctcaggatgctggcatattcacttgagctgcctgagtggagcccttggcaaagttggcaagacccttgcctcagagaggatcacacacacacaaaaaagttttccctgacctgggggctcacaggctagtgaagggaaaaggtacttttagctatagacaggtcaatggtgctgagagcagagaggaggcccctgcccccttcagcaaggtgagggggtgatac

SEQ ID NO: 52664 - DNA, 1046 bp, Homo sapiens
acctgaggtcaggagttcaagaccagcctggccaacacggtgaaaccccaactctactaaaagtaaaaaaaattagcagggcatagtggcaggcgcccataatgccagcaacttgggaggctgaggcaagagaatcacttgaacccaggaggcgaggttgcagtgagccgagatcacaccactgcactccagcctgggcaacagagcgagactctgtctcaaaaaacaaaaaaaaagaagaggggcagaaagatattttgggaggaggtaagacagccctggtggcaataagggagtagctgtctctatatacgctgaagactagggaggataagtgactcattcagggtcataaaacaaatgagtgaggcactcagacaggaacccagggaccccctttcaggcactgctctggctgtgttattagcagaaaagacttctttttgacctcttcacgcctcctcaccccttcccagtgcccaaggggaaccataaagttacccatttatgctagtaagtagatgggcagatgagttagtgcagatagacagataaactggtgcataggcagatggcacaaaagatcgggaggtgcctgactgccccctaccctgtgatcatggtcatgtccaccccacccagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcggtgagtcctgggggctggtttcagcgggtgtgtggatagggctgtagggcccagtccatggggcatggctgggaccatggttccagggttccagggttccaggactctttcccagggttcagacaggggcttcgttccagggaaggaatgctcctttgagcagctggagcacgttcgggagatgcaggagaagctagcccggctgcacttcagcctggatgtgtgtggggaggagga

SEQ ID NO: 52665 - DNA, 1047 bp, Homo sapiens
tccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgaggtgcgtctctgtgaaaggcccctctctcggtggagttgccgccaagaatttggtctttggagtcaaacaggtctgggtcagccccaccacttactcactagaaattctcggaaaagtcagttgtccttgagcctcagtttcatcatctgtaaatggcgattataataataaccatctgataggtcagttgcaggaattaggtgagatacgtagagcacttagcattaggcctagaacatagtaagtgctcaatctatggctgccattattcacattttattgtgattccttcagttacataaggcaacatttgtgagcctttccagagggagggcttggggctcaaattggccctgcaggggaggagttcagaggaggaaggctggagctggaggacttggggaaggcttcctggaggggctgacattggcttcaaggccttgcaggatgggaactagcagaggtgagggagagggtagtttgagcaaaggcacagacttcagtctgtttccctctttgccctggaaggatcctccttagagggattagtgttctctgggtccttataaccctgcctccctccaaggaaagacattcgctaggagctcaaagaaggcagtgctgctcagtcaggccatcacactgactgcaggtttctcctctttccagtacctgatgccctttctcctcaaccagtgtggatcccttctctattacctcaccttggcatcga

SEQ ID NO: 52666 - DNA, 1050 bp, Homo sapiens
tggccttctagccccagctagccgcccccacttccctccttcgctctcttcgcctcggctgcgactggcggctaaggcaggcccagggaagctagggagatgaatccaggagtccggcctctggggttgtagcaggggtcggggttagagggtggatgtggagcaggaaatgaattcgaggcgagggtcgggaaatccatggaagggcggggccggctacctacccagagacgccgccatggcaacgccgctgtcttctacttccgggaacgaaggggcggagacccataatccggaagtgacctcgaaaccttttccggtcttactcacgttgcggccttcctcgcgtcacagccgggatggtgagtttcagagttaggggtattgcagtgggggtcctgggctgaggctggggcccaattccgagcactgacgttactgtcttgtccccacagaagccgatcctactgcagggccatgagcggtccattacgcagattaagtataaccgcgaaggagacctcctctttactgtggccaaggaccctgtgagtgttggctggagggggtccgggaggggcgggatccttctgccaggacgatgggtggacacgccagttttgccgttagcggggaaccaaagagcagcccattgtgagaagtagggagaggccatgccgggggtaggttggcgaaagtattctaccgggaaaggtggggaagaactctattggccgagtgcggtggctcacgcctgtaatcccagcactttgagaggccgaggtgggagggtcgcttgagcccaggagttggagaccagcctgagcaacgtagtaagacccatctctacacacaaaaaaattagcctgacatggtggcctcgcgcctgtggtctcagctacttcggagtctgaaacgagaggatcgcttgagcgcggtgagctgagatcgtgccactgcactccaagaaaagcaagagaccactgtggaaaggggataaagatgagggtcagcttgcccagagaacgggatgcgacctttagggataat

SEQ ID NO: 52667 - DNA, 1050 bp, Homo sapiens
gaactcctgacctcaggtgatccgcctgcctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaa

SEQ ID NO: 52668 - DNA, 1049 bp, Homo sapiens
accactgcactccagcctgggcaacagagtgaaactgtctcaaaaaagaaaaaaaaaaagaaaagttaaaatactttttaagtttgggtcactggagcaagacaaacagtgagatgtgatggtagcattctctagaatgtcctccctgcaattgcaatggatggtgtagcccagactttgcctgactccaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattggtgagggctgggaatagggctggggttgaggtaaagggtacagttctagagcccagggcctaacatctactgccccacacagacaacaatgagccctacatgaagatcccttgcaatgactctaaaatcaccagtgctgtttggggacccctgggggagtgcatcatcgctggccatgagagtggagagctcaaccagtatagtgccaaggtaagaggccacatggggcctgagcctaccagaataatttttttttttttttttaagatagagtctctctctgttgcccaggctggagtgcagtggcgccatctcggctcactgcgacctccacctccctggttcaagcaattcccctgccttagcctcccgagtagctgggattacaggtgcatgccaccgcacctggctaattttttttgtatttttagtagagacagggtttcaccatgttggtcagtctggtcacgaactcctgacctcaggcagtccaccgctcgtggcttttttttttttttttttttttttttgagacagagtatcaccctgtcacccaggctggagtgcagtggtacgatctcggctcactgcaacctccacctcctgggttcaagccattctcctgcctcagcctcttgagtagctgggactataggcacctgccaccatgcctgggtaatttttgtatttttagtagagatggggttt

SEQ ID NO: 52669 - DNA, 1360 bp, Homo sapiens
agaacatcccacaggcaaaaggaacagcaaaggcaaaggcacagagttaagaaagtatggagtcttcagaaacccttggggtgtggtcttggggacagaggacggggaatagattttaaacgtccttcagtgtgaggaggtaaagagttttgactttcctccaggcagtagggaatctttaaagggttatcaatggccagattttccttccaacagcttttgcagtttatgtttggagagtgaacctgaactagccaataggcataggatgtacattactggacagagtcaagggatatttaggggtgactgataggatagagggggtgaggaaaacacaaagtccatgctgtctcagctttcatttgggtgcttgggtttctggggagctgagattagtagggattgggcccattcagtgtcactcttcttccttccctagtctggagaggtgttggtgaatgttaaggagcactcccggcagatcaacgacatccagttatccagggacatgaccatgtttgtgaccgcgtccaaggacaacacagccaaggtgagcctgggcagcggtctggcagggctgctccctccctccggctgcacagctcaccctgcccgacttcccccaggaaagctctttacagatttcccccctgccttctctctccagctttttgactccacaactcttgaacatcagaagactttccggacagaacgtcctgtcaactcagctgccctctcccccaactatgaccatgtaagagaaccccacctgccttcctgctgaagcctcaggaagcttccaagttctagatgcttgtccagaagttgggctacaacattgtgggggaaatgatgtcaggcagagaggagatgcccagaggagtgacaaagctggaaggattgaatagccccagggcagccagcaggaggtggcagaagtgtctgatcatcccctacctttggtatcctcccattgagccgtgtgagatgttaaaaatgtatatggcagcagaaaaacacaaaatggacttggtgtccattggtcccatctagagtttcttcttccattcaggtggtcctgggcggtggtcaggaagccatggatgtaaccacaacctccaccaggattggcaagtttgaggccaggtaaagaagaagagagctcttccaaattaaaatctcatgtggtgtaccttttttgtttgtttttgtttttgagatggagtctcgctctgtcgcctaggctggagcgcagtggcgtgatctctgctcactgcaagctctgcctcccgggttgacgccattctcctgcctcagcggcccaggcgcccaccaccatgcctggctaattttc

SEQ ID NO: 52670 - DNA, 1050 bp, Homo sapiens
gcctcaagtgatccacccgcctcggcctcccaaagtgttgggattacaggcgtgagccactgcgcctcggcttctgctttattttttgtgatacaatttgcatttgaggccaggtgtggtggctcatgcctgtaatcccagcacattgggaggctaaggaaggcggcttgaggccaggagttcgtaaccagcctggccaacatggtgaaaccccatctctactaaaaatacaaaaattagccaggcatctgtaatcccaaccactcaggaggctgaggcaggagaattgcttgaacccaggagggggaggttccagtgaaccgagattgcgccactgtactccaccctgggtgacagagtaagactccatctcaaaataaataaataataataacaatttgcatttggggagtgccacctccaaagtgttttggaagaagatagaaagtgaattaattgtgtcccttttcctccaggttcttccatttggcctttgaagaagagtttggaagagtcaagggtcactttggacctatcaacagtgttgccttccatcctgatggcaagaggtagggtaccagtgaagcagctgacctaagcctgggttgggtctctgcctttcccagagtaagcacctgactggtgcctggctatctttttccagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaa

SEQ ID NO: 52671 - DNA, 1031 bp, Homo sapiens
tacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgtacatctctttg

SEQ ID NO: 52672 - DNA, 1023 bp, Homo sapiens
atagtcatgtaaataattcagatataaaacaatcctagcactttgggaggctgaggtgggcatatcacttgaggtgaggagttccagaccagccaggccaacatagtgaaaccccacctctactaaatatgaaaattagctggatttggtggcacgcacctgtaatcccagcaatttaggaggctgaggcaggagaactgcttgaacctgggaggcagaggttgcactgagccgccgagatagtaccattgcactccagcctaggcgacagagtgagactccgtctcaagaaataaaaaaaaaaagaaaagaaaactaatgaagtgctgtatacaaattgcatgtagaggaaaagaccatttattttgatcaagaaagggtttggagcttgaggtgggctttgtagtatgagcatcatcaaagaaaggaggacatttcaggtcaaaggaatagtctgcacagaggatactgtggtgtgaaggtgaatgtcatgttcaggatactgatcataatctggtgtgtctggagcacaggttggcaaactttttctatatagggccagatagtaaatattttaggctttattttgccatatgcttgggtgtctgtggcaactaaactgctcagctctgccactgtagtgtgaaaacagccatagaggaactgtaaacggatgggcatggctgtgttccaataaaattttatttaccaaaacaggcaactagttgtatttgtcccaagggccatagtttgcctactccagtctagagcaaagagagagagagagtgagtgtgtgtgtgttgtgggaaagggtggtagcaggagatgaagctggaaaggcaggttaagaaagtccttggatgaagctggaaaggcagattaagaaagtccttggccgggcgcggtggctcatgcctgtaatcccagcactttgggaggccgaggcgggcagatcacaaggtcaggagatcaagaccatcctggctaacacaatgaaaccccgtctgtactaaaaatacaaa

SEQ ID NO: 52673 - DNA, 1118 bp, Homo sapiens
tccatccgtccagataacatgtcggagtacagcaagcagatgcagagatgtaagtccattctgttccctcacactctgaagccgccagttgcatctccctttccactgtagaggcccattctgccgtcctcgcacctcccattcagtggacacctgatttcccctacctcctaaaggtgccagagtgctttttcccctcaagtcggatttttcatgtttcctgatttgtaaacgatagaggtagtactttttctggttatgttcacaacactgtcccaagagtactgtaattattgtagtggaaaaagcactgacctgggacggggagacaatagatacagtaaaatttaactctaactctcagctgagtgggcaagtcacttcccctcagattcttcttttgtaaagtgggctgggccacatgatctctgatttctgtccaactgtaactgttttgacttagtgggtattaattgagaatttagaggccactcaggacagattctagatggtgtaatctttgagatgaggtgatgctgcccctgatcccttggacttgaacttcagagcaggtcccatcttggaagccacgcttagtttgtaggaatcgtgggaattattttagctgtgagggggaaaaaaaaagtattcaaatttgggacaaaactatcatacctgacttcccccttgtgttattttagaaattatctcttagcacctaagacttcatatagtataacagcactgtccagaagaagttttgattaacttatgacagcttatatggaagtgtcagaaaatatgcggcacttgtttgttgctgctgaccacaaggtagtcttactcccaaggaagaaagttatttataactattattacaactaataataactgtacagtggtattgatggcagaaccacagagaccttccttgaagcattaagcttctttgctaccgacaactccaggagctgccagctgctgtgagtgaggtgtttgctctctgaattgcagggtcttatttccctccaagatgaggcaaattcatgcctttcctgtagatggctttagaggtttccataacccatttaggccaaggatcaggctctactctcagc

SEQ ID NO: 52674 - DNA, 1001 bp, Homo sapiens
gatgcccccttgggcatctttccttgatcacataccctttctctcccactcccccagccccccaccccattaccagcactgccaaggtataagcactatcctgaggttagtgtttaatcttcccatctctttgcaatgagcatttgactgccttctctgcctacgtctgcttccacctctcacccagtattgcttccctttagtctaaagctagtgtgagaatgagaaaagcgtttatagcagaaagagagaaaacccatggaaaagtcttccctaccctcacagattagctcacatgagtatctgctcttccatttgccccctttccatctctaatcacatagcttattgactaggaataaaagggctggtcatttgagctacatgttggtttggtgcctgaagaaaaatatttttttttttctcacgtccaaaacacccattccttcccatggaggctccatatcccaaataagagtataaacaaagctttggaaacgcaggcaggccaaactctgtgcaggaggaagtggccagagagggaaatcagttgccaatggataaacagccggggcccagggaccaaagttcttatttacacagcctcccagtgtttacccaggaagtgaggaagagacccacccgctgcacactccctcatgcagccatgcttcttcctcagagcaccggatcttggcaccctccaagtttagtgcagaaccagagctggtaactcttgtggttattgtagatcttgagcttcaactgtgtcttgagattttaccagcacaatccaaactgagctcttctgctctcaccccagggctgctccttcctctacttttggaaatcttgataacagtgggtacagtagaaggctgggcaagagaataagtatgcagccccacacctcctgcctctgacttcctgtagctcattgatgtctcagcagttactttttttttttttttctcctgagatggagtctcgccctgtcaccc

SEQ ID NO: 52675 - DNA, 2063 bp, Homo sapiens
gcctggctaatttttgtatttttagtagagacggggtttctccatgttggccaggctagtcttgaactcgtgacctcaagtgatccacctgccttggcctcccaaagtgctgggattacaggtgtgagccaccgcgcccggccagtagttaccttttctgtaagaggagatttggagctataaagttcctctaggtctgtgagtctacagcctccaggtgtgctttccttcctgttttcatttcatttgccttattgtttgcatatgtttccacattatgtactacttggtacttttaccccattaggcccgaaataactttactccacttgtcactgtgaatgtagcagtaagacactgggctacgggagtcaagacaccgggaccctgattctggttctgctactgcctggttttataaccttgggcaaatcacttaacttctcggtatctgtttgttcctccgcacagtggggttgatatctggcttgtccagctcatagagttgttgtgaggatcaaatgaggttgtatatgtgaaaggacttggaaaagggccgggatatattttcacaggcttttaagacagacaggctggctgggcacggtggcttatgcctgtaatcccagcactttgggaggccgaggcgggcggatcacagggtcaggagtttgagaccagcctggccaacatggtgaaaccccgtctctactaagaatgcggaaatcagccaggtgtggtggcaggtacctgtaatcccagctactcgggaggctgaggcaggagaatggcttgaaactggagggcagagattacagtgagccaagatcacttcactatactccagcctgggcaacaagagcaaaactccgtctcaaaaaaaaaacagacaaaccaaagcttgaggcttgcatactgcttctgccatttactaacagctcacctctctgaacctgtttccctacttatttatttatttatttttttgagacagggtctcactcttgtctcgcccaggctggagtgcagttgcgcgatctcagctcactgcaacctctgcctcccgggttcaagtggttcttgtgcctcagcctcccaagtagccgggattacaggcagctgccaccacacctggctaatttttatgtttttggtagagatggggtttctccatgttgcccaggctggtcttgaactcctggcctcaagtggtcctcctgccttagcctcccgaagtgctgggattacaggtgtgagccactgtgccaggccttgtttccctacttataagatgggaccaaatcttacctcagaagcttgtgtgaagatgaatgatctcgggtatttaacgcatgtagcgcagtgtctggcgtgttgtacgtgcgcagtgaacgatagttctctgggtctctgttcttgccccttgtttgtcagctggcgtgagggccagaggataagtttttctccctcaagaaacgaaccaacattttccaagttgctaactgcttctccatattagatttttgttaattttctgaccagtgggtgaggtgggatatcagttttgcttgttatagataatgggctaagaccaggtgtgatggcacatgcctattgggaggccaaggcaagaagactgcatgaggcctagggaacatagtgaggctctgtctctaaaaaaaaaaaaaagaaaaaaaaattagctgggtatagtggcatgcacctgtagtccaaagtacttgggagactgaggtggaaggattgcttgagcccaggaggtgagggtcaaagctgctgcacatgagccatgtttgtgccactgcactccagcatgggcaacagagcaagcccctggctctaaaaaataaaaaaataataatgggctaaagctcaaagatgttaaacaacttgatgcagtcatacagccaggaagtagagcctggactagaacccacacctcctgaatttaaattctgtgtttttttccatcagctcataaatatgtaaactaaaggaaattgtggaaactaaccttttgcttatttctttcaagtcaacgttgg

SEQ ID NO: 52676 - DNA, 1170 bp, Homo sapiens
gttagaataaatgagcattcactttttttttttttttgagacagtctctctctgtcacccagcctggagtgcagtggcgtgatctcggttcactgcagcctccgcctcccgcctccaggcgatcttgtgcctcagcctccgaatagccgggatttagctgggattataagtgcgtgcaactatgcccggctaatttttgtatttttaaaagagatggggttttgccatgttggccaggctggtctcgaactcctgacctcaagattcacccgcctcagcctcccaaagtgctggacttaaataggcgcactcactattttgaggttactgggaaggactttcttacctctctccttccctccacaacaccctagagagggagcatgggggaagaggagtgagcattagagctctctggagtggaaagggttgtcaagggtggctgtcacttctgtgactcacctgccagccagctctaacccaatcccaaggtagaaatcttgtgctatagggtaggctattcaatctctggtcccatcaagagctctcagtctgggggtaggcttaatgctatgtccagagatgatttgccagtgaagctagatttgccagtgaagagaatggtactaacaaggtacctctgttctgtcctggcccacatcatgggcctagcttgtctctcttgaacctcttcctttatccctccagcccctatccttgaccttccttcaagcttcatccttcagttttactttaatggcctttttaattaggatatcggggctggcaaaggcaagtattatgctgttaactacccgctccgagacgggattgatgacgagtcctatgaggccattttcaagccggtaagtggctttatccaccccttgggctacaaacaggggattggttggcggtggaggggagcaaagcacccccaccatacctcaggaatctctccttactaaagctggtggggagatagaagtgtttgaaccctggattgctgtgtggtcagttaggggaacaaacacccatatttattggttccttctatgggtcaggtcttctgctggatacaaaaatatctaagacatgatctttgccctcacggactatggtggggaaggcaggcacatacccagtagtctatgattagtactgtttttg

SEQ ID NO: 52677 - DNA, 1338 bp, Homo sapiens
ccaagagacaccaagggaaagggaaccagaagagggaggaactcgggctccctaacctgttcctacaggcactggaactcgaaaacagatttctctacaggtggggagcttggagggagtgtgcagccaggaatggtggtggaagtgtgagctgcctattgaatggaaggcatagggctctaggtctgggtctcactcgagatgcgcttgtcagggtcgtcttcgtcctcatcgccactctcctcagggatggcgtcctcaggaatcgcctgcatttggaccccaggtgcgtgcggcagcattctaaggttctcaaacagtcgctgtctgtggccaatgggagagagtagcagggctctggtcagggacaaaccaaagtcaggaatgttcaaccaaggggtggctggaggatatactcacttgatcttctccaggtactcattcgtgttctggttagtcatattggaaggactgatgtggagcttgaaatctggtccaaagtattcaaagtagtcattgtatggaagctctgattggggcaggagagaagaccgtcaagagacctggccaccgcaccctaaccatttgcacgtaagcaccctaaagcatttgtaggtttctctgggcctatttatccaaacagaggagaatgcctccaagacactgtgagacacgggtacctatgggatttccatctttttaacatcactctcctatgtctgtaccagtggtgtatatgtcgctaggagaaggcccatgtccctggtttaggacacttgaggccatgctcattatgagcgctcccttcactcgctactccagttactctacagagtagaaattccaaagctgtaaattaccaatgagaactttgtccagaccaaaagcaggagggagaggggagagagctaaaaaggactagggaaaaagtgatggttatggtctgctgatcacaagaggacaggcaggagactcagtgactagtatcagaagaggagcggtcatatgaccaacggggaaggggttataaacttaaggacagatgagctccagctcccacccagcccagccgaacctggccctgcagctattaccattagggatctccgtatccagggccacagctgtctcatatgtccagcaccgggcaacgttacgaatggtgtaaccaccgcctcccagcatcagcataggcaggttaaagctcttgacaaattccacacacttggcgtgtcctttggtgggagaaggggtgctgagttacaggagcaccaagcaggaccccgcccacccatccttgtgctacctggtctcacctttgatagttagattgaagca

SEQ ID NO: 52678 - DNA, 1485 bp, Homo sapiens
ccgctcctcttctgatactagtcactgagtctcctgcctgtcctcttgtgatcagcagaccataaccatcactttttccctagtcctttttagctctctcccctctccctcctgcttttggtctggacaaagttctcattggtaatttacagctttggaatttctactctgtagagtaactggagtagcgagtgaagggagcgctcataatgagcatggcctcaagtgtcctaaaccagggacatgggccttctcctagcgacatatacaccactggtacagacataggagagtgatgttaaaaagatggaaatcccataggtacccgtgtctcacagtgtcttggaggcattctcctctgtttggataaataggcccagagaaacctacaaatgctttagggtgcttacgtgcaaatggttagggtgcggtggccaggtctcttgacggtcttctctcctgccccaatcagagcttccatacaatgactactttgaatactttggaccagatttcaagctccacatcagtccttccaatatgactaaccagaacacgaatgagtacctggagaagatcaagtgagtatatcctccagccaccccttggttgaacattcctgactttggtttgtccctgaccagagccctgctactctctcccattggccacagacagcgactgtttgagaaccttagaatgctgccgcacgcacctggggtccaaatgcaggcgattcctgaggacgccatccctgaggagagtggcgatgaggacgaagacgaccctgacaagcgcatctcgagtgagacccagacctagagccctatgccttccattcaataggcagctcacacttccaccaccattcctggctgcacactccctccaagctccccacctgtagagaaatctgttttcgagttccagtgcctgtaggaacaggttagggagcccgagttcctccctcttctggttccctttcccttggtgtctcttggaggacacgcagggaagcactgggcatagatgctgagctaaatcagcacccgcctgccctctcacccatgcttcccactccctcccagtctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaaggtgggtttgggttcagctgggacttgggtctcgagcctgagaggatgaatctatgtagggcagtgggaggagggagtgactcaggccctgccagctcctgtggggctcttcctcagttccttgagcctttcagtggctcccagaagtggcagagcccacaaaacaatgaacctctactgcctgagcacggctctcacataccaccccagcccttttcccagcactgcaccccagtttcccaggg

SEQ ID NO: 52679 - DNA, 1040 bp, Homo sapiens
ctccgctccgcgccagaatgccgcccgccgcccgccgagctgcctatatataagcgcccggagctcggggcggggccggacatttaaatgcgcgcccaatcgaggggcggaggcggggttggctcgcaggccccacttgcgcagcaggcgacgctggcggtcgggtaccccccaccccacccgaatcccaggggcaggtagagtccggtgtgggcaggagcgaggccagtcctcccgcgagctgggcggggcggggcggggggcctggaggaaggagacgggcagtcattccatcctctccgctccacctctccggtgggcgcccccgcagcctggagcggcccccaacgccttggtcctgcagccgctggcagtctcccgcttgaacccttcgaagggctcacacgaccaggctcgtcagatggctggtcctgaattatactctagaaatgtggtcatagaagctgcagggcccctgcgctgggctcggcacccgctccggcctggagagcggtcagaggtcccacccacgtccctgcctgcctgccatggccagccggggagcggagggctctgccttgcctcggggtcactctggtcggactagtgaggcctttccctcattcctcctttcagtcccttggtggccagtcattctgagtggggacagacagattcgccttgagcccctcctgccctcagcctggacccactgcaaagtcccacgtgggggactttgtgaccttgaagggcatctccatccccattgaaaggccaaggctcagaggcattgacaacctgtctgacttggctctggtccttcctctttacctccacacacaactctgctcccctacatcagggtgccccaggccggcagaggaaccccagctggggactcaacaaacctcaaaacaccccagtttctgaaggggagggataggatgctaccaagggtcccttcaagggacagccccttgaggacagccctcaaagctgcccagcccagcttcccaccctgcctgagagcaagggagccc

SEQ ID NO: 52680 - DNA, 1090 bp, Homo sapiens
tttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgaacctgggaagcagaggttgcagtgggccgggatcacaccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggc

SEQ ID NO: 52681 - DNA, 1023 bp, Homo sapiens
caggttacatttccctcttgcccctccctttctctctctacagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggtaggtctggaggtccaagcccagagggttgtgtgcggtcagggccacctcctgaggcagatttgtctccttgtcccttgttaggatactatgagcagattttttttcgtttctgataatgatgacagctgctatatattgactatttgctaacatatttcattctaagttgcacaacatctctgaaataagaatgcatcttcaattgttggcatcttaagagtcaacaaaacaagtttgatgccagatcccatgctaaatatgttatatggcacctaatttctcagtattattgtcctcattttacaaatgaaaaaaagtgaggcccaaaaatattaggtaacttgcccaagttcacatggccaggaggcccagattcagacccagggctgtctgactccaagcccatgcccttaactagcacactgtgccaatttctatctttttggacaatttaaccttaccctggcttgggaatcccagtgacattgatgttaagg

SEQ ID NO: 52682 - DNA, 1271 bp, Homo sapiens
aagtactgatttttcaagtatgtgttttagcactagcattagcgccaccacttagtgaacatgtgagtggaattgtgaaaatgtttgataagattttgagctataacgacagtgaattatcaccagaccgcttacacatagcccatgcttcctgcaatactgaggaagaaaggtggactttgtctttgccagctaagtttgccaccctgtgatcctagtgggaacgtaacttggtagagactggctatacaattaataaattcttgagtggttttaatttgagggaaattgtgttattttaaaatttgtccctaaattttgactttattaacatattggcactaacatttttcaaattttacttactacaaagcattttatacaaataattttgtagcctgcttatgctgtattttcttagttcttggggtagaatactgggtgaaaggccatttttctgggaaccccagttttggatgcctagcctagtgccccactctctgtgccacagtgctaattaacagatgccctgggggtatcccagccaacaagggagaagctggattgtggttgactgagtatcctggcagagaaagggtgctttctatgcccagtatctcagaatttctgttttcctcttctccttttcttacaggctcgcctctatagcctgcagtcggacccagcaacctactgtaatgaaccagatggtgagagggtagcactgagcgggtgggcttgtagggcaagtagactaagggggctgggttgtagaccctgtttgtctcaggtagcagaggccgggcaccccctatgtagggagaccagagtgagactagtgtgtaccttatactttgtggggtgggtggatgttctcttttctttcctgaacttgagctgtcctgcccaccctgcagggacttggcccctctcatccctcatcctcagctcagcctccctcccagccctgctgccccccttgccttctcttcagctcctgttagctaagcccctgccatgcagcaaaccccattatgggaactggagatcagaaatgagccaaaccctccacctagtccaaccctccaggaactggcagttaagagggggaaagcagaaacagtcaataaagtagaaatactagagagcagcatgactgcttctgcagagcagcggggcagcaggagccagaggaatggcacccttcctggcctgggaaccaagcaagtgatgctggagttgggttttgtttgtttgtttgtttgtttgtt

SEQ ID NO: 52683 - DNA, 1034 bp, Homo sapiens
agttttgaccggcctgactgaccttgaaattttgatgaaacagccaatcaaagatctctgatctacacaggcctaccatggccctgttctgcagccccacttgggggatggaggacccttgcctcctccctctcctgcagccccagagacgggtgaagggtcgtgagcgcttccctggtcccccaacacacggtacacctttgccccaatgttttacccccataccccagattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggtattcactgacagtctcccctgcagatgcctaacatctgtaacctgggctttaacttccatcctgtactcacaaaagcagcccatgttcaggccaaaaaataaatatgggtatattattaatagtaaatcagaaaataccagtaagcaaggacaggataattatttttaaactcacaattgcatcacccaaagagaacccctgatttcttattggtatataaccttacatttgtttttgtttataaacataggtaaagatagtttggttttttcttctgaacaaaaaagacattttatacatgcagttttgtaacctacttttaaaaaatcaacaaacatagcatctttcctaatcatctttttttttttttttaatgagacagggtctcactctgtcacccaagctctctctggggctcagtggcacaatcatggctcattgcagccccgactttccaggctcaagggtccttccacctcagtctcctgagtagctgggaccactggcgtgaaccaccacacccaactaatttaaaaaaattattttggtagaaacggggtctcactgtgttgcccaggctgg

SEQ ID NO: 52684 - DNA, 1230 bp, Homo sapiens
ttaaaagctggggtgggggtggaggtgggagttgtttatgcctttttggaaagaaaagacgtaatttccctttttttactttcttactcttatatgtacttgggcaagtgttttttgttttttgtttgtttgtttttgagaccaagtctggctctgttaccaggctggagtgcagtggctcagtctcagctctgcaacttccgcctcctgagttcaagtgattctcctgcctcggcctcctgagtagctgggattacaggcatgtgccaccacgcccagctaatttttctattttcaatagagacagggtttcaccatgttggccaggctggtctcaaactcctgacctcaggtgatccgcctgcctcggcctcccaaagtgctaggattacaggtgtgagccaccacgcctggcctcttgggcaagtttttaacctctctaggcctcagttcctcatctataaaatgggaatactaacaatacctacttgatgagattgtggtgatggttaaatgttaatatatgtaaaacactaagaacagtacctagcatacagtaagtgctatataagcattagctgttattaagtgctgaggctgatgggaaaacctcttagataccacccccagttcgtttttccttccattttttttcttggtcttttggtgctttcctatctgtatgtcccattctggctccatctggaccactcacttctcagcactccttagaacacattgccctgaagaccacagctatgagatggtgctatcatctgctttcctctgctccttacctcctcctgtcctgtcttcctgtgtgttgtcaagggcaatatgactgacacaaatacgtgtgcatacacgttgatagagaaaggcatatcattgctctacatacttaccagaaagaagaaattaaaaagagaaaggcaccaaatgctttttggttccatcacagattccccaacctcatctgggcccacatactcttcagtctccaatttgcttctcctccccttaacttcagaaactttcccaaaacctaactcttccctggggtcccctattcagccgctttatccctttcacttccaggagacaacctcatctactttttgaaacttcaggtgaacaaacaggatctttaactctctccccaccctcaaagccaccacctataaacttatctttactcagtcagctttacctactgcttgccaaatccag

SEQ ID NO: 52685 - DNA, 1704 bp, Homo sapiens
ccaggagttcaaggttgcagtgagctttttttgtttgtttgtttttggggtgtttgttttttgagatagagtcttgctctgtggcccaggctggagtgcagtggtgtgatcttggctcactgcaacctccacctcccaggttcaagcgatttgtctgcctcagcctcctgagtagctgggattacaggcacccgccaccacgcccagctaatttttgtatttttggtagagacagggtttcgccatgttgtccaggctggcctcgaactcctgacctcaggtgatctcccccgcattggcctcccaaagtgctgggattacaggagtgagccactgtgcccagccacagtgagctttgatcacaccactgcactgcagcctgggccacagagcaagatcctgtctcaaaacaaaataaaataattgtaatgtaggttttggtaaccacatgtgtcttttcctcttcagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccaggtacccaaaaagagcataagtcccctcatccaggttccaaactgctatattaatcagtctactgtcaaaacacccttagtttcaggtgctctaagcagttgaagcaagtgatttttttcaaaagttctatttttgtaatgaaatttatttagtaaggataggcgtggtggctcacgcctgtgattccagcagtttgggaggctgaggcgggcagatcacctgaggtcaggagttcgagaccagcctggccaacatggcaaaaccccgtctccactaaaagtacaaaaaaattagccgagcattgtgatgtgtgcctgtaatcccagctattcaggaggctgaggcaggagaatcacttgaacccgggaggcggaggttgcagggagctgagattacaccactgcactccatc

SEQ ID NO: 52686 - DNA, 1058 bp, Homo sapiens
ggtacctaaaatatcaaactgtcctgcttttgaaaaatcacttttatcactatttaaatctctacacagattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctggtgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgttaaaaaaaaaaaaaagtagaggc

SEQ ID NO: 52687 - DNA, 1017 bp, Homo sapiens
ccaatccagacgcgcggagtagctttccgcggggaccgaggcgcgcgctccgcccctccccccacgcctccccgagccgacttccagcgattgcgcgcgccggcgttgacgggactgcgcccggtcagggtcacgtgagagaggtttggtccgcacactcccgcggcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacatgtaagcacacaggcatcccctctccttacccgcggcttcctgctgctctttctactgtgccccatgggtacttcaggcatgatcccatttgtgccggctgttgtagtcgcgttcgtacttctcctggggatgctgaaggaaaaagccacctggtttaatagtcgcgaaacctggcctccctcatttacagtctcttgaacttcttccacatgtgcctaatcacatttatcttcgtaaattctaaagataaccatattttcaggcgtttgcagggttgttacccccatgtatttcccaacggtgagattaga

SEQ ID NO: 52688 - DNA, 1023 bp, Homo sapiens
ctgaaggcgtgaagagggaactccccgcggggcgtgctaacggctcgccagttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatggttaggctgtaggagtcatgcaggtggctttgcagaggattactcggtttccgtttgtttgctaacttaaatttgtttttaaaaattttagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccacaaagtaaggcaaaataacaaaatgattttgtaacttacctgacaagagaaaacatattggcgtttttttctcaatactgaattaaatagctgtagctgatgataatacctgtaataatagtggctgtaccaaataatagtacaaaacttgtcaactttcaaaaagtattatggccaggagcagtggctcacacttggaatccgagcactttgggaggcccaggcaggagacttacttgaggccaggagttggagaccagc

SEQ ID NO: 52689 - DNA, 1112 bp, Homo sapiens
agtagaaaatatggctcttggccaggcacggtggctcttgcctgtaatctctgcacgttgggaggctgaggtgggtggataatttgaggccaggcgttcgagaccagcctggccaacatggtgaaatcccgtctctactaaaaatacgaaaatcagccaggcatggtggcaggttcttgtagtcccagctactcgggaggctgaggcatgagaatcgcttgaatccgagagccagaggttgcagtgagccaagatcgcaccactccattctagcctgggcgaaagagtgagactctatttataaaaaaagaaagaaagaaaagacccttaatgactttttcccctctcttaaaacctggttgtattagtgactttgacatacatgtatattgttgacttcgccgtctcctgatgttactaatttgaacagtgactatatattgccgttacagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggaggtaggaatcttaaaggtgaaagaagtaaagatgtgtgggtcatatctgttatgtgcactttgataaagtaaactctgactttagaaacaatatttaaggttgagggaaagcctgagtttgcaatggtaggtatttatatttatattagagttttaggtatcagaagaaatacttaacacatccttggttctgtaccttcacaataaacttttctcagctggtgctggtggggaggatttctgcaattgaaagaagcaaaaatatatattattgctgtacattcttgattttttatttttttactcagtctcgctctattgcctaggttggagtgtagtggcacgatcttctctcactgcaacctccgcctcccgggttcaagcgattcttctgcctcatcctcctgagtagctgggattacaggcgcccgccaccacgcctagttaatttttgtatttttagtggagacagggtttcaccaagttggccaggctggtcttgaactcctgacctc

SEQ ID NO: 52690 - DNA, 1439 bp, Homo sapiens
ctggtgctgtttaagcattatctatttgatcataacggttcctatatcatttataaatgttaagagctttagacatcttgaccaaaattccattatgctcagtaggcccagagagccagtggactgggtagtcttgatgtgtctgtcactttgcagatccttctggagagtgcaacccagacttgcgtctccgtggacatcagaaggaaggctatgggctttcttggaacccaaatctcagtgggcacttacttagtgcttcagatgaccatgtgtgtatccttcccattttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctaagttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacataatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcacataaggatgaaatattccaggtaagagaaactaatgctactattttgtttgttttaagaaaaacctgctgggcgcggtcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaaagaaaaaagaaaaacctggatgtatgagtgggcacacatgtgctttatgccgttgctaaaaatagaaatctatatgcctatgctactttctgtgggaattgttttttctttgttatttctata

SEQ ID NO: 52691 - DNA, 2720 bp, Homo sapiens
attagccaggcgtagtggcatgtgcctgtaatcctagctactctggaggctgaggcaggagaattgcttgaacctgggaggcataggttgcagtgagccgagatggtgccactgcactccagcctgggagacagagcaaggctccatctcaaaaggaaagaaaaataataatgcctggttaaagaactcaagaatgttggctatcaagacaaatagtatccacactgcagttttgtgggaatgtcctaatcaggcgtctggggatcagctgcttatttttattggaacatgatcatgctaattaatatttcattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaccccatgctgatgggttttatttagtataaaacatccatcaaacaccagtctctggcttctagaagagtccttcagatgacagttgttgtccatggtctttgactatcaagagcagaattaaatgtaatagtcccagagctgtagaaaagaactttactccttcccagggaaagtgaaagacataaaacactgaatcagaggtggcacagattagtctttgataaggtaacgtttctttgaagtctatctgtagagaactacatggacttccaagagtgtcaaaggcagtgtggtagagagaatttaaggcaagatttaaatttggaaaaggtgcttgaaccttttctcagaggttttatttccccagtatgtttttcactggggcctttacttaggttagaaataataggctttgaaggcctctatcaccagatgcaataaccagataaaattcctgttttttcccaatcgcttagttttttgttgttgttgttttttaactgagtagatcattctgacccagaactactttcatgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatccttcactcagtgcatatgtgagggttgttgctggaagacaggaggctcatctttcctttccttggtgcattgagatcagtatcaacagcagatgaaatagaatccagcaaagagttgacatgttctgcctccggccaactctagaatctttttaagcaggtcagccagtatttgcaacttccacaggatgaattgcttgccaagtttctggcactcttgtctggttggaagagtacatccaaagggtacttagtgatcctttgctaagaagttttttgctgtttccgggttacagatttggccatatatttctaaacagcccctgtaa

SEQ ID NO: 52692 - DNA, 1049 bp, Homo sapiens
aggctggtcttgaactcctgactccaggtgatccaccctcctcagcctcccaaagtgctaggattacaggcgtgagccaccccgtccggcctgtttttaaggcattaattagtattgttaggaaagcagtaacaatgcaaacaccactcttctcttcacaaagatcaccttgagactgtgtctccattccacctgcctgagaagtgggagcatcagcctgttccaggctcttgggtagtagcatagccctttaaaaagagagagccattttccatgtgtttttggataagcacaatttgaaaatcatttcccaaatcctctttttgtttttgattctaaggtaaaattttccctaagccctcccaccatcccctcagccagtattagatgagatttgtatagcagcagaaactgacttataagtagagagctcttcagcaagactgagccttagctgttccatctctttgttcttctgttgctggagttgcaccccatttcttaactgcctctggcgttcttccatttcctccagctgttcctgcatgagatggccaagaacatttctaatgagccaaacaataaaaactcacattgtccactcttacttataaaacacttttttgttcattgtttaatcttgatagcagtattgaggctggtatttatatgataggttatgaaacaggttcaaagaagttgtgtcttggaaaaaaagtgacaatgcttttgaaaatgatgacgaaaaaggcatcttgtctgttaaccacagcttgctttaatagaatcctgggagggtgattgggactttttagtattacaaccttagtgtcattgaggaggattttggtctagttagtgggctgagtttcatatacctctccctccatgtgcaggtttgttaagataattggtagtttttaataatataaaatacttaagttgaaatacaaaagtgtggcaacaattattaaatattggctagaattctaggagagttacacaactagtggaagtccatgtttagaaaataaatggcttgtttaagg

SEQ ID NO: 52693 - DNA, 1047 bp, Homo sapiens
cagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcagg

SEQ ID NO: 52694 - DNA, 1252 bp, Homo sapiens
cacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacac

SEQ ID NO: 52695 - DNA, 1021 bp, Homo sapiens
tcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaagggtgtctggatgtgagctggaccatctcaggagagaacacaagtgtgaggcagctgctggcccctcacctagtctggggttcctttaccctgtaatggggggtggggggtagaagatggacaagacaccttaacagtccctttggcagtactaggcagaagaggcccatacttgggtccaatgtgtgcagcaggcaaaacattttcccttctaaatgtgggcccagaccactgccctgtcccccccacattaagaagcagtagccacagccaagtttcaatcatttaattaacatctttaaatgaaacacagttttcttcatgtgtctca

SEQ ID NO: 52696 - DNA, 1019 bp, Homo sapiens
agaaatgtctgaagtccctgacacagggcctcaaatgatctgtcggagatgtaatgcaaggtcctaagacccccatgctccttaggcaccttgaattcaaaaaggtctggaaagaaggagggagagaggggctcaaatgcaggaagtcccaacagagaggggcagctatggcttcagtaacaggacagtctggggacacagtccaggcagcccagccaagaaagggaacaattacagctttttacctgcaacttctcgaagactttcttcttgggcttgagctcctcatctggttggcccttttcatagcccttcacaaacacgtgctcaccaggagcagagcctgccggagggtccagaggttcaacctggcggtttatcccttctctgggaagacacaggacaagagaagagtgaggctatggatgggttccagtgactgtggaggccaaagcaatccgggcctttacacaggggccctgatgggatttagggcatcctcagtaccagagccccaggaggtcctcttatcttgctacatccctgcatatcaccagggttacattaacccaggctataccaaaattgtgtgtcaagataccaaaatctgtgtttctaggggaggaagtataaaataacgtagcgaggactttatagacatcaaaactgggatttgaatccctgctccactccttactagtagtaagacttgggtatgtactggtttgagccctccatttctattttaacaaaattaactgtaggtaaaatgcttcattaacagtacttgtacgataagtccttcatgcatcaacttttggcatcagcaaggaagaggcacgtgttctcagagcttccacctggtgtgtggaaggacatcatatgggctgattccctactcttcctggcctccccaggtcctgtgccccactccaagtcctcactcacatagaagcacacagaagcatgccttgggactcgactcctctcatcttctggggtttcaggttgcacagcac

SEQ ID NO: 52697 - DNA, 1143 bp, Homo sapiens
atcctagcactttgggaggcagaagcaggcagattgcctgaacccaggagttcaagaccagcctgggtaacatagcaagaccctgtctctacaaaaagaaaagagaaaaagcagcagccaaagcttagaggggttatgtgcctagtttggagtcgcacacagctagctgggaatctaatctgggtctgtcgaactccaaagcccttcctctttcttcttactcagctgtctccctcaggttatctttaggccttgggttacctatgtgaatgtttctctgcttgtaaataccagttggtctgtgaccctactctaagcataaatggagggactagaagaattagactaacaaatacattcagctcctaaacaccctcaagttagtatagatttcagaatcaaaagacttggattttggacacgttagtctttctgaatgtattttcccttctcctacctgcctcacaagattatcacaaggatcaaataagactgttgggaaaaactcccttgatcctacttttttggattcaggtgtcctgtgccctgttctagactttatctcactaggtcttgttcgattctgcaggttgtacatcctggagacctgaagaattctgttgaagtcgcactgaacaagttgctggatccaatccgggaaaagtttaatacccctgccctgaaaaaactggccagcgctgcctacccagatccctcaaagcagagtaaggccagctggagaggggccgacatcatcaggagagagagcttgtcaatgagccttggaaaaatgcctgtcttaaattgagggcacaacaacccagggggtctgaagtgcaggaatgtcatgtcctactggctcctagaatggaacttgagtcattttgatttgggtttggttaacatcaggaagtgatcacatccttttgtaccggcattgctgagagctgctggtgtaagatgtatactttggtccttctagtctgtttgttaaatctgcctcttcattaaagatagtgaccggggccagacacagtggctcacacctgtaatcttaacactttggaaggctgaggcaggcggatcacttgagcccaaaagttagagaccaaaacccagtctctacccaaaaaaaaaaaaaaa

SEQ ID NO: 52698 - DNA, 1029 bp, Homo sapiens
cattttcttttttttttttttttttagtatctcatgtaatttattgaatacagaaagtgaaaaacagaatggttgtatgggtacttgaagaagtatggtttctactgaatgagtactgcttttgtacatcctaaagggaccactcgtgtgtataagattacagacatttactgataagaaatgtttcctgagaagaggtgagacagagtccctgccaggtaaggaaagggccccgagggatagaaatccatctgtattaacaaaattcctaagtcagaaaagctaactgacaagaaactttaaccaaaactgcaattttgaaggaaaatggacactagtgagattaccaaaagtagagcaaaaatagcaggcagctcacttttacacagaacaagttgttctaaacaagttctaacagtcagcaaaaaataacaaaatacagatcttcatgaaaggattccttttcctttcatgttacctcagcagcaaagtccttttccaggtccacgtaagctgtgtaggttttgtttccaccccatttctcatctcgtaggatcacaaactctataaggaaaaggatccatgtcaacaaactcattgacagcattcctagctcacatgcatgactattcctagcccacatgcatgactatttgtagtttttgccatatattctgaactttattgtatggtattattcttaaattggatgagtggcactattgtatacccagctagcatctcagctgcttcaggggaaggcttgtggcttatatctattttgttgtattcctctagttcaacatgtctgcccccacccttacttctaacacctctgcccactccagtattccctcagaacctagcctggtaacgaatatatggacaattaaattacatcccaacatcattcatactttaatatataagaaatcagagcagagaatcagggcagccagtccctgaaggaagagtctgtgacaaatcacaagtatgatcacagcacgaacttttctattctagcctggc

SEQ ID NO: 52699 - DNA, 1007 bp, Homo sapiens
aaaaatctttatttatttatttttaccacatccacaggaaaatatctgcaagtacctaatgttaaaatctttgtaaaaagaatttttttagcgaggcacagtggctcacacctttaatcccagcactttttgggaggccaaggcaggagagttgcttgagcccagaagtttgagaccagcctgggccacatgatgaaaccctgtctctacaaaaaatagaattacctgggcatggtgacacattcctgtagtcccagctttccaggaggctgagatgggagaatctcttgagcccaggaggctgaggctgcagtgagccatgattgtgccactgcactccagcctgggtgacagagaagaaaaaacaaaatttaacttatattagttgagcatattctcattttcaaccacaagaggtcctcttccgttctatgacttctaggagtccaagattgatctccttgatcggaaggaggatgtgaagaaaaaactgaagaaggccttctgtgagccaggaaatgtggagaacaatggggttctgtccttcatcaagcatgtcctttttccccttaagtccggtaacactctctgttttcttcctagaggccaggctagaatagaaaagttcgtgctgtgatcatacttgtgatttgtcacagactcttccttcagggactggctgccctgattctctgctctgatttcttatatattaaagtatgaatgatgttgggatgtaatttaattgtccatatattcgttaccaggctaggttctgagggaatactggagtgggcagaggtgttagaagtaagggtgggggcagacatgttgaactagaggaatacaacaaaatagatataagccacaagccttcccctgaagcagctgagatgctagctgggtatacaatagtgccactcatccaatttaagaataataccatacaataaagttcagaatatatggcaaaaactacaaatagtcatgcatgtgggctaggaata

SEQ ID NO: 52700 - DNA, 1094 bp, Homo sapiens
agtggtgagaatgcagggtctgtctgtctttgttctgatggctgtcttgcataattgcctgtcaggaggtatggttggtgttatcttgacttcagactgatggtgatggactaatcgttccagactccctctgagcaggaggattctgcagtctgggctccatgcctagtttgtttcaagattagcttctgtgatttctttttttccaacttttattttagattcaaggggtgcatgtgcaggtttgttacatgtcacaggagtttggtgtacagacaattttgtcacccaggtaatcagcacaatacccaataggtagtttttgaatcctcaccctcctctctgaaatttcttaagcaagaacataattaaataagcatgcattgccagaagggagggaaagaagaagaaagttggtgattaaaatatatttttaaaaccgagatccctggttacactaaggttagggaagtaaattaatgtgctttagatttcctaggaaactgaggcctaggcccaggtttacagctgtcccctcttcctttcctcttcagagagtacacactagatgtgtacagactctcctccgtggtcacacagcacgattccaagaaggctggagctgaggtggtaaagcaggtggagcaccctttgctgagtggcctcttataccccggactgcaggtacttaagggggatggagtggcccgatgaccttttctgctctggtttgatgacaggcatatcttattgcactttgctttactgcactacgcagatattgtgttttttacaaattgaaggtgtgtggcaaccctgtgtacagcaagtccaccagcaccatttttccaacagcatgtgctcacttcgtgtctctgtgctacattttggtaattctcacagtatttcaagctttttcattattatcatatctgcatggtgatatgcgatctgttacctttgatgttaaatattgtaattgttttggggcaccacaaactgtgcccgtataagacaacgaacttaataagtattgtgtgtgttctgactactctaccatccagccatttcctcactctcctggcctcctcatt

SEQ ID NO: 52701 - DNA, 1026 bp, Homo sapiens
tcacatctgcactgagaacatggctggacctccttgatggctctgagcctggatctccactgacacatgctgttgttttccttgtcacatggtaaaggatgagcaaggtgaggcactgacattaaactaactcttctgcttccacaataggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaagaactaatgctataagcccttggggaatgacccaagggagacccaagagagacttaacaaggacagggtggggctggaggagacaggttggaggtaattggacaaattcacattttggtggccccttatctcttgtccaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaagtaagtgcttgatcatccaccctccttgtggctctggtgcttctagctaattacaggcctgtggagtccaggcattctttacatttagattagaagctgtctggcgtgacctattaagaaccatttaaaactttgtccattaaaacctcattgtccttgtaattcatccatcagaagtgtactgactagtaaatgccttaatactgtcctatttgctggaaatataaacgtaaccaaaacaaagtccttggccttgcagaactcacagcatatgggagagtgatggtgaacaattcagcctccctttctcttccagcctcagcaaataataataaaagaaatgtgaaagaaaaatatttcacttatttctcaccgccccaacaattgttattgctttttatctttgtga

SEQ ID NO: 52702 - DNA, 1069 bp, Homo sapiens
attttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaagtaagtatattttattcaaggtgaagagaaaaatgaaattatttttattcagatgtatagcagagtttccatatacctgctatctccacacatacacaacttcccctgctgtgggcatcctacaccacagtggtacatttgttataatctggcagagctttgtattcagacaaattggggtttgaatcctgactagcactgtgaccctgggctaattatttagcctctatgtttccccacatttcttatctaaattggagtaaataatacttcatagtataataaggattaatgaaataatgtatt

SEQ ID NO: 52703 - DNA, 1030 bp, Homo sapiens
ttctaatcaatcagcagtatatcacttctctctacaaaacgctatattcctgtttctaatgggctgtttttcttttttctggtttgctttattcaaggactaatgttccgacgttttcacagtcaaatctagaacagcagaagcagctttatctcaggagtgtcattgctcatatagaagacccagaggacactaaccaaggtaacatggtacccagagaaaggcatataaaacatgtgatgtgactttctctttccggtgtaacagcttaaactgggagattgtttagaattttcttaaattcttgagaaagataacttccttacttaaaagattttcacttaaaaggattgcctaaccagataattctcgaagtggtttggttaaccagttttagagagggatctaagcacgtttacaacagtacatgaaaggtgcctccctcatggttgagggctttaacccagaccggtacatttttgctagggatttttttgtctgaaaaataacggaagtggatgaccaggtgctgcttactaatcagtggtttttaaaatttgaaatgttttatttctcctgttaccttcagcatttaaaagcaggcatttcaaacaccattctgcattttggcttctgaataaaagctcttgaaaggtttggctaccttccagatccttcaagttgtgttctccccacttcattagaagatattgcaaaccaaagtgactagattctttctccagctctcaagagagtacagtccatgttatcattcagcctgaactattggctgatgggaaagctcctaaaggggagacttacgggaagaactgaaggtgaagaggttagagaggttttatactgataaaagaatcacttattaaaaagatcactccaggctaggcatggtggctcatgcctgtaatctcagcacttttggaggcagaggcaggcaggtcatttgaggccaggagtttaagaccagcctggccagcatggcaaaaccccatctctactaaaactataaaaa

SEQ ID NO: 52704 - DNA, 1044 bp, Homo sapiens
tgtatatccaaagcctaactatttctcatcatttgacctggattgttgcaagtctcctaaatggcctccctgcttctgcccttgccagtgcactgttcacaactcagcagccaaagaaagagattcttttaaagcataaatcacatttgctcaatatttcccagtggcttcccatctcacatcttcccattctcgtaatcccctacaaaggcctatatgctttggcctatgctcaccgacctcatctcctaatactcttcctcttgcttcagggcctttacagtcatattccctctgtagttgtcaaaatcatagcatttctcagaaggaaaggcagtgtagtgtaattgttaatagataaattctggagtcagatgtgaattcaaatccagttctgcttactctactctatgaccttgggtaaattattaacctgaggctcaatcaatttccttacctatacaaggacttaatgaaaatactagtaggattgtcacagtattaagtgaggagaggtatttaaagaattcagcaagtacttgcatatagggatagataaatgtcaggtactgttacagttattttcaaccctggcgactactcataattacctgtggagatatctaaaaatacagatgtttgtatcctgattccaggtattctaagtcattaagtctgggaggagggagaggccaagaatccatatctgtatttgttttttctttttctttttttaaattttagaatgcgtatcttcagaaagcttcctagattattaggagcactttcagagtcaaaaatgggatcagattatctcagagcgtcttgctcagaactgcagcccagcacataactaaatgagacttttaagaaattttactgtgagtctgtgctgttaatttttcagtctctaaactcacatgatgacttacctttctgggaatttattctaattttaactgctgtgtcctgagcaaccttgagctgtgtcagacaatgaggtccttttggaggtacaggtgtgatgcaaacaataaaatatag

SEQ ID NO: 52705 - DNA, 1700 bp, Homo sapiens
ttgtgtacaaatagccattctagttgaaatagccttcctgtttgtactctccctctctcgatagaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaatgcccattgccgacttgaatttttttgtatgaagtccctcctgattttgtgtgtgtgtgtctgtgtttaagcaagcgttcggttggtatagtttttttttgtttttttaatttaaattgaaggtagctgcctcctgaaagccagcattaagccagaacacccaggttcaagcaaaagacccacctctctgcagaggcaaagtctactttctggtacctcaaagaaatcattgttcaatcttccataaggaagagattctttaccaggctgtgagccagtgttagataacttgtgaatggatataagttacttttaacaacccctcttacttttttatttgaatcctctgaatacctgtcagtattttaaagttggcaatccaggacattataagtaggatggagcaggagaagaatcctattgaaaggacaaattaaaatagtaaatcctctcctctcccttctgtaggtactagctgccttgatttttttttgtgggtgggggggattttttcattccttattgaacttattttgcacaatagtgtttacaaatcttatacatcttactttgacagaagacttataataccttgtggtcttgagactggttgtctcctttgcctttcttcaaggattttcctttttctttttaccccccagtgaccactctgctctttaggattctagtggcagtattcttgtaacctgttagacgtggatatacctcttcaggatggcctccttgctgtctttattgaagagctgcccacccagagtcttgactctagggcaggctagtgctattgtggtgtcagttgatatttagtttcatttgctgaaccccaaatttgagtgttagttagggagcctccattctgtgggagagtgtggaaaggcactcttttttctccatattagttaacaagaggtgtctttaggccctggatgttaccatctcatttggtcaagcccctgatacctagtttcacatggatgctaacgtggatgtaatatagttgtgacagcctatgcacaaaagcattacctgatcttaaggtttggtattctaaccaaagttgacagactgtgcgtctgtcttaatggatgtcttaggagttggttattctctcttttttttttgagacggagtttcgctgttgttgcccaggctggagtgcaatggcgtatctccactcaccacaacctccgcctcctgggttcaagggattctcctgtcttagcctcctgagtagctgtgattacaggcatgcgccaccatgcctggctaatttcatattttttagtagagacaggatttctccatgttggtcaggctggtcttgaactcctgacctcaggtgatctgcccac

SEQ ID NO: 52706 - DNA, 1034 bp, Homo sapiens
tgttgaaatgaatgataagagcattggtccccaagccagagagccagaagccatcacccaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaaggcacatccttgtcttctggtaaatgcccaaatgttgccctctttttctggcaattggcagcaagtcaggatgtgtggaggagggagtcagtttctctccattttggcctgcagcttcttagggacatgcctgccagccaagctggagttggaagggaaatctcaaacagatgggggtgcacgtgtaggagaagaaaatagctgctccatcatcctattactgaggctcccccaaaccaagcttgggctgcctcactagataggtatgcaggctggtacttagtttttaaaacaaagggttttcccctctggatggggctgggtgcttttcctggccaaaggaatacaattcttgtttctccccagggtaaggaaggaagtgaaggggaacagcaaaagctgctttctgcagctcagtattcacagcgtgctgttctaggctgttaaaggaacaccattatgatcccaacagtaggctgaaagagtaatgatgacattagccaaggagcaaaaaccagtaaatggggtacctcgaacattcctgtccagagccaggaagaagcttggagagaaaatgtccggtgagcagggcttagagttgactgctgtaggttttgaaagcagagggaaagaaggtttagaggctgcacagcaaagtaggaaacttgagttgcacaccgact

SEQ ID NO: 52707 - DNA, 1370 bp, Homo sapiens
actgttttagaaacatcatgtcaggctggactatgaggaggcagatggagatgtgaggcccaggctaagcagcaggtgaggggtgggggagtctggagggcaatggttggcgccggtgagatcattatcccagagtggccctgatccccctgcccctgttcctccagccaaggagtcagggctgacttgagccttccctacaggtcatcacttcaggcatcgcagccatcgtgttgtcacgctacctccctagcacccccctggtacgtggtgcctcctgggatggggctgtgagggaagggtaggggcagcagccacccgccaagggcctggcctccttggagagggtaaggctgaccctcagggaggccagagctgcccatgggggccaagcacgacgcccattgaccagtggcctcccccgtccagcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatgtgagtacctaggcctggagtaggggcaccaggccctcgcacgggtgggaagggctcttggaatccaccctccacccccaactccagccagccatctctgccccatgccccgcagagctccagcctgtgcctctggggcatcgccctagtgctctgcgtggcggagaacgtgtttgctgtacgctgtgctcagctcacccaccagctgctggagctgaggccctggtgggggaaaagcagccaccacatggtaagttccctccacagccctgactccccgaatttcctgggagcccctgccagggtgcccaagctgctctgccccacccctatgtatgggcccccaccttgagaaatggggcagaagttttctccccaggagcaaagggagaggcctggaggctgggagaggtgagatctcccagcagagtcacacagctgacacctggctctcctagggcccaggatgagtcttgagggaggggcaggggtgtctgggctcgcactgagggcattgcaaaggtcaggcctggctcttgcagtggagtgggtagtgatgcccctttgcccccagagagccttccagccctcacctccttccatttcccggatgtcctggaggaggagacccaggctgagaaccagtgggtctggcagcctcctgtgtctctgcagatgcgggagaacccagagctggtggagggccgtgacctgctgagctgcaccagctctgagcctctgaccctctgaga

SEQ ID NO: 52708 - DNA, 1040 bp, Homo sapiens
gtcagatgtccaggagaggttgcattttttcgttgggtactaggtcttcagaagttcaatgcctcatgttagggctgtatgtaccatctcctgggatatatagtgtaacctgtgaattcatttgagcaagttcttggtacttgagtgtttggcatctcttgattcttcttgttagcgcttgatttttagagatttcttttctttcttccttttatgtattttttcttttttttttttttttttttgtctttcttggctattgcaacagtgtataattacatggaacttaaagagctagattgatgttcattgatgtcttcaagtctagggtttctgcttgccctttgcttgataggattcccatagcttctttctctttcattttgagaaactggtgtatctgggatggtgtgattgtggtactcccactagtaggtattctggcttcttctacttgtggcatggtagtaaaaagcttttacttttctattttgagtaagctagcatggggctctgacccttagttgaattttggaagctctttctgtatgtttaaagagattggctgagatacacgtgtgtgtgcatctgagcacacgtgtgcatgtatagttaaatcagcaaaaaggatctaattactcttctccatctcatttatttttatttttgtttttttagagacagggtcttgctctgtcaaccaggctggagtgcagtgacacaatcataactcactgcagccttgaactcctgggttcaagtgatcttcccatctcagcctcccgagtagctgggactacaggcacgtgcctccatgcccagctaattttttttattttagaaacagggtctgactttgttgccctggctggtctcaaactcctggactcaggcagtcctcacacctcgacctcccaaagcgctggggttataggcatgagccaccacgtccagcctccatctcatttgagtgttagattaaaatgttatttttgttaaaagtgagctctagttaactgttcacctatctttttgaaatt

SEQ ID NO: 52709 - DNA, 1099 bp, Homo sapiens
aatccaagtaactccaagtatgctggtagtagtagtgattataataacatctttatatctgcacagtacttgataattttcagagtattttacacaattatctcacttgctttttacaacaaacagctctctgacgagggaggatggagctgttatccccatttaaatgggaatttctttttttttttttgagacggagtctctgtcacccaggctggagtacgatgtcgcgatctcggttcactgcaacctccgcctcccaggttcaagtgattctcctgcctcagcctcctgagtagctgggactacagcaacgtgccaccacgcctggctaattttttttttttagtatagacggggtttggtgtttcaccgtgttagccaggaagatctcgatctcctcaccccatgatccgcccaccttggcctcccaaagtgctgggattacaggtgtgagccaccacatctggcctaaatgggaatttctttaagctttcatcttactatctattaagagcttcacagagctgagactagggcaagtcttctgacttttactttaatgtggtttctactcgtagtaagtaacgtagggcacaagtaacgtagaaaaccccaaaggtttttctagcttccttttttcttttctttttttttttttgagacggagtcttgctctgttgcccaggctggagtgcagtggcatggtcctggctcactgcaggctccggctcctgggttcgcgtcattctcctgcctcagcctcccgagtagctgggactacaggcacccgccaccacgcccggctaaattttttgtatttttagtagagatggggtttcaccgtgttagccaggatggtctccatctcctgacctcgtgatccgcccgcctcggcctcccaaagtgctggaagtacaggcgtgagccaccgcgcccggccggtttttctagctttctactagaagcttcctattaaaatcagcacatgacccaaacatattttttaaatcttcacgtttggttacatggaagcaacagtgtagtggaaagaatagtggccttggaatcagagttatagtttcatgtaactaccatg

SEQ ID NO: 52710 - DNA, 2205 bp, Homo sapiens
gtcattttattaggatagttcataacttgctctgaaaattaccaagtatatggtagatagcatacccagttgtttttaggttttgaatttgaaagtatcatgggaagggattgtgggctatgttaacagcaaatcacaatgatacatgttgaacctgaaaaataaatttcccaaactaaagtttttaaaaatgtaaagctaattccaggctgcaggctattctttctgtaggattcttcttttaaatctaccagcctatcgactggtagaaatttcatttttcttggaaacatctttctccctaaggaaatctccttgctagaatgtggttcaagtgctgtgtaagatgccagttgttgggataggcagctcaataagagacaggattcattttatgaaaattcctgaggtctagacatagccaaccttccagtaaagtgggttgtacaatttggagtgttcagtgaagagttcttgactgctgcctcatttcttatatatactcctaggaacaattaaatcaaactggatttaactaggggtattttttctacccattcttcccccactcatagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcaggtaagatgggaaatgcatccattcctttcgtagtctcattctcttactgatttagggaaaaggatgtcaaaaagacacatccgttctctcattacaggtttaaggaagctgtgaaaacttcttctgacatgctcctctaatcatgttttcaccagctactattctgtttctacctttctttgcttgccatattacaggtagtctggacttgctttttcccttttgctgtcttgcctccatacttgttcatgttctttcctttgcctagaatgctttctgcctaccttccagtatcctccttttatctcaacttgttcagttcttatcttttaagagccacttaaatgcctttcatccatgttgcctctcctttttccgcctcattctttgactttcttttatcttttgtcataaatatcgtcagtactttacacttcacgtacctatcttatcttactaaactgtaagtatcttgaggctagagttgtgacctttttacagttttttgcatttagtgagttcccaaggaattcattaagtgaattctttttttttttttttttaagacagagtttctctctgtcgcccaggctggagtgcagtggctcgatctcgactcactgcaacctccacctcccaggttcaagtgattgtcctgcctcagcctcctaagtagctgggattacaggcacctgccaccatgcccagctaatttttgtatttttagtggaggcggggtttcaccatgttagccagcctggtctcgaactcgaacctcaggtggtccgcctgcctcggcctcccaaagttctgggattacaagcgcgagccaccgcgcccagcctcattgagtgaatattaaaatgttgtggaggagttaatatttacaaacaaaatgtttgctaatatttacaaataaacaaaatgtgttaatatttacaaacaaacattcattgtgtaaatgaaacacaacaccttcattgccaatttgtcgaacatttgagtacttactgtgtgctagtcattggggacataggggtgagtaagacatgatccctattttcaaaattgtttatcccttctagtggagaagatagcacaaagagaatgggcaaaaatggttgggcacagaagggctgactgtaaaagtagccaaactcagaataccaaactgatagaaaggttatgatgaggtctttttatatcctctcccacgaacatggtttgcagtatctattaggtatggtaggacatatgccaagaaaactacacaaatcagagtgttcattagtgcagggtgcagtgtgtctggatgggatgtcaagtgcataaggctatgcagcatcccaagtattgtcagtcatggaagctagatcagttttggtgggttagggaagacagaattcagcagagaagaatggaaaaggaatttcaagtctggaagcctgtctttacaacaacaaccaaaaaagttaaagagcccag

SEQ ID NO: 52711 - DNA, 1814 bp, Homo sapiens
gacagagcgagactccatctcaaaaaaaaaaaaaaaagaatgaaaaggtagcatggtggctcatgcctgtaattccagcactttgggaggctgaggcaggctgattgattgagcccggaagtttgcgaccagcctgggcaatggggcgaaaccccatctctatgcaaattacaaaaattagccaagtgtggtggtgcgcacctgtagtcccagctactctagaggctgaggcaagaggattgcttgagcctggtatgcggaggttgcagtgagccactgcattccaccctgggtgacagtgagaccccatctcaaaaaaaaaaaagaaggaattaaaaaataaactttagtttttgccatagctctttatttcactaatgtcctcttccttcgtataaacaaatactaatctctctaaatatagcaaactatcaaaaggaaatagttttgtaccctgttatttatgaaacttattatgacaaactactcctaaagcagcttcagctatgattgaataaatgctggaaatccaggataaataagatactccacctccactttttaaagtaaataaatgatttgtgtttttggaatctcaagaaatttatagccaggcatggtggctcacgcctgtaatcccagcactttgggaggccgaggcgggtggatcacctgaggtcaggagtttgagaccagcctggccaacatggtgaaaccccatctctactaaaaatacaaaaaaaattagccaggcgtggtggcttgcacctgtaatcccagctactagggagtctgtggcaggagaattgcttgaacctgggaggtggaggttgtagtaagccgagattacaccactgcactccacaatccagcctgggtgacagagcaagactgtctcaaaaaaaaaaagtttactttctcacatgggatatattttacagttggtcaaatgtgcttgtgtgtgtatatgtgtgtatgtgtattcttttctctgtatcatatgtgatagtggggtagtgccaaacattgttaactctgatgaataatgtctcttttggttagatcattcttaccttactggtatctcttactgtttccttacctagttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccaggtataagttggcattatctcattgtctctttatttggtatttcatgatgtgagcccatagctgaaagaaattatcttattgtataacccaagtactccaaaggatcagagagcagaaaatatcatttgataatactttcaatattataataaagatagcacttccctctctgaccattataggttatccaactatataaaattgaaatgcaacaaaattgaattatgtagttcctactttcttagtaatatgtctcagattggagagcaattagttcattttgttttgctaggggctttttcaaaactttcattgtgaacagaaagacatttaattagtattaaacctgtgctgtttgccttcaagctgacttaagtgcctcactgcctttggaagtagagtacagattgaagaaaaggaaacagtattagtatagattaatgattaaccttaaaaggaggaatgtcacacattcagctccaaccttggcgagtcagaggaa

SEQ ID NO: 52712 - DNA, 1418 bp, Homo sapiens
tcacccaggctggagtgcagtggtgcaatctcggctcacagcaacctctgcctcctggattcaagtgattctcctgcctcagcctcccgagtagctgggagtagctgggactacaagtgcacgccaccatgcccagctaatttttttgtatttttagtagagaggggttttgtcaggttggccaggctggtctcgaactcctgacctcaggtgatccacccacctcagcctcccaaagtgctgggattacaggcatgagccaccatgcccggcctaatttttgtgtctttcgtagagatgggatttcaccatgttgccctggctggtcttgaactcttgggttcaagtgatcctcctgcctttgcctgacaaagttctggggttatgggcatgagccactgcacccagctgtgtctgtattcttcacagcatgtaattttctacacctttcttttagcttctgattagcaagcctgactgattggttaagctaaaagagcagagtaggagagatgcaccagcatgggacgtggaagagaaggaacaaagtggacagggcagattgggtttcaaggatgaggtattttcttttcttttttttttttttttgagacagggtttagctctgtctcccaggctggagtgcagtggcacgatcttggctcactgcagcctccacctcccgggctgtagccgtcctcccacctcagcctcctgagtagctgggactacaggcatgcactacaggcatgcaccaccacgcctagctaatttttgtattttttttttttgtagagatggggttttgccatgttgcccagactggtctcgaactcctgagctcaagcaatccacccaccttggcttcccaaagtgctgggattacaggtgtgatccaccatgcccaggcgaggttttttttttccaactattcgggaagaagattaccgtattcagaacttaggggtttaccactaaagtgggtttatatgaaattttaggattaggttatagtacctggcatataataagccaatagatacatggatacattgaaaagattgctttagagcagagtgatggcctaggagaagacctagaatgtcctagggaaggtcaaacaaccaaaacaagagagggtctctgtcattcatgcaacacaggtattttgagcatgaaccagtatactagactgagattaaaaagtggatgatatgtctccttaagtccagtgtggtttggaaggcaagcatataaacagttagttacattataatgtaagtgttataaaataattgtgcacacccacgaagtaggcaacgagctgcctagagaggttaagtatattttacagagaaaatgacacctgagttggttcttaaatgggtacttgtcagggcaagaagtaaggacaagac

SEQ ID NO: 52713 - DNA, 1021 bp, Homo sapiens
cacatttttgccaaaacatactcactcacatggccatactcagctgcaagggagcctgggaaacattctcttaactgggtacaatgtgcccagctaacaatgagtgctctgttattaataaggaatggtaagatgggccaggagctgtggctcgcacctgtaattacaacactttgggagacctaggctggtgaatctcttaagcccaggagtttgagaccagcttgagcaacatggcaaaaccccatctctacaaaaaatacaaaaattatctgggtgtgatggagtgtgcctgtagtccccgctacttgggagactgaggtgggaggaatgcttgagcctgggaggttgagactgcagtgagccgtgattatgccactgcactccagcctgggtgacacaaaaagacatcgtctcaaaaggtggaaaccagctgtgatattttaaaccaggtctccagaacttcaaacttttgacataaaacaagaaggggagccaacaaagaaaactgaaaagcgggggccagtgacataaaagaaaaactaagcaggcatgatgtcacagacaccaacatagtatgttcccagaagggagtggtcaattgtgacaaatgctgctgagaaatcaagaaagataagaacagagatgtgaccactggatttggcaacaccaaagagtcctaaaggagggggagagtttaatcctcaaataggaaggaggtttgatgctggatggctaaaacaacaattaatgtctatatttatctggcagaataggctagacttggctatggtaacaaacaagccaaatttctcaatggcataacacacaacaatggtatatcttttccactcatgcaacgctggctgtgggttaaggcactctccagagtagctctcctcaactctcctgggtaactcagagatccagactacttctctcttgggctccactatctcaatgcaaagctttcagtattgcctcaaaaagagagctggaggccaggcacggtggctcatgc

SEQ ID NO: 52714 - DNA, 2637 bp, Homo sapiens
gggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaacccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttcagcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaa

SEQ ID NO: 52715 - DNA, 1486 bp, Homo sapiens
tctggcactaatcaaagattgctagattaattataactgagttattctggaacttggcctctgagaatcaccttcagaagtcattttgtgcttggtcttctggtctttttttatcttagaatgttggttggggaaggagctggactttgctttaatcctcaagttaccttctgttaggctttgagattctgtagctgtatcaaatgatacctctgcctgcccatttctatctagttttcccttcatgtaattgaatctctgagtcaaaccagaaagctagatattttggactttgagttttgacagaagactctgtactaagaaaaaattgagatgtggcaatgagattgcttatctccaaccttcacttagttgcagagtgtgtactttgtccccaagttcacagttagcaccaagaaataaaagcattagctgccaagatgggcaggcttcactacaggctggagacttttctttctataacagcccaagagaaaaaccagtttctgaaaactgggagaagtccttattggggttttagagagactcagaagtatattggcttagggctggacatggtggctcactcctgtaatactaacactttgggaggctgagacaggcagatcacttgaggtcaccagttcgagaccagcctggccaacatggtgaaaccccgtctctattaaaaatacaaaaaattagctgggcatggtcgtgtgcgcctgtagtcccagctgtttgggaggctgaggcacttgaatcacctgaacctggaaggtggaggttgcagtgaggggagattgtgccactgtactccagcctgggcaacagaatgagactgtctcaaaaaaaaaaaaaaaaaaaaaaaagtgagggaagagtgttggcttggctcttcagttccttggttctgacccaatcttgccaattcagtgaacttctctgtttcctcatgtccaggatggcccagatgtgtaaccaagtacacacatcagtcacgttactgttagcctaatgacagctgtggaacagggaaagctgatgcctgtgttttggtcaaccccattctctcctggcactctctcaggtggtctgtcagccatttgtcctcacatttcctgtgccttgaggatcactgattgctgataagctgttatctgacagtttggactctggactctagtggcaggagggaccttcaggacctaagatacaaagctctcctggtgaagtaacaagtaatggaatctgtcttccctcacccagatttttgggatacaggagaatttcaagagacgagagtgtgtatttggcaaccacagagataaaattatgaaactggatcttccaaatggagccatttcacgtttgcttttatttttgcttctttgggtccaagaaaacttgctgtttagtaataaggttatatacacaaacttttggctgtggagttgggctaatgtcagtcacctaggtaatggat

SEQ ID NO: 52716 - DNA, 1031 bp, Homo sapiens
tgatccgcccacctcagcctcccaaagtgctggggttataggcgtgagccaccatgcccagcaagtcttcccatttataatggggaaactgaaacttatgtgtcactagtgtgttgagtggaaatagtgataattaatatttatgactccttcctgtgtgctagttgtactgttttaagtgctttacatatattatttcatgtaattcttaccataaccctataatcagtatatgttagaatgtaatataaggtacttttatccccattacaggtaaggaagtaggcatttgcccatgtttacatagccagtaagtggcagggccaggttcacacctaggcagtctgactccacagcctgtaatgtaattgaatcttggtttttgtcttcctctctgtaggcacccagattggctgaaaacttctgtgtctgccatttagctactggggacatgctgagggccatggtggcttctggctcagagctaggaaaaaagctgaaggcaactatggatgctgggaaactggtaggtttggtggtaccaatgagtgttgatattcctcagaatctagatctgcactgtccaatatggtagccaccagccacaggtggctatttagattaatttaattaatgtaaaaatcagttcctcagttgcactagccatatttcaagtatttaccagccaacgctgatacagaactttccatcatcaaacaaaattctgttgaacaaccatgtgctagagggtgttttaacaaactggcagattataggaaattttttttcttttttttttgacaaagtctcgctctgtcgcccaggctggagtgcagtggcgcagtcttggctcactgcaacctccacctcctgggttcaagcgattcttgtacctcagcctcccgagtagctaggattacaggcacctgccaccatgcctggctaatttttatgtttttagtagagatggggtttcaccatgttggccaggctggtctcaaactcctgacctcaggtgatccaccctcctt

SEQ ID NO: 52717 - DNA, 1440 bp, Homo sapiens
ttattgttggacatttggagtattgcctttattttatggtttttctcgggcttttgggctaagtgttgcaattaacaactttgttacacgaatctttactcatatccttgattttatccattgaattcgtggaagtggaattgctggaccaaagggtatttgaaacatattactaatttgtcttctaagagtgattttacccatttaaactcccacgcgcaatttaataggatttcaatgttgttgctggtgtcgtcaactgtcaaatgccgaagtataccttccggcctgacctcctgtcctccttcgcgttttcccgcccactccgcacacccgccacccttagtacatgctggcccgccccttccttatcccgcaccaattctgtccaatcaaaagcaaagttcctcagtatcgccgtgcagttggtaaggtgaagagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggtgagcggcaggactgggcttggcggcggagcctgctgaactccaaggtcaaggcggccggagatctagaagccctggacctgcccggagcgggccggggactaaggcctgcggggaacgctggccggggtctcggttctggtggggcatttcggagagggtccaaattggaggtcggggcagtctgagttaggattggagtgcccgagggattcagtgttgaagtgttgggttagggaatgtgagggctgattaattccactaagggtctagagactggaaaggtttgaggggtagagtgagccctgggccgaggcatctagattacaggctgaatggaggcaattagctttatggcccaggttacctgcgagttggaggtgaattgtccagaatcagggttacattccaggcactggaggtcgggagattttgataatgatttatgacttagggggaggggaggagaagcatctccaacacgtggggcagagtgagaggtgacatgtgctgtgtgagccagttgaattgagatgggaggaaacctaaggctctccctgtttgaaagttgggggtgaatgtgtagaactggtttatagcctggagacccatgagtcgcaacctttgagtagtgtccacaataagggttgggagtgctcatgggacctggcttggagttaggacctgaggctactgaaggctaagcagcttgggatgacgcaaatgattttagatgaaaaggaacttgaa

SEQ ID NO: 52718 - DNA, 2253 bp, Homo sapiens
aacaacagtactgtttggtcatctctgtcccttagcataacgtttggcaccaagtgggcatgagtaaaaaagtgttgcatgaaagggaaactgagtcccagggaagcaactctggaagggtcccttccacatttaagtaatgtggtctcacccacagcctcatacatgtttggcctttagcacatctacaatgaacagttgtccatagggataggttgcagtgtcagtgggactagcttaaggcttcattgagcacctgtgtttggaaggcagtgagctgtaggtcatagcttctgcctttagggagtttacccttttctagaatggacagatgcatatgcagttctgataccttggaagcatatgcaaatgcagtgggagcatttaaaagcagagttgccttattggtttggggaaggtggcatttgagtgaaactttaaggattttgccagacacaggagtggggagggtattctgcaggacatggtgggaacaaaggtttgaaggtgggaaaatgatccagcctacagctggagttttagccgcattgaggggagggattggggctagatcagagccttgaatgccaggctgaggagtttgccttctgccctgtaggcttggggaggcccagaaaacttagcagcagggtagctctgtggccagtactgaacctgggtcaggtacttggaaggatcacggatggcatgcacagggtgcgagctggatggggtctcacattcatccacttcttgtcattcaggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggtgagccctgcccgcacggtgcactgaccctccatgcccactgaacacacacatggccaggctagtccaggtgggctctggggagcaagaggtacctgtagttggtccttgccctctgggaagaccacccactcaggaggggtctcaagggatgagggagggagaaacgagcatggaatttgtcagccttgaagttccagattggaatcttctttgtccctggtagaaagctcatctttttaatggagatttgcaaatttgtttggcacagagctatacatgatgttcttctaattaaaacaaaagcgtctccatattgttggtttcttttctttttccttttataatcataataatgtgtggcggtgcattttcttaactagtccttgtagttttgttgttgccaccaattctgtctttctaatttgatttctgctgttgtcttcattccctcctgctctctttagatttatttttttcattttttgagatggtgtcttgctctgtcacccaggctggagtgcagtgttgccatcttggctcactgcaaccttcgcctcccgggttcaagtgattctcctgccctcagcctcccgagtagatgggattacaggtgcacaccaccgtacctggctaattttttggtattttcagtagagacaggatttcagcatgttggccaggttgatctcaaactcctgaactcaggtgatccacccgcctcagcctcctaaagtgctgggtttacagccgtgagccaccgcgcatagccactttagattaactttacttatctactgtcattcagtatctactgaactcctacagcgtgtagtcactgtgctaggcagggctagcaatacagaattgatagactgctgtccttgagttgaatgcttagtttatttatttctattctgtccttgctagataaaagcatttaagctataaagtttcaactaagtagagctgaaagtatctcatttattgattcagcaaatattaattgggcatctcttctgaggccaagcattattctaggtggggatttggcagtgaacaaaataaaacaacaaaagcccttccttcatggagcttgtttacaaaaaaaaaaaaaaagatgaaataaagaaaatatttagtattttagatggaaaatgctgtagagagaaagcaggaaagggaagtaaggaatgttgggagagaggattgtacttttagatagtttggccagggaatggttcactgagatttgaatacagacccaaaagagccaagggatcaagccaggtagataaccagggaaagggcattt

SEQ ID NO: 52719 - DNA, 1768 bp, Homo sapiens
ggcagggaacaaaaacacaggtccacatccactcagattcggggtaggccacatctgcccctgggaagcaagctgtggtggcagcaagcccagctctggagcttgacctttgtgtcccattctgctactggttggctgtgtcaccacagacaggtggacctcactgaactcaattttgtcctccataaaatgtagccagtaaatatttcatagcatagtcattgggattaaatgaaataatgcttataaatatctagtgctgaaaagttgctaaattaaaattagactcttattacaaaatcaggatggctaaaaatgactcttatgcctctcaccatgtttcaaaactggctctctcttctcttgtttattcgtggagagtcagacttgagttcgaaagttcgttctgccacctattttctgcgtagcccttctgagcatcagtttccttctctgtagattggagctaatacccatctgaatgggttattggcaaggactgaataaaagggtgaatccaaagtaggggttggcaaactacggatggaaggccaaatccagtccaccacctaattttatgaagttttattgactcacagccacattcattcaattatgctttggctgtggctgttctggtgctacaaaggcagttgagaagttgtgacagagactgtgtggctcgcaaaacctaaaatatttattctggttctttatagaaaaagtatgctaacacccgatgtaaaccatctaattcagggcctgcttgtggtaggtgctgaatgaacacagttgctgtcgtcatcatcatcatcatcatttgttcatatcattaatgcagcaatcaggtgcccacaggttctagagtaaaggggatgaagaggaggccccaagaggagcagggctgagcccgcacaccctgcacacccagtgcagggccgtgcacagagtaggcctttggagtggggtgatctctgtccaaaagatccttggtctggtggactttctaatacaccagcagtgcttttgttatttattaagctgacaaataaaaattgtatatatttatggtgtacaacatgatgttttgatatatgtatacgttgtggaatggttaacaagctaattaggcattaactcacatacttacctttttttgtggtgagaacccctaaggtctattctttagcaatttccaagtgtaccatatattgttattaactatagtcaccatgatgtacattagatctcttgaacttaattctcctgactaaaactttgtatcctttgaccaacttcttcccactgccccctcgccattgacccgagcccttggcaaccaccattctatgctgcttctctgagtttgacatttttagattccacatataagtgagatcatgcatgtttgtctttctgtgcctggcttatttcacttaacatgatgtccttcaggctcatccatgttgctgcaaatgacaggatttcctgcatttttaaggttgaataatattccattgtgtatgtggaccacattttctttatctgttcatctgtgatggacacttaggtggcttgcgtatcttggcgattgtggataatgctgcactgaacatgggagtgcagatatctcttttacatattgacttcctttcctttggatgtatacccagtattggattgctggatcatatggtagttggtagttctattttttgagatggagtctggctctgtcacccaggctagagtgcagtgatgtgatctc

SEQ ID NO: 52720 - DNA, 1026 bp, Homo sapiens
ggctgtggggaggctgggctgagggaaggctgggcttcagagtgaaggggggggtggggtgagggggtggagctggggcaggtcaccctgtcctggacccagccacagttgcaggaggttggggcaggtactcctggactgaacccaggatgctagggtctagctagaacaaaggcagaaataactggttaaagccctaggcagagtgagacccatgtgttatggaggccaaagtcacaggcttgagagagtcgagggagtggtcaggaaggctccacggaggaagtggcatttgaagcaggccttgaggaatgaatagaatttggagggggcataaatagtgaactgcgtaagcaaatgcattgaggttggaaacagcatgggacattcaagcgtaagcagaaacttagtgtggctgacgcatgctatgtgtagggggtgaaggagatcctggtcgggggcggggagccgatgcaaatggactttcgaaggggtcagggctggacgttttgctctggctgtgccttttacatgattactggacacccttggacttcccaggaggggccttggggtgaagggggtggccaggtgatgggccactccagtccatccaaagcagcttccatcgtattaatgggttctccttaaggctttgtttaaaaatggttcctctcatacacgacaagtttgaaagctctaactggtgtggagactgatttggagggactggagctgccccaggagagttggtgaggtctggaccagggcgcaggggctgcaggaatgggtcagggacatttagagaatggattggacaggacttgaaggttgattggctgtgtagggagagggaggggtcagggagcctgtggggttgggtggctctgagccatgtagctcacagcccttgattgagagatgtggctggggtggggcgacagggtttgtccagcagaggggcactgcgtgtctcatcaggatggttctgtgcattgctaccgatgactcccactccctgagctg

SEQ ID NO: 52721 - DNA, 1032 bp, Homo sapiens
attttttcccagttatttgtttttgtttcttatttcaatctttttctaaagagaagaaaaaagcctgaaatgtggagaatggtaaggggcttcaggcttgtgcaggcgaatctaagcaggggtctcctggacccctggctgcatgggcactgcctcctccaagctccctgctgagcgacccactggcagtggctcctcatgcctcctggctgccttggaagtcagatgttcctgttggcctatcacagacccatccttccctggggcatcacctgaggaacatcctcttcccaatgcctccctacaacccacctgtgcctcctgaagcccctcctgcgcgcacactcactctctctcattctctccttcaaggagttaacagatctgagcttccatcttctcatactcaggactggccccttcttcccctttcccctccacagtccatcctccactcagcagccagatgccgtacctcctgggattccgtttcaccaagaatgaaatttaaagtccttggccagctggctctctgactcccacacttccctctcacgcactgggtcctggccacactggcctcccctctgttcttcaaacactccactgctgggcatgcatttactgtcccctctctagaatgatcttcctgggttatctgtgggcctcactcacttcattcaggttctgtgcaaatgttttctttaggtgaagccttctggatcaccctttagaaaatagcatgtcctagtctctctcttttctcttaactagttttctttttcttcatagtacctaccaccactcaacatactctataacataactccataatgtgttccataacacaagggcaactgtcagcccttctagaatgtgagctctaggctcttggaataaacctgatttattttttcactgctgtgtccttattacctagaacggagtaggtgttcaaaaagtatatgctggatgggcaaatgaataaacatgtctgaatctgtctgaataaacatgctcttaacctgtctg

SEQ ID NO: 52722 - DNA, 1074 bp, Homo sapiens
gcttttggaggaaggagcttctcatatttacacagcgaaaaactcctcagacaagcgcgcttcccatacgactcaccaggacaaagggacgatccatgagggtatttgctcagcctgaggaatccctgaggcaagtctcacagaactgtgcccattccacagatggagaaagcgaaacccagagagggacatgcagcgtacagggacttgccagagtagggttaccatatttagcaaataaaatgcaggatgcccagttgaagttgaatttcaggtaaacgacgagtaatgctttagtataagactatcccaaatattgcaatgagacacgtatgctaaaaaattactcattgtttttctgaattcaaatttatctggatgtcctgtattttatttggcgatcctaccccaaggtcacctaactgagtggaaaaacagaaagcgctattgggggggtcctacgtgcctccctgcctggggctcactagtgtatggagctggcttgttcccaggtgctattctgaggttattttaaaggcccccagctcatgccagtcaatggtcttcctagtgcaggatctagacctattcaggagctgacaaggagccacatcccccactcccattcaggggtaccgcaccaccaccacccaaactagtttattcaaaagacactaagtgtctactctgtggtaagcacagtcttaggttccagatcacactagaaagtaggagaaacactccctgtctttatggaatcaataggattagatacgcaggaagacaagtatttagagaggaaaactacagtacattgtgatcagtagttctttaatagggacaaatacaggatgcatgaaagcccggagatggaacccctaatgaaggaatagaaagtaagagaaaggagagagacacccaagctgaggcctgaaagattcattccttcattcagtaatttcttgaacatctacatgaaggacagtattctaggcactgtggacccagcagtgaacaaaataaacaaatctttgccctcagaacttaattctaagtgaaatgtataatatgtta

SEQ ID NO: 52723 - DNA, 1472 bp, Homo sapiens
cttgctttagtgtgtcctctgggcttggcaatttggtggcagagaaatctgcctcccatctagagaggatgtgctgctgggtgagattcaaggcaccctccaccccacctgcctctccctccatatggggaaggcaaggcttattagctatttatgcagcagaaataaggctgaacccaccctcacatccccttctctcccagcagctgatggagctggggcccttctgcagaattacagactcagagccatgcagatgatctggtgccacatccacttgacagatggggaaacaggagagggagagggaggaagggaacttgcctaaggcctcgaagccagaggaagctgggcctatactcagctggagtctcccaacaccctacctagcagttggcgtgcagcttttacatttattataaatccttgaggcatcagagcagagaaattaagagccctgctttgtacccaggtaatctcaatcctggctctaccatttactgtgtgactttgggaagattatttaccatctctgagccttgggtccttcatggacagcatggaagtaattatattaggattaaacaagatgatgtttataaaaacttagtactgcacttggcacctaacagcactcaataaatgacagctatagtaggttacatcgtactcggcattattgacatttggggctagataactgttgtgcagggccatcttgtgtgttataggaagtctggtagcattcctggcctctacccattagatgccagtagcaaactccacccaccccgcaagttgtgacaatcaaaaccatctccaagcattgacaaatgtctcctagagtcaaaatcacctctagttgagaaacctgacctagaaaagtcccactgaactttaaaacttcaggtcaaatatcacctcctctgtgaagccttccctgacctactaagcacaattgctttgtactccagattacatcacaggggtcagatcctgacatgctgtgtgtccttggtcacgtcactttgcttctctaaggctccttctctaaggttcatctataacaagaggatatgatgttcctgggaaggatgttgtaagggttagggatcctttatcagaagtgcctagtactgtgcctggcatagtaggcaccccaaaactatttttaaatgtctttattctgattataaaattaacataagaagcagagctgtataatgtaaaagttaaagtccccccataataataccccatgaaacatggcaggagttactatacagttctaaggatttttatgtaacctgtgggtgtgcatgtgcgtgtgtgtgcatgcgtacatgcatgtgtgtgtgcatgtgtgtgcatttgtgcatgcatgtgtgtgtgtgcatgtgtgtgtgtgtgcgtgtgtgtgtgcatgtgtatgtgtgttggtgtcttcctccccacctccactgctgagtacc

SEQ ID NO: 52724 - DNA, 1100 bp, Homo sapiens
ctggtggcagggcctttgcacattcccccaccaggacagcttttccctgagtgtttacatggctggcaccttcttgtttcacaggtttctacttgaatgttacctcctcagagggtctgcttggaccacttgctctaaaatagcttcctactctcactctctcacatcagctgctttttcttttctcttgtggctgtcaccagtatctgaaaccctctcattattcgcatttcttgcctgtctacaccattagaacatgctgaagcgccatgcgtgtgagtgagcaggtggttctggtgtggtgtggctggggcttttgtagaggtgaggaaatgctagggagtccaggtgtggcagcgcattgcctgggagataaagttacactgagggctgtcttctccttcctcccaccccgggagactcagggctgttgtcaggaaataatgagatgattaaatcatggaatctaagaatcccagtctcttccagtctcagagctttagcatctgagaagctttccagctcagaacctttgacacttggaatcttaccatgataggatgatccagtcttaggtttagaatcttacaaagtggactctcactgccttatttagcatcacagagggctcgctttgtgccatgccatgttctaaaagcctttataaatattaacatatttacaggtgaggaagctgaggcacagaggtatttaggtatcatggagcagttgctgggatttgaacctagcactctgggactccttagaatccctcaactgttgaggggaagcccaacctcacttgacccttgcacagagcaggaatccttttcccacacctttgtcaaaagggcctctgatctctgccaaaaaacccccctccagtgaactccctcctaaccaggccacctagcttcctgctgtcagaaagttctcattgctagtaagattttcttgacaatgtgtaaagtgctgcacctcccttgtgaataacgcctgggaagtggtgttagtgtcatggtttcccagtgcctttgaccttgtggattcctggtttcagtggcctctttcttcccactgggttgtgggaagaaaggcag

SEQ ID NO: 52725 - DNA, 1005 bp, Homo sapiens
ggagacaccgttatctctccaataaagtctgtatctgatgacatttatgtatgcaattcttggagaatcatgtgagatctaaaatcatgcactattcggagcgaggtggatgtcatctagccaaacttcattctacccgttggggaaactgaagtgggaagggagaggagcaggccttatccaaggccacgtgcatctctgtctgctacccagaggccaacaggctgctgctgcagtatctgccttggggatcaaaggcaggggaaagtgctcaatgggacagttacttcttctctagtgcagaagctacccctgtacaatgggggcaacatttttggatgcacagggtgtgcctggcacttggggggagattgaggaagccagctgcattgggagttggttggggctatggtgatggggatggctttctagaacctggggctggaactgggctttggaggctgggtggaatttgggggaggtggctgaatagtgtctttagtggataaggtgtgtagggaaggccaagggatttggctctggggcctaaggggtcctgccttgttccctgcctcatgcatgtggccacaagggtactcttggtggggtctccaccatctggggtccttttctgaactttgggcaaaggctttaggattctttttttttttttttttttttttttgagatggaatcttgctctgtcccccaggctggagtgcagtagcgcgatctcccctcactgtaagctccgcctcctgggttcacaccattctctcctgcctcagcctcccgagtagctgggactacaggtgcccaccaccacgcccagctaatttttttgtatttttagtagagatggggtttcaccgtgttagccaggatggtctcgatctcctgaccttgtgatccatccgccttggcctcccaaagtgctgggattacaggcgtgagccaccgcacctggccggctttaggattcttgaggggacagtctaggcagcc

SEQ ID NO: 52726 - DNA, 1031 bp, Homo sapiens
ccacagccctttcagttccccccacctgattattaagtaagtaattaatccaaacttttatcaggtactgtgcagggcttaaaagataaatgattcagccatgatccctccccatcagagtgcttgtctggcagcagagatggatgagcaaacagacagaacatggggtgagaggggttctgatgatggaaaggcagggtacaaagggagcagagaggagagcacacagtgtagctcaggcatggaggcagagcagtccccgattgcttccaggaagaggtggcctgtaagctggggcctgagggatgcattggaattcactagtgaaatggggagggcagagagcaccagggagaggatgcagcctgtggaaggtgagaagggaagcagaaccctgggggaactgtgagatgttcagtctggctgggcagtgcaaagtagaacagccagagagattggcaggggccgcacatgtaaggcttaagcaatccagaaattgtctggagggaagtagggagctatggagggtcctaggaagggcagggttatgatcttttattttattaaaatcacagtgactgcagtaatggagtggaggatgagggtggagtgggggaacctgtgagcaggctcttacaacagctgaggccagagctgaagggggcctggatcagggcaggggaggtggtgcagaccctcttctctccccaccctgtaggatcctaatcagcttcatggtacagattgaatgccacctcttccggatagcccttcctgacacccaccctccaagttgtgctttgaggctgaggctgtgcagggcctggcatgcaacagtcaactgcctgcccaccagcagctgaccctgacctccccctgccccatgcctctggaccctccatctgttccccgcactgggctaccaactactttctttcattttttaagaataaatttattgttttcattaagcagctgaacagcattacagagaatttggaaatcagagaaacaaagacaaagaccaagat

SEQ ID NO: 52727 - DNA, 1493 bp, Homo sapiens
cggtgagctgagatcgcaccactgcactccagcctgggtgacagagcaagaccctgtctcaaaaaacaaaaaaacaaaaaacaacaaaaaaagaagaatacaaaacccaatcattgtaagcatccctccttttgtaaaacaagggagcaaatctttggtgttgcccagcagccgtctggaaatgccaagagcaattgtatttgcatttgcaccttgacaattttatctttctgagtggggacctggatctgagaaaggcgacagcacaaagttgacagaacaggcaagctaataaacacaagagcaagtgataataatgatgaagaattctgttttttttttccaagaagtagactttgtttaaaaatattatttgagaacatgaccaaaaaaaaagcaacaaaaaattaacaggcctttgaaggagaggagaatattttgccagaatgttctttgactcagggattattctccattcctgagggcacaattttttttttccctctctctctctcttttggactaatttgagttcataatggcaggaaaccaaacaaacaacaaaagaggattctatcaacatttggaagacagtttataagtcactagacgcttgcacatataattaaactgatatgtcctaactcagtggcaaagaggcgagtgtcccacatgcccagaactcccaggattctttagacaaacaaacaaacaaagccaaagctgaagaaacaaccagattccagattccttgtcctctgctatttgacggaggccctttcctacttatttgtcccttggcagagaaccaggcatcagatcatataatcaaatccatcttcccaatgttacagccactaatgaagggcataaaagaaggtcatgtccaaaacagagccagccccggtcaagcaatagaggtagagttagcaagagggcaagcaagatccaccctgggagttgagaaggttgtgcttgggagcatggtcggagtgaggcggttgagtggcgttggagcatcttaattggcctgcagcgtgaaaggaaggcacaagcaaagtgagggacttgcaaagtgttgaacaagtccaggcttcagaaggatcagccctctacataataaacaccacatggatttatagagaaaatagaacattttctgttcttgttagtctgttcatggtagaaaaccagcattgtctcgtgcagttagtgtatgtgtaagggtcgtctgtacctgcagatatcacagtgtgggagtcagggcttgagaccaggagtctgagactggcctgggcaacatgttgagacccatctctacagaaaattaaaaagttagccgagtgtggtagcatgtgttgtagctccagctactcaggagactgaggtgggaggattccttgaacccaggaggtagaggctgcagtgagctgagatcacgccactgcactgcagcctgggtgacagagatcctatctaaacaaacaaacaac

SEQ ID NO: 52728 - DNA, 1098 bp, Homo sapiens
ggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgaggg

SEQ ID NO: 52729 - DNA, 1052 bp, Homo sapiens
ccccagtaggtcccttcatttagacccatgggtgcttacaaggttccctgcccccttccgtggccttgcctcaacatcaccccaccttccagtttgcctccatccttggcttctggggccacggaaatggggtctcccctgggctgctcaggtaacctcctgccttacgtggagggctgggtgagaaggcagcctccaccctttgttttgccacctttttgcctccctgaacacgcgagcacagagttcttgaaggtctctaccaggaacatgggtattcagtcattaaatattttttagcaccagctgtatgccagaaactctgttaggcactaggctctaaggacacagtctcgccttaaaggaactccacagcatggtgtgatgttttataaccttatgtataattttgccttattttttttttgtcttaaacctccttaagaatggtccaaagctgtgtacgtacagaagaaatgttacatgctatttcaagtggctctgtgatcacctcctagaactcagagccctgctttaaaactcatgtttagaaaaagataattgcagtattgtgtggtagacactacaatactaagagggactaactctgcctagggtaggagacaggacagcatggaagatgctgttagatctgggaactcagatgtgtagtagtaggccaagtagaaaaaggagaaatacctcctttgttcatcactgctgctagagatggtttgttcccccatcctgaagaaaactctctgctcccagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggtaa

SEQ ID NO: 52730 - DNA, 2207 bp, Homo sapiens
cattttctcgtaagctagcacgcactgcctttcactggctcattagtcctcacagcagcactctaaggtaggcgtaggatccttatttcacagccagtgaagctgaggcttagagagggacaatgacttgcccgcagttgactcaatgatagagaccagtctctaagccaggtctaagcccgtgtctctgcctgttagacaaatctgattggccttgttctctgtgagtttaaggaacagaacgaggataactgggcagaaattaatagaaagacagattttgggctcgttatataaggaatcactaatgagccgtccaaggtgggaacaaactgcttccagagtagtgagtttctttgtcgctggaggtattcaaacaaatgccagaaaatcattgggtgggcatattatagaaaattttcaagcattggcaagagatcgaaccagactttccaatcctataattgtataatctgcagttcattagactcatcagggaatattttttaccaggctctaattgggaggaaatagccatcatctaaaaaacaaaattttagctttcatagtaatctatgttagtaattcattttaaataaaatagatgtttcttagcatatgcaaaacataaaagcagagaaaatgtaattgtgtaaaggcagagttaaatatttaaaatttaaaagcacagaaacttaatttgattgaatcatcaactcagtcctcctagttattcatagattgtgagggaaaggggttttttctacgttctcaaacatggatgtgagggccatctggctgcaacacctgtcaccccattgatcggcagagttgattccgctgatctggctggctacgcaggtgtccccttcctccttcactgctccatgtgcgtccctcctgaaccagcagctgggtcaaagaggacgaccatcccgtagaggagggccgtccctcagtcaagggcatacgagtagctgccctcccctgctagaacctccagacaagctctcaagttctcagacacctttgcaattggaaagactaattctaaaagaaaggaaatgtttccatctctacagaaaagccaaagctgtttaaaaattttttttcaagtgaatataggcacttaatggaaactttctaacttactggtataactgtgtctcaaacaaacaaaaaaaacttcattggtcctttctcttagatggcccctgctcagctcagaagtttattatgtagctgaattatggaggactgagtactaaagacatgagtcatagtcaactcttgttcattaaaggtttatcctggtttagttagcattagaaccaccagtaagaacatgagcttgaggctgggcgcggtggctcatgcctgtaatcccagcactttgcgaggctgaggcaggtggaccacctgagatcaggagttcgagaccagcctggccaacatggtgaaacccagtccctactaaaaatacaaaaattagccgggtatggtggtacgtgcctgtaatcccagctactcaggaggccaaggcaggagaatcgcttgaacctgagaggcagaggttgcagtgagcataggtcgcaccactgcgttccagcctgggtgacagagtgagactccatctaaaaaaaaaaacaacaacaacaacaacaacaaaaacatgagcttgagtggaccaagacccattatgaactagtcataaaccatcttttctttccccccctccccccccaagatagagtcttgctctgtcgcccaggctggaggggggtggcgagatctcagctcactgcagcctccaccccctgggttcaagcagttctcctgcctcagcctcctgagtagctgggattacaggcacgcaccaccatgcctggataatttttgtattcttagtagagacagggtttcaccatgttggccaggctggtcttcaactcttgacctggtgatccacccgcctcggtcttccaaagtgctgagattacaggtgtgagccgccatgcctggccctaaaccaccttttctcaaacgtgtctgttttgacttttccatactatataattaagcacaaagaattcctattctgtggtggtattatggatctttaacatgaaatatgagcatcttcatataaagttttatgcaaagattacttaacaagtgtgctgaaatcacttttaaagtatatatca

SEQ ID NO: 52731 - DNA, 1038 bp, Homo sapiens
cttccttttatctcccctgatcttagtgtctactgtagaacctctcccattggttctagacattttgcgttttgaaatcatagcatgggccggagcactatgatgtgagactatctgggagcccttgaccctggcattggataccagtggactggcctccatcaccagggttaagtagaactctttgaaaactcctccctgactccctgcagccagggccagctattattccctggtgtgttgacctggtggaagtcactctggtcctgcaggtgctgctgctgagtttgagctcaggcccctcttgcagtcctcagcctgtgggctgggaagcgttcaagcagctgtttggaaatcccccactgctcccgttgtcctgaactgcatggggtggggggagggtggctgttcgctccattgattccttcctgcatagctgggggtggcagcttggagcacattcagctgtttacaattcagcttatgtacactttagctggggattgtgggtgagtcagaagggccgttctctttgcctgtgtcctgagagacagcatgaaagtcagctgtatggtaatggctgccagcatgggaggagccccctccctgccagatgccttaacgggagctggtcaacacagatgcttaaaatccagtaagctctccaaacctttcaacccagacccagcaagagcattttgcagtgacgctgagggcaaggctggagggtcccctggcttggcctctccttcatcctgctggccagccccctgcaaggaactcaggtgtggatctcagtcatccgcagccagtgaccctcctgtgcctgaaaagctcaccagttttctcagcaaagagccccacagggtccttctgtcactgctgtgccttcccttctctgggagaggtccttcagaggaggtgcttcagagaggttcctcagggagccacagcctgctgtgtcaaggcaaggagtccttgtccctttgacagctctgcccttagcagatttgaaaaggctgcagacattggatgttc

SEQ ID NO: 52732 - DNA, 1055 bp, Homo sapiens
aaggagtaatgtttccatgagcagaaatgatcaatagaactgatttgcaaggtatgtagtatgtagtccataatatagacaggacaactgaggcttagtgttccctcctcccagtctcccctgacatttatctaacaatattagtgatgctgcagttgataaccaaaaaaatagtcatcatattggggaacatggctgcctttccctgttatcaacctgaaaataattggagagtttactaaacatttctagatttcttttgtaaaccggtagaaatccatcttccatgagtttatcttaaactgggtttatttttagccttttaaactaatttcttttcataagctaaatcatctggcattacaagttacataaatttagtattttctaagtaaagcagtgcttccttttatttgtcttaaagttaacctttcttttggtttctagggttcttctgcactgtctgcttaaaacccccctttatgaaaaaactgcatagaaagagaatctggtgcttgtcttcttgtcctttagattaatagccattgaaggtgacttgagactttgctttgccctttaggacagaagcatttctgttatgttgcagtcacagtggaggtaacatttcttcctgaagcctgacctcaacagtgcaaggacaggactaccgacgtagaccaagacgtctgaggaacacaaacctcagatacctcagtttgggccacggaaagattagccctgctctggggctgtaagaggccagactcagtgaaagagtgagattagaatgatttcctaatcttctcacaggtctcagtgacgttggcactcctgtgtccaagctcagcctagtccagtgtgttgtgcctgcattacattatttaatcctcaccacagctatatgtaagacagatataagtatcccatttcatagatgaggaaagaggcctagagtaacttgtccagcattacaggataggatttaagcctagagtctttttttttttttttttttttttgagacagagtcttgctctgttgccaggatggagtgc

SEQ ID NO: 52733 - DNA, 1065 bp, Homo sapiens
aagacaaaaaaattgaacctctcaccccagacctgtgttcttaatcactacaatgtttttttgaggttcctggataatacaggcagaaaagagagaccacagctgagaagtgtttactcccagtgactttgctattacagtttggatatactagaaaagtgacctcatcctgctttgaacttaggcccagataagggaacaagggagaacccacaacagacagtaagagggcctgaaaacccaagttaaagaagatgccatcagataccctggactcttccctctcccacttatttctacctcgtgcttagtgaatccatgtttcctgcccctacccttgtccctagccccagcacctggccctggcccatcatgcatgagaaccttagctctgatttatagccacggcattcagatatacccactcctgccactcatcacaattctaggcaaaagggggtctggggtcctgttctggcgagtggaatcacccaaggttgcatgcagaaccatcctgggctcctcctgtctcccttcattgacatcttctcatgaggaagggtcacaggatctcaactacatgggctggactgctggggaggtcactttcaggagtctaatagaaaggcctaggcaaagggaatacagacagataattctgagagagcaggagagaaaaagaatagagttaaaataaaacagggtatcggagaggggtgttcacgtcagaggagtggaatctgggggcaacatgtggaagagttgggatggggatgtctggggagacaccagagcccacggaggatctgctataacaacaggctgtttttacagaaccccaaatctgagccagaggctgttttgtcctagagctgtcagccctagaagtcacaccaacctggggaaagcctgacctgaccctgggccccgttctggcaaggcttgctcgccgggacagggcccagggtcaggagctgcctgtggccagggattcagcagaggtaagggtagaaaatagggggaagcctggtgaaggccagtgcagggcatcaactgggaagagat

SEQ ID NO: 52734 - DNA, 1050 bp, Homo sapiens
gcccagcattctgttttaacaaaccctccaggtgattttgttgtgtgctcaagtctgagaaccactgtggacctgaaaatttgcatttttaataagacctcactctttgaaaatctctgctctaagaatagaaaagaggggacaatgtgtgatgagaaagatctcattccacctagaaagccccctccccatttccgaagtcccaatcgaacctgtctttaaagatccacccaaatgaaactttagctgatgcaagtgaaagttatcccttgacagcttcctgcatttcaggggtgcataaaccaagggccaaatccaggtcacaacttgtttatgtaagtccctcaaactaagaatagtatttacatttttttaatggttggagggggtgaggaaccgaagaagaatgtgcagcagagaccatatgtggtgtacaaggcctaacctagatactctgtccctttacagagaaaaaaaaaaaaaaaatgctgactcctgttatatttatgtgcttttcttatttttcctcttaaactgttaacttcttaaaaatagagtcaatatccgagtcatgtttgtattgcattcagtaccaaacatatagtaattgttcaataaatatgggaaggggcggatggtggtggttgggcagctgacaagtgttgtgggaatccaaaagagatggacttttatacttgaccactttgtggctgtcctatccataaaataagaacagtgtttttctccaccttaagtagatgatgaacatccagaagttcgtactaatggaatttactctagtaactagatggtgaaaagcagttgggagctgccctgcatcttgaaaaacaagattagtattgaaaatgtccataaatggataagttaaaaataagcaaaaagcttaaaatttcaggtggatttctgatgtccagtaaaaagttttcacagaattatatgctaccatggttaaaagagcccctagtgatgatgctgcacgaattccacctgccccatggttgcccagcctctgcttgaacccctccaccg

SEQ ID NO: 52735 - DNA, 1126 bp, Homo sapiens
atattgagatttcttgattagtgatttaagtatattttagtgaaatataaaccagtacaaggagaatatcatatttatactagctttcagattatttatttctcccataattcacagaaaaataattttaattcttttgagaacttcctttttaaagaaatgaatatattgggtaatgaagctggctggctaaataagacatataattatcgaaatgtaattcattccatatttagaaattattttgcactagtaatcataataaatggaagtctccaggtgaagaaagacttggttcttcattgggtgataaacaaaacaaggacccccatagttagtgccttgatttatcatgcttgctatttaactgtgaccataatatgatgtttgttctctttatataaaggaaggtttttgttgtttgttactgagtatttccagtcctgtttaattataatggctactatttttgtaaagaaggtattttaaaatcaatgcttaaatgtagtaaaaatgattcattcccccaatgccagttccagtcctacaaatggaaatagcactgaggaggacatcagctgatttaatcttccattaaggttttatttgcatagcccttgatccctaaaggcttagtctgcccattgcctcaacaaaccctttgtacaaataaaattgaatcaagcagatgagtgagtaagtgtgtctggatagcagccctggaatatcgctacccttctcatttgcaaagctacatttcccagtcctttctgcatacacacaggctgtggggtcaaacccgattaggtgctctcatcaactcttttacaggattggccttttcagcttcgagaagcagcatgacctgttccattcagcggctgttcttagcccattctttagctctgtctgttacgttcccatggagtgaggctctggcttctcctgcacatgctccctgagagagtcattcacaaagacaatctgctctccaaggaaaagcagcaaagccagctgaggaaagagatgatggatcatgccaaccagaggggaagagtaaggcatattaaaaatgacatcagtgcagtaatcccacagggattaatacaaattgaactggtatgtt

SEQ ID NO: 52736 - DNA, 1048 bp, Homo sapiens
aaggctaaggcagaccagagtgtgatttactgcagatccatggttgtacagagctgtaaccagttactgaatcttggctataaaccctttaactgccctactgtctatttaaattctttgtcagtgggcttcagtgtttaaatgtttgctttgataaacatcccaatattcaaacaaggaataaaacattcagaaccattgagataaagatcaaaacaatagtgagaacatctgacaaatgctaactttttaaactgtagaagcctccactaactacagactgtctgaccccagaattaggattttgctccctgtccttgctggccacactgaaaataagtgaggctaattacaataatctatcctggggcaggttatttggggcaataaatcaacctcaactgttaacctttcttgtgtgtgtgtgtgtgtgtgtgtgtgtgtgtgtgtgtgtgtgacagagagagagaatacatatgtaaacatgatgcatgggcacttatttatttagtatcttatatatgccaggcattttaatcttcataacagccctgccaactcagtttttagatatacatttaagggatttaatgaacaagctgagatctagagatactaaatgatgagttcaagtttttccattataccatgctgtttctcacaatgccatgctgtattaccctcagtagcaccataactcagttgtcagtagaccacaaacacaacattgggtcatccatcttgcagtcatgtactctgggccacaggaggcattcgaagacagagtttgatggataattacagcttttttcattaggaaaataatttgaagttcatggtttacatacagtggatcaaaacaacaataaagcagtgaatacactttgttattatctatataggccagttttactgaaaaagactgatacatccccaataccataccacctgctgctcaaagacaagccttttagtttgaggttgtagtcactattggcaaagtctgactgtgtttgcaactgtcttttaaacttacaatcttcataaa

SEQ ID NO: 52737 - DNA, 1038 bp, Homo sapiens
ttctgttttccagaagagtttatatagtattggcattgtttcttttttttgaatatttaatggaattcaccaataaagccatctgtgcctggagttatctttgtgaatagattttaagccaagaattcagctactttaatagctatagggctattcaggttatctatatcttcttgagtgagctctgatagtttgtgtctttcaaagaatttgtccatttcacctaagttgtttaagttattggtataaagtagttcataatattgtttcattatccttttcatgtctataagatttctttcattcctatcactggtgatttgtgtcctctttctctctctctcactctctttctctctcttgctcttgctcctttttctgatcaatctggctagaggtttatcaattgtattgatcttttcaaagagccagcttttcatttcatcaattttctctctagtttttctgtgttctatttcattgttttccactctttattatttccttccttttgtttgctttgcattttatttactcttctttctctaacaaaatagaagctgaggttaatgatttgagatctttcttcttctctaacactagtgttttaatgctgtaaaatttcctttaagtactactttagctatatcctacagattttgatacgtaatgtttttgttttcactaggtttaaaatattttctaattttccttaggatttcttctttgacccatgagttattttgaagtgcattgtttggttttcaaatattagagattttcctaatggctttctgttattgctttcgagtataattctgttatgcttagagaatatgctttatatgatttcagttctcttaaatttattgagacttattttatggcccagaatgtatattctgttgtcattaggtggaatgttctatatatctaaattaggtttgtagtgttgttcaagtcttttatatatgtattaatttttacatctacttgtgtcatcaattactaagagaggagtattgaagtctccaacta

SEQ ID NO: 52738 - DNA, 1039 bp, Homo sapiens
ccaagagaacttctttaacttaaaaaaatttcaactcttactttgctcaattcccttaagcaaattaagtcacccccaaccctcagctcccataacttctcctattaccacatttgatcataattatctgtgaagtgtgtgtctcttccattagactgtgaacatctccaggacaggaacagtgtctcaatcacctctgtttccccattgcccagtctagagcagtaaacacttgatgtaaagcagtaaatacttgatgtatgtatgtgtgaatgaagaccatgcagggtaagctttgctataccagccttgaagacttctattgccagtggatttccagggcaggagctttagtcttcctctgcctggcaaggctatctgctggaagctgaagctgattcattgccaatgggagtttaagccaggggtgacaaatacatggaatgtgtgctgccagtgccccttcctgtgtccctggcagtcatggctaattggttggttctcagcacatattcacactgtactcagagccctcagcacactactctaggcagccacttccagttgattgaagtttctgctttaaatgaaacctatttgctctccctggcttaagcccttatgtgtgaggtcaggtcagactgctttaagccatagcttggactgtcagccaaatgggcctgacagcctttaagagttcccagttttttctctttggaggtcacagaccagtcttggcctttcctgtggaactggagagcatcttctcttcccttttcactgagtgggctcctcatgaccacgttcatacttactgccctaggagtcaagatgcccctcagcttccctgtgtttgtaaagacatcttgattttgatggcagtcagcacttatccctcatgacctgggaggctctgtactctttctaggtctttctggatattggaagagagctttgagatcacttagctgaatctaagtggcaaagcgacagcccatgctgaatgaagtccaccatcatgctttatttaatctcatag

SEQ ID NO: 52739 - DNA, 1028 bp, Homo sapiens
taaactttcctacctgctcctgagtggtcacaaatttcaaaacaaatggacaagtagcagaggagcttgtttttttcaggtgcaaatgtagcttgtgatcttacattgcaagatatataacttagttgcattctctgcaagtaaaatttttcaagtcttaataatgggatgaaatatagttataatattcctcaaagtgaacctgaaaaaggttggtgcctacaggactaaatggcccctaaggtaatttcctaaaagggatctttcagctctgctattttgtgattgttacttgtttcttctgtcatcaccatcttgttgaatccccctctctgtcagatgccccctctccatcaggtgcacagggatttttaaaaaacaggctttattttttagagcaattttaggctcaaactcacagcaaaattgagcagaaggtacagagagttcccatccctccccgacaagcctccctaactatcaacatccctgcaccagagcaatatgtttattaccattgatgaacctacagtgatacatcattatcatcactcaaagtagcagtttatgttagggctcttaatgttattcattctgtaatgtatgacattaagagccctattataaactgtatctaccatcatagtgacatagtaacatgtatctaccattgtagtgacatacagagtagcttcactgctgtaaaaaccctctgtgttctacctgtttattcttccttccccccaacccctggcaacaccgatctttatactgtctccatagttttgccttttaaaaaatgttacatagttggaatcatacagtatatagccctttcagattggcttcttttacttagtagtatacatttaagtttcctccacgtcttttcatggcttgttagctcatttctctttaatgcttaacaatattccgttgtgtggatgtaccacagtttatttatctactcacctactgaaggacatcttggttccatcaaagttttggcagttatgtatgaagctgct

SEQ ID NO: 52740 - DNA, 1027 bp, Homo sapiens
tgagaggaaggatcctgaggtgagggagagggagggaattccagggaaaggcactgttgtgtggaatagcatggattcagggtggggttgtatgatgggaggttgggaacagggagctgatattagaggagtgctggagcaaggtcactgaggacctcacatgtgaatggagtgtcaacaccaggcccggggcaatgttcagatgtgcatggttgaaatctgacagctgaatggaacttggacatgctgcaattaggatggccttttgggacactgttgtggtatttcagctaaaggctagggtctgaactagagcagtggtgacactgaggaggagggaatgaatgggaaaggtctcagaggcagaggggaggacatcagaggaaagctagaatgcctttggtgactgggtagagcatgtcctcattcagaattgggagcacaaggaggagaggctgatagagcaggagggcagaagatgagaagtttagtttggtatgtctagaacttgaggtgcttaagggaaatcatggtgatgctatgcatttggatgtcggctagcagctaggggagaggctaggactagagatctgtgtatgcgaagtagttaaactaatgagaaaggaagaatttcagtttcaaatattgggcctaggacagagctacttgatagtgctgaatggagaggaagatggccctcaaaggagatctagaccattccccactcccacccactaccatcatgttctggaccctgtcttctttgttactgacccctgaattcttcatgtagccctgagttttctggagccctcactgtggaagtcaagctgagctctgtgtggatgtgaggtggtagtcctctctccacttggtcaccctttcccctgggtttggtagtgtgttagtgtctcatatctttagtgaacagttttgatgtttattatctgccattcttgtctcatgaatcttaatagaggttcagtcatgaaagcaaggccagtgtgggccaggtgagaaaatggcc

SEQ ID NO: 52741 - DNA, 1313 bp, Homo sapiens
ttgtcagtctctacattctctcctgatggaagagttttttgagttgaatatgctgtgaaggctgtggaaaatagtacagccactggactcagatgtaaagatggtggtggctttggggtagaaaagggagtcttcctaaactttatgaagaaggctccaacaaaagactttttaatattgattggcatgttggaatggtggtagcaggtttgttgacagatgccccttctttggcagatataacaagagaagacgcttccaactttagatctagctttggctataccattccacaaaaacatcttgcagacacagttgccatgcatatacactctgcagtgctgttagaccttttggctgcagttttacagtagggtcttacagcgtgaacaacagggcacaattctgcaagatgtttcgtatggttattggggctgtacccttggcaaagccaggcacgctgcaaagatagaaaatagaaaagcttcaggtgaaagaaatgacctgccatgttattgttaagaagttgcaaaaatatttacatagtatatgatgaagttaagaataaaccttttaaattagaactcagcagggttggtgaattaactaaaggaagaagacatgaaattattccaaaagatataagggaagaagaagagaaacatgccaaggaatctttgaaggaagaagatgaatcagatgatgacaatatataacatttactccagcatctattctattttaaatttctgctacagtcccaggttaacatttagccccctgtggattatacacactcactaaccaattttcattaaatgtttgtattgtgaaaaaggagaaagaaaagttctggagattgcacaattacgtgaatatacttaatgtacttgatgccacttaacaatggttaagatgatcaattttatgttatatatattttaccacaatacaattttttttaatttatagtggaggccacatcagctcagaccaagaacctggggacaaagaagttgctcccctcagggctggagtttggcttggactgaggagctcaggatctgaggaccgcggtctaagggcaggtgggcttaggcagtagaaactccatagcagagaaaagccaaatcaaggagggtcatccaggcaagacagtcatgagaggagtggtgaggaagaagaggaaagaactggcaagagctagtaggagcctatcctttcttaaatgtactatgcatttgttagcagtcatcattttaggtggaaaattcatccagactaccttcagttttctgactcccactaccctt

SEQ ID NO: 52742 - DNA, 1069 bp, Homo sapiens
aacctgggactgtagcagaaatttaaaatagaatagatgctggagtaaatgttatatattgtcatcatctgattcatcttcttccttcaaagattccttggcatgtttctcttcttcttcccttatatcttttggaataatttcatgtcttcttcctttagttaattcaccaaccctgctgagttctaatttaaaaggtttattcttaacttcatcatatactatgtaaatatttttgcaacttcttaacaataacatggcaggtcatttctttcacctgaagcttttctattttctatctttgcagcgtgcctggctttgccaagggtacagccccaataaccatacgaaacatcttgcagaattgtgccctgttgttcacgctgtaagaccctactgtaaaactgcagccaaaaggtctaacagcactgcagagtgtatatgcatggcaactgtgtctgcaagatgtttttgtggaatggtatagccaaagctagatctaaagttggaagcgtcttctcttgttatatctgccaaagaaggggcatctgtcaacaaacctgctaccaccattccaacatgccaatcaatattaaaaagtcttttgttggagccttcttcataaagtttaggaagactcccttttctaccccaaagccaccaccatctttacatctgagtccagtggctgtactattttccacagccttcacagcatattcaactcaaaaaactcttccatcaggagagaatgtagagactgacaagtcatacctggtgtcaattgagctctttgttttaaaaccagtagaacgcgtagggcttccaggcctccagaaacttttcatcttataaaactgaaactttatactaattaaacagtaactccccatcctttcctccccctagtccctggcaaccaccattctactttctgtatgaatttgatgactcaaggtagcttttataaatagaatcacatagtatctggttgttttttttttttttttttttttttgtgactggcttatttcacttagcataacatcctcaaggttcatccatgttg

SEQ ID NO: 52743 - DNA, 1032 bp, Homo sapiens
atatttacagcacttgatgttttctgaaaaccatatttatacattttattacatttacaaaaaaggcttccactaccgtttacctacaataatgaaaaaaaaatttacacctttttttttttcttttttggtactgtacaaactttgtataataaaaatatatctctgtacaaaagattttttttgtctttgttttacttttttttttttcctcatgggatggtgatgggtatatggcgtagatggtgggtgaagggcctcatctgccctgttcccttccaagcctctggaggtggagagaaatgtcaggggtgcggagggtgatgcccagcagagtgctgggtgccccaccagcaggtgctcctcgagcatctcatggaactttacaaggagacgcaggggaggggtggggggcgggaataggcatccgctgggtggtctgagaggggcataagaagggggaagggagcagtcgaaggagaggagtgtaagggggaagggagcataagaaattgggaggggagcttcctgcacttgtttccagccaaggaaagagatgagagtgtgagtgtgtctggattggccctctccctccaggcccaggggggtgccgtgtcccagaggtggtgtggccaggggtaggctcctgcctctgtcagcctccattgtgtctgctggaaatggacgcctctcactttcctctggccactcttaacatcagtcagatcttctaattgttccaatctagaatttgcttaagaaccaggtgtcgctgtccctccgctcctgcacatttctatttgctatttcaatatgtgacatgaatctctgaggccagcatgtcacacgtatacaggggcttaagcttgtgggggccttcccgaggacagagaaagtggccctaaatgctatactttgattcctaaactcatgaacttcccaacaattctcatggaattcatgaacgacccaagcatgatatagctgtcaaaatcaatcaaacccactcgcaaggagctggagaggtgtgac

SEQ ID NO: 52744 - DNA, 1066 bp, Homo sapiens
gaagctgaagcatctccttctgaaaggctgcctctcctccttcctcaccctcccctgcagactgggaaggctcagaagaacacaagtagaaactgtggccccagtaggcaccctgctaactgaggggctggggctctgagaggggacaggatgtctgctgtggagccagaacaaaaactgtgattttctaaggcctttgcagcgtgcctggccatcttgcagtaggtgaagggtgctgtgtggaagacagtggtctcagtccatgcagctcatgagggcagagctgggacaactccgggggaggagcagtgtgggtgggaaagggtgggagcagaccgtggctcagtccagagaagctttcaggagcttggagccagaggacatggagtggactgccttggcaggcaagggccccggcgatgggaggtgtcagtgcctggggtacagagaggctgtcacgcacctgcggctgcctcctgtttccccctcccctgcttctgagaaaccagacccctccccccaccagagtctgaggctgggcacccagaggctctgggccaggacaaggctccaaggtgtggatgtttgacatggatgacaggaagcacgctaggtaaagaggccagggaaggaccagggagggaagtggccttaatgctcagttttcttatctgtaaaatgggcacaaaaccagtcttctagggctgggctagggcagaaacgacatcacagtcaaggcaccctgagagctctaagacactccacagtgtcgttgtttgttgaggcaggggtgacacccagggctggctggagggtgtggctgggggctgtatctaagagccaatgtccctggagttgggggctctcctctccaggtctgaacaggaaactttgtcaaaggttgagtgggttatgcacatgtgtttgcttttggagagatattccatggcttttgtcagaatctcaagaggcatccctgatcccaaagaggccaaagcacccccgcctcagactgttcaacttccccagtcctctacctgaccacggcacacacggtttctctccc

SEQ ID NO: 52745 - DNA, 1028 bp, Homo sapiens
aactaggtagcaaaatgagcttgaacaaaaacatggtcccatgctgactgctctcactttaaattaatgatccccccaccttaagtgagcgctcagtgctgcctggccattacacacttcccaattccattccacttgtatcttgctaaatgattatctccttcctcttccagatcttctcactcaaacttactctcatctgttaagcctgcttcctgcctaggagagtactatgcaagctgtattttagaaagagagagacagagagatttggggaccaactgcaagaggagagagagatttaaaaatatacattttccccagaaacttaggaatatatggaaaaatgataatttctcccattggtgctacctcaggcaacatcactgagggcctagattactttgagagttttctaaaattggatttgtatatcttttggcacattgaatatttgtttcacgtagtctcttcccttagactgtaagccccaggagatcaagatgtgtgtctccgtctgttcaggcttggacatggtgccttcttgctgtgtcttcacatggcacaagggaaagggagcattctaaggtattttcttttctctataagagcattaatcccattccatgacctaacaacttcccaagaccccacttcctaatactatcactgggtgaccaggtttcaacatatgatttttgggaggtcacaaatatccagaccatggcagtgtccgtcttggtcaccattgtgtccccagcacattccacagcacttggcacatagatgctgaatgaaactatatgggaaatgaatgaaatagtgggtcaaattcagtcttttttgatttcttcccttttgaggtgagagtgggaatatgtttgtcttttgattactaatgaaaatgcacatgaattatctgttgcagtcctatcagccaggctgagggttcaaatggggccacggtttttttctgtgagcgcaggtgcctgggaataagagcaggagcaggggcgagctctggggct

SEQ ID NO: 52746 - DNA, 1050 bp, Homo sapiens
tgatctttgaccagatacttctggattcacaaattttctaggctggaattcatccctatgggcagagactggatgatgctagaggcaggatgctatttactgaggctaagttcagtgtgggctcataacctggcttttattactaacacagagtcaagtgctatacaagtgttagctgctcctgctgccactgctgctgttatcgttactatttccaatcaccccaatccttgctatattaaaaaagtgttctttaataaatacaaatatagtacattatcattaaagaaaatttgaggtattctatggaacagtaggaagaaatcaaacttatccattgccctctcagagataacgactgttaaccaattacagtacgttcctggagtgtttattctctgcaaatataaatatttttgttttatacaacttgcattatatgttatatagcttgtgttgatccttgcacacttattattatattgcaagaatttcccatataattacatttcttagaaaatatgattgaaataacttcataggatttaatcatacagatttactagaatgtatttaacagatactctgttaaccatttaggtttccaaagttttgcaatttaaaataaagctgcaatgaaatctttttttatatatgcatcttttacgtttttttctttttcttttttaactaggaagattcaagtacatgacccttttgaaagtacagatatctcctgctgaatgtcagtaatcctttcctggaaatcaaatgttctgtgtaaagatattaactaggagcctatatcccattattttaagtgggaaaaaattatactgtgttgtacttcaacccaaaatccaaaaagtaattaagacaaaataaaatacctaaatatatgcaacaaaccattatgttagagaagttaaatacttaaaacatcacgatcacccaacaacatggtgtgacaaaacagcgcctctgtgcattgcatactgtaccatccacatccagtgcgccatgaaatcttgcagcttgagacattataaa

SEQ ID NO: 52747 - DNA, 1079 bp, Homo sapiens
ccacctaaacttcaggtctcatttccttttgccttccctgatgagtgtggcccacaccgatgtcttttctgagagcacgtacagccacaccacacggctggcactcggtctcctcttggctgctgatttcacagtgcattgatcaccacagagaaagcagagaaggcagggggcagcctggcacagcagtgagtatgtgtgtttgtgctctgtcctagggatctccttctcctcttttcaaatcaaatgtggggccccagccttacacaggtcctggttttaaggaatcccctcctatatctataaaagattctacctaggaaatccaagagattctgttggtttctaatagtactaactagtgaccgaaagtaagaaacacacacacacacacacacacacacatatatatatctgacaataaataactagaaaatgtaactaaacattaaatctcattcacaatagaaccaaaaccataaacttgtggactgccaaagaggaaatttaacaagaggtgtgcaaagaagaaaaccataacaaagatgaaaaacataaaactttgcaaagtacataaactaagttatctacaatgttcctggctggggaaaattagtaacataaagatatcaattatctccaaattaatcaatgtgtatataatcccaatcaaaatctcaatcacatttttttgggacttggtaaccataaagtttatctaaaagagtaaatttgggaaattagtaagttttagggaaaaaatcaaaatttgagaatatggaaacccaagtaaggtgagtagctacgttcctggtaccacaagtagattctagtatagggaaaggagagatcactggacttgagagaagagtccagaaacagcccgcaactaaggggatatttcaaatcagtagggagaatcaggattcttcagctatgagcgtgtcatcatccatgggtatcatgagcaccatccaaaatgtcagatacatcttaggcaaacaaggcctggttccacactcatgaaaattatgatctagttagggagaagcatagtctacaaataggtacactaaaga

SEQ ID NO: 52748 - DNA, 1047 bp, Homo sapiens
ctctctgtggtggcttcattcaaggctccagtgggaccatcttgtcgccagggttccctgacttctaccccaacaacttgaactgcacctggattatcgaaacatctcatggcaagggtgagtgtttcagcccatagcaggcattgggatgtgacgaggtcagggacccaagttcctcaggtcaagttgacctcaatggggatctccctagatagtgacctctgggcttcgtctgaacttttctcaccaacaagaaaacttccagagtcttctcatccctttgaatggtagaacttgttcaataagtattgttgagattctaaaatctccctgctggaagagctcttagaggttaccagctgtccaatctcactcagtacaggaaccttctctaaatcactccctgcaagatggcaacacgccagctcagctcaccctctgcctaaacatgcctgatgtggggaggccaccaacccgttcaacagatgggcacctactatcatttttgcacagatgctttcttctaatagtctattaggtgtctctgaaaatgtttttcttgtattgcatcctggaggagcatcagatacacctgctccctcttcttcacattcacccttcagatactgaacacagcgatccccttcttgcataactcagctcctcccctgatgccatctttcatatgggtcaccagcctgcactgctgcctcagctcccctaacgtgagtgacctttgggagtccaagttcaaagtaaaagtgctggttataaataaatgttaattaatatattaatactcttttctcaacaaatatgtattcggtgccacccatgtggctgacactggggctgggcatcagcagtaaccaggcagatttggcttctagcctcagaagcttattgccaagttcatccagagtcatggttcttgcagtttggcaaatacactaatgcttaggcccaaggctagaggttttgattttctacgttggcggtggaaaccaggcatctatgttttcagaacactttgccagtaattttgat

SEQ ID NO: 52749 - DNA, 1084 bp, Homo sapiens
aagctctaagctaagctgtctatatgaatgattttatttcattctcgtaataggacaatgaattttattttaatatacctatttggtagataaagaaactgaatcatggaaaggttaaaggttaggaaacagctgaagcacagagccagtaagtggcagaactgggatttaaaccccgtctttctagctccaaagcccatgcacttacatagctgggctgtgctgctggatggaacaagatctcagagtagatgaaaggggctgggcttcacctcagtgggatgagcctggaaggacgaggatcactctatctcctgaactaaagcaatagcaggaagatctgagtttttggaaaattactctagcagcaatggagaagtttagaggtggatactggaaggagaaagaccagttaggaggatgaagcagttacctaagtaggaaaaatggggacatccaccaaggctttggaaatgtggaggggaaaacagatgagagagatttaggagatagagtgggacttggtagctgattggatgtgggagctgagggaggaagagaggtcttattcaatattgtatcccaagtgaccaacgtggttccaggcacatagtaggtactcggcctatatttattccatgaacagatgaatgatgacttagtgctttctggcttggtccagtggtagagttaaaaaggaaatacagatggaggaacatgctttgcaggggtcaggagagaaacagtgcatttggaatgtctgtggttcattcaatgtcatttggatatactggatggaaactctgggtaaatctgagtttaagagagaggtttgggtgttatctcagcacgtgggtgagaatagaagcttaaggaatggacaacatttcttggaaagactgaagagaataagaaaattcagaatggatctgagaataccgtcgtgacaggagaaagagcaaaatccagtgaaagaacagagaaggagcaatctgagaggcgggaggagaatcgtgatgcaaacacaggaagagtttccaactagggcatgtctgatcatggcaacgatgacaaatgtcttgct

SEQ ID NO: 52750 - DNA, 1554 bp, Homo sapiens
atgcggattaaattatctggtatgtgtatagcacatagaatagtgtaataccatgtgattggtaaatgttagttgatcctaatatcctttaacatacctatagcatagggggtatcattacttgttttatagataagggaattgtccaaggttatggaattaggtagtggaagaacaaggacttgaatgcaggcctgtgtgtctccagagtctaccattcaaggctgtcttctactgggggataaaggtctgtgcattcattggctacttgatgaacttagcccctctgggcagaggggttccaatgcctggctaagcccccatccctgctgtgccatcggccatggctagtatcttctacctgcaacctggagccagcagaccctgcagcccctcctgcaagccttacacacacacacgagaaggatgctgcctttctcacctcctccagatgcttgcacctactgtgccacattgcaatcaggggctgcatgtccgtgccttggtcccagaacagaggaggaaaggagccctggagtccatgctgacagaggtctgtttaccttcatgcccagtgccctgagttacgctccaggtgtcccatttggagaagagaagctagtcaggagccctgtctgagagactgtggcagcttggggttgaagccaggagagcagacttggaaggactttaagctattagcaaatacagcacagacagaggccagaagttctgagaggaactgggattagggaacagtctgagtcatggcctggcagggaagcatgaaggcagccagctctggggagggcactgagaacaagcaggcccaggctggatgcctggctctacctactcgctctgtcacaagatttcatgcttctctgagcctcagtttcttcagctgtaaaatgggcatggcaaggatacatcccttctaggggcaatgtgaggactccttgctatgccaaggatgttacgtgttagcttcccttcccttcccctgcctacccaaggagggaggatttcctgcagaaggcaagctttcagcagcgctggagaggtacagaaagacatggattgagagagtagaggtaggagggtgttgctgcaagggcctgagccttgtatccccagaagccggagctgagtggaaagcttcaaggtgaagggattattgggcataaatatgtaaagaggaaaggaactggctgctgtcattctagtaatcctggctgctgccagctctgcggcaggcattgggctggactggggtggtgccaaggtgaatgaggtgccacctctgccctcaaggagctccctgggttggggcagtcagacttattaatggagcatctccatccagggtgctaactgatgctcaggggttggacaagggaaacagctcagagcagagagtgactgctccttccaccagaacatgagtcgctgtgccctggcagcctgcgagtggactgaggccccatgcattcctctaagggtggggcgatcaaagagattccaggcctccgctctatagactggaggcttgaa

SEQ ID NO: 52751 - DNA, 1063 bp, Homo sapiens
acctgggttgattcccctaccctctcccaacattagattttatcaggctttttcatttctgccaatctgattgtcaaataatgctatctcattgttttgatttgcattttcctgattagcaacacggtgcctcttttcatatacttatcctccatttgtgtttgtgatttttttttcaagtggattacctgttcatatctcctgcccattttttttctgttgggtatttgctttttttttattgacttggaccacttaatatattcttggtatcactgtgttgtccattatatatgttatggctgtcttttcctactctgtaatttgtattttaagtttgttttgaggcctattttattgagtcagagacagatagcttaaatgacttgcccaaggtccctctgcctagagctgttttctgactccccgtggtgtttcaccagatccagtattcctctgcagaacagcaagaccgtgtcttcctttggctccctttcagggggattttttaattgcatgcactcctggagtaagctgactttgatcctgttgcaaagctggctgaggcagggaaacctatgactatggctgttgctgggttctactccacctgttccatttctcttctcaatttcgatggaagaatttccaagattttctagcccacactttcaagttcatgtaggatgtacagcggtaaactaaaaggtttcagtgttctctggaaccctaaagattcaaggactgtgtatcaggagccacctggaatcaggttgccagatgttccaattggaagtacaggacacagccatgggaggtggctgatgcctgtaatcccagcactttgggaggctgaggcaggaggattgcttgaggccaggagttccatgccagctgggaaaacatagcaagaccctgtctctacaaaaaatgaaaaatatcaaccagacatggtggggagtgcctgtagtcctagctacttgggaggatcgcttaagcccaggagttctaggctgcagtgatctaagattatgcctctgtactccagtctgggcaacagaca

SEQ ID NO: 52752 - DNA, 1096 bp, Homo sapiens
aagacgctgctaataaactgcatcccgtatattggagggtttatagggtgctggtgatgactgcaccagttaagcacagctaagcatctcttaatttagacatttgggctcaagttatgggaaacactacaactcgttccctcaattattggaaatacacattctgtcatcagcctaaggtgcaatgtagttttagtcatttggagctagttgcagatttcactcaactggcgtcagacacctgttttggaagttgtaaaaatccacaaatttgccagatttactgtcttcttatgaatatgtatcacagcagaggcccccaaaggacctgttttttggattccttaaaaggtgtgccttgcacatcaatagggacgtccttgaagggtctgctctccagaatgcctctgggaatgtgctcttgtgggcagaaggaggctgggaggacccatggggatgagggaaaagtctttgttcaggattgaaacagagaggggacactggaaaggagaacaaaggaatgaggacactgaacggctattatgttccagccaccatgctggacacttgtgttcatgctctcatggtaatttattctacatttattgaatgcctaacaggaatgccaggtatcagagacacaacagttaacaagacagcttctgccttcaaggaacttaacgatatctttagggagacagttaaataatcagggtataagtgctatgactggggaacctgacctcgccttgggggagatctttgtggatgctcatctggaggcttgggatgaaccccctccatctgccccttgcttagttgtcccttactcattcctcaagtaactcagttgtcccttccttgcccaggacaccctttcctcacaacctggtcaaaccctcctgtgatacctgctcagattaccatgcattcaccctttgtggttttacacacgcgtgtgtgtgtgtgtgtgtgtcttcttcatttatgcccatctaccccacaaggctgtaaactccttgatgacaagaactctttctcttttacttttcattgtagctctccagggcctaacagagagtctggcttatagcag

SEQ ID NO: 52753 - DNA, 1077 bp, Homo sapiens
ctcttgggagaatttcatgaggcaaagcacttaaagcagggccttcacctagcaagtgcccaggacatatatgacagggtgtcttgcccgagttgccattgagatgggattaggaaggcatttggggatcaggctatcctccctctagtgggcctctctgtcccctggtaagatgcccttcacctctcaaagaactttcaggatgactggccccagccctgatttgcatgggtgtaggaatttcatgagaaagaacttgaatcctgagcacagatggggtatggaaataggtggacctgtgtaataggtgggaggaggctctatgaaaattaaaactctgggggagataaagtaacaccagagaggaaataggtagacctttataatgggtgggaggaggttctatgaaaattaaaacactgagggagataaattagcaccagagaggaaattcacccactttgcatgaggaagaggattagtggagtgggctggacagggagggccctgctgcttgagggtaagaaaagacagaggttctggatacagcaggaggctactcttggacgcagcccatcccattttgtcccctgcagatcccggacctcggtgcctggaggagagggtagcttggtaaagatgaaaaaggtgccccaaaggctcagctgtgggtctcccttctcctgcacggtttctcagccttgggcattttgggctggacactgttctggagcactgtcctgtgcatcatgggaagtttagcagcctcttcagaatccacccaccagctgccagtagcggccccctactctgagttgtgataattaaaaatgtctccagacgttgccagatatccccgggaacaaaatcgcccccaaatttagaaccgttgttctgctagactggaagaggatattttcctaccagctggaaagagagatgaaaagtggaagtcaggaggtagaaaaaaaaaaaaaaaccagaaaaattccttccagctgcctgagagtgttaactaaccctattgtatatccaagatcaaggcgtgcctgtgttcacctatggctctcagcagac

SEQ ID NO: 52754 - DNA, 1036 bp, Homo sapiens
cctgcctcagcctcccaaagtgctgggattacaggcgtgagccactgcgcccagcctatcatgggctcttttaaattcctccctatttacacatatccttccatgtattgtaactgatacatgtaagcacatgtgcacacacacacgcttctacacacaacatgtgttcacatacacagtttcacaagacaggtacactgctttaccactcacaaacacaacatcaggtggaagggacacccagacctttacacagattcttccagaagggcactgataccctagtggagggagggggtggcagcgggacccatggagcctccatccaggatgggagggtgggcatgcagccacgtactaaagagctgtatgcatgagaaccgtgtgtgcaaaatgtatatgtgtgtgtgtgtgggggggggtacacatgtatgtagtggacgtggacgtctgtttctgtagctgttgatgtgtgtgtgcacaggtgtgaattctgcatgccaggacttgggcagttgtgagcatcttgcttagcctgggttccagctcccagctctccagccccaagggtgggtcaggctttgaccttgaacctcccccatccctagtcactgtccttctgagctggcagagtttagggacgacgcccctcctgactacacttcaggctctgtgtggagtggctttcctgggaacaaaagccggtctactcactccccgatgacccaggatatgagtctgcacttgacaaccatgcctggtaacagccagggctcaacaaggccgacagctgcacagagcctgccaggctgtgtgggtccttcagggaggcgggggcctggtgctctgtgctcagcaagacaggtctatgcctctgcctgaacttcaggcttctttgaacacccaggtcttctcttttggtggagctgccaccacttcgacaacgtgctggcttggagccctcactgtctgtctgtgctttctcagggaggaggaaggttaggagacacaccctcagacccgagcgcagcatccc

SEQ ID NO: 52755 - DNA, 1037 bp, Homo sapiens
catcagagaaagacattgtgcctaccctagagctagcacagtggctccactcacagaaaggaaagccgaggatggagtaggggtttacctccatggccccctctgctgggcgagtctctctcctagagactctcttactttccacctgtttgtgtttgtattgttggaaaattttaaactgaatttgtctttcaagggatgtcagtcccacccttgaaaaatcattattataaggaacttttatgatgctaaaaataatgtatgtatagttaaattactgagagcaccaaattactctgagaaatttacttgagaatctcctgtgccatctagaacagaaaataagggcttatattgcaacacaaatagccttcctacctgctaatgtctaatttataccaattaagtgcaattataatccataaacctcaaaaaattatgtgtccatcttcaaggttttcaaatagaaaacagaataagttctattattaagtaggtacatctatttattgattgaaagtaagtgagtgtgacggatgtaactgtaaagggaaaaagcagagactttgaaatttgagatacaagtatattatgagagaatgtgcagacattttgtgcagaatgattgatggccctttctgagatgagcaagtgtggtagagtcgactcaggcctcgggaggtttgtcttcaggttgctgcctgaccccaaccctttccctaccccagcctcaatctgtctacctaccaaccttcattgcttcctccattgccatttcaggaatggagagagttcagtgattgggtgggacttggtgatggtgtgtggacttggcagtaagaaagagatgacagtttaatggtttattttcaattaatgctaaaatgttcctagcacgaaaacagacatctcaatgttggcatcccctcctgccagggacctatgtggccctatcctcctggccttatcatatgtgcattcctagaagggctgactcatagcagatcctcagccaggagaaaggccttgtttggcct

SEQ ID NO: 52756 - DNA, 1929 bp, Homo sapiens
gaaaggagagaaccatctcaaggctcagcccccctgaggaggagggccagggttgaaacagagggagcaggcagaatgtcccagctccaccagtcttcactctgcagaacctcaagaccagagcctcaggcccggggaggaatgagtggctccctggacctgcccttatccactggtattggtaagagctgggttctggacttaattacctatgctcaaatcccagccctgcacctaatagttgtgtaaccttgtatataatgccactaaacctcagctccctccctctacaaaatggggacagtagtagaacccagctcctctagtgatggtaaggatgaaatgtgatgacatatttctacaaagtgctcagagcaagtctgtgataaatgtaggaaatgattgttcttgtttccctgcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggttccaggtgccctctggttgtgcggccttcgtgaccctcacacgttcatggtgtcaatctctctgcccccgtgaagagctgcacttgatccagcctgtgaggggcatcctctcttccagaaagggggcccccagtactccaggggacgtgctacttgctcatgctcccatctagcctttatcccccatggcaagtttagtcctgtgggttgtctgcagagagaatggagcttagtccatgttgcagtgggaagttcatgaacttagaatgcctgtgtcgaatccaagttccaccgggactct

SEQ ID NO: 52757 - DNA, 1045 bp, Homo sapiens
tgggaaggggacagggtcaatcccactggtgctgtcctaggcctaggcataatgatatcaggctcctgaaccccacacagcagtctcacccacatacctgcctgcctgggagccaggctcagccatacccagccaggctagagaggaggcgtgggccaggagagaagagccgcaggtgtttgctctgagtatgtgcccggggaagtccgccctcctgcctgcccacccaatcactctcgcttggctcattggcccagaaagccccacccagcaagggagagaggaacaaaagctgcctccgggaggtcctgaggcaaacagacaagcccaaggacaaggaagcagctactggacccaagaagggtgaggaccgaatagggcaggaggctggccaggaagcaagcaaccagctgagctgaggatatccaagggacctcaggctgtgggctgggcttcagggagggagccagagggtcagtgtccctagaggatccccagggaagtgccaaggaggagaaggaatgtcctggctgacctaagggacgacagaagattggggaagagggggtatcaggaagaaatgggtttcagttcagtttaacaaacatctattgtgtgttcactgggccaggccagtgctaggtgctagggagacagaggtgaagagcctgccctctagcagctgacagcctggcaaaaaaataagacaggtaaatagaccatttgggtacaggcgatgcctcttgctctgaaagtgtcccaggcacacgatgtctgaagaggctgagagcagagtcagggattggggatggggaaggaggagggtaggaggaggggagggttggacatggggcctgatggggactccagacaagggggtgtggaggtcagagtccacaggagaggggcctgagaggaaataatggaaatgcggctagcaaacagccactaaatggacagaggagggggtgcccccagagaaagtaaatggggggtccagaccatgccagaatccatcctcagtccttcctaaagctggaatggt

SEQ ID NO: 52758 - DNA, 1017 bp, Homo sapiens
cacgtgaccaggatgagctgtagggcccagaggcgcacgtgggacacggggaagaactcgtcatagcagacgttggggcagccgggctgcttggtgttgcagacaaagtccttctgctcatcgtcccacacctcctccgctgccaccacgtacaccagcacacgaaagatgaacaccacagacagccagatgcggctcagcactgtggagtacttgttcacgccactcagcaggccctgcagaaatgcccagttcatgctggctgtgtcctgggtgctgcacgtggaaggtctatacctgggtgctacctgcccactcaggccttgggagccttgaggcctgggggaacctggagatgggcacccttaatgctggtgcgattgacaaaatcttttcacaatcaccgtgtcatcatgtcttcactcccaatgacttggtagggtagggattgcccctgtcctcatttcacaaagagtaagtgaaggcccagagatacctgcccaatggtccacagatggaagtagcagagctaatcttgcactttggtcttcaggttccaaaatcagggtctaccttattctacaaggtaatagatacatgtgaagacaatcatcctgcatggatatgccagccaacctctattaccccaagtttcagcccatgtcttctaaagagaccgtaggaaggcttgaattggacgatctgctctcccatcagctgccagggctgggccagggcaggaggggtgggaacgtatccttatcagttgtcagatccatcccacttttactgaacaccaacaagagcctggccccgtgttggggacgttcacatcagccccttggtaaatcccagaacaatctgcatccttactccttgcctctggctccaggaaggttctcagccctggcattccctcccaaactaaacagaggtgctttggaatcacggggacttgatatcatccctgccaacccgtgtactggtgctggggcctgagggctgactgtcttgacc

SEQ ID NO: 52759 - DNA, 1050 bp, Homo sapiens
accctcttgtttcctattcttctcacagccacgttcaccagccagttgttcacacctgtttccatgtgcccagccctcactgtcccttcactgccctgggacctggtttctacatcccatactcctgcacaggtacacatgaccatcttgtgaatcgaacgaacacttttcagtccttatttgatttggcccatgtcagcgtttggctctgatgatcactttctccttctagaaacacttctcttggcttctgcgacaccatcttcctcctctacgatgtcatacccccatggcttgtatgatctctacttaccctgcccggagctgtctttcccccatgttatttgacctttaagtctccagcctagggtatcttctcatctctcccccagtctctgtatggtcttacccactcccaaggctcaagcccccaactaccatagaggcccagattatgtctccagataaaaggtaaccccccatattcccattgaggagagcctcaaaaatgtgtgggggctgacctggatatataaacttttagtgtggttgaaataaaatgtactgtattaacttagtttgttatacattttaaaaatcacattgtatacaacaatgtagtaagaagtattagtttttctctcctcatgctttatgaagtaattttatttaaatttttaacatttttctctaacatctgagtctacatcattagagctttggttgttatcaacattttacaaaacacaaaaactttatttctgcccaagttatttgtgacatagtgctttttgaatctgtttatgatgctggagattttattctttgccataaaagtctggctgcttaacattaggttgcataaataaaaaaaatcttccagtaggtatttgtcatctccataacataaccacttcctttattgttttaaagtgattttttaaaatgggcttgcttacaaagacaatccttgcaattgtaaagtcctgcccttgggaataatgattcaatatacgtgaaatgcctttgccttcactttttttttttttt

SEQ ID NO: 52760 - DNA, 1048 bp, Homo sapiens
acttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaagtgctggacggggcggggcgaggctgggcgggaccctcaggggcgccaagcgctcctggcgaccccctgcggcagggctggggcttgagcctgccagtgcgctgggatggggcgcgaagcgggggtgcggggagcccgccaccccgtacctctcaatcctccctctcgcctctcaattctgggcccattaggggtcccggctgcgggaaggttccgagacaccccctccccaagtccgcaagctcccaagctgcctaggatggagggaaactgggaaggaaagggagctttatccttcagggacattgtggggcgggaggtagggctgggcacagtacagtctgggggtcagggaaaaaacggttgcgctgggagctggctttggagggcagctgggggaaccagaaccggctccaccagtccccagcctagacttgggaaggaaattctttgcca

SEQ ID NO: 52761 - DNA, 2533 bp, Homo sapiens
cttgttttaagtgagtgacttgacctctctaaatttcacagtaatgagtagccagcatttatggggcacttactatgtactacttgctttgcaatcgttcaatgatcagtttcatctgtaagtgaggagcactgtaataactaccttatggggtcattctaagagattaaatgaggttctgctcataaagtgtttaacttcatgcctgactctgagtaaacactcaataaatggtgattgttattatcagccaaagcatatttgcttccttccagcatactagctctgttgcctttggttaagttatataaccttgctgtgcctcagtttcctatctgcagcttgggaggaataacagttctgaactcagagggtcgttgtgagtattgaacaagtcagaactcagaacactgcctggtacatagtaaatgctcaataaagtcacctattcattcatacgatggtttttcctctaattctctcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttatacaggttggctctgtctctggttctcccacactcccacccactgacagaaccctgaaggtagggaaaggtaagccctcagaaagggaaagagttccatggctcggggtggagctagggtgggggctgtggctgtggctgcagctggggcttgagctggagctcggttaggctggggctgatgttgacagccgggagctgggtttgtaccagaggaggaggctggggtggaacctactgatacatatgttgggattctagctgtggccacaagagtgcgctgtgctccctctgcaacggtgcttccagccttcgtaattagacttcaccctgagtacacacacaatcactgccactctcactatagacaaaccacactccctcctctgtcacccagtcactgccatctcaacacacatcccca

SEQ ID NO: 52762 - DNA, 1038 bp, Homo sapiens
ttatacaaaattctaagcatgctatcatacccgtggggttaatttgacccagtggctgccaatttgtgacctctcaaactgcctcctccttctgatgacacctataattatggttttttttttttttttttttttggcgatctaacaacttgttacaaatattagatcccagaattggtttccctcaaaacacttttgggcatcctgtacaaaggcagcttaataacctaagaaaaatgtgaggatggaaagcctacagaaataatagcaaacacatttcccatggacatttttggattttcagatcttttaaaatatccctgtcaccacccgttggcctccacttggtgtctggtcgagagagccctatctttgggaatccaggtggctcccttcttccagtctcactttgattgtgcccccttttaaattcttttctttcctttccaagggcactttgtcactgaattcttcctctagcaagtctattagtgttctcagctagatctttctttcccacaggctggctgaaatcagccgttgcggtggctgtaagatagtatatgtgctcttgcctctgctcgggtgacattagatagcaaggtttatgtggacgtgggtatagacaggtcagggttgctgggatgaaccaaggtgcagaccggttttcttccatgcttgctgattcaccttggaggcatgtgaccctctttttgactggccttccagtcacagttcactgaaacacatgagtgagtggatgtgcttggggctttttgctccccgcttacccccgtctcttcccagcccaatgatggtggtggctttagtatagggtcctctccgagcacggcaggaatcacttctctccctgcagcggttcagtgtctggtgcttttccactctttctagactctttcctgtgcctgttgctgtgttagcacaagtcggctgggcagctgccagaacaagcctgccagggagccttttgactctggtcagctccccagggctccaggctggtgggactgccgctga

SEQ ID NO: 52763 - DNA, 1020 bp, Homo sapiens
ttccttcttccctaacaatggaatcttttgaaatttcctagattatttcagggatccacctctcgcattgctctgcacgggggtgggtgctcagtaaattgtgccaggctggccaggtgtggtggctcacgcctgtaattccagcactttgggaggctgaggtgggtgaatcacgaggtcaggagttcaagaccagcctgaccaacatggtgaaaccctgtctctactaaaaaaatacagaaattagctgtaatcccagctacttgggaggctgaggcagataattgcttgaacctgggaggtggagggtgcggtgagctgagatcgtgccactgcactccagcctgggcgacagagcaagactccgtctcaaaaaaaaaaaaaaattgtgccaggctgcctggtaagtggagagctctagtgggttgctcttatttggtgggagatgatgctgggttctctaatgctgccttgtgcttttccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactg

SEQ ID NO: 52764 - DNA, 1093 bp, Homo sapiens
gttaaaaaaaaaaaaaaaagcggccaggcgcagtggctcacgcctgtaatcccagcactttgggaggccgatgcgggcagatcacctgaggtcgggagttcgagaccagcttccccaacatggagaaaccccttctctattaaaaatacaaaattagccgggcgtggtggtgcatgcctgtgatcccagctactcaggaggctgaggcaggggaatcacttgaacctgggaggcggaggttgcggtgagccgagatcacgccattgcactccagcccaggcaacaagagtgaaattgaacaacaacaacaaaaaaggtgggaaggtagatgaaaaagcatcaataaggcactgaggtgtgaaacagtgtggtctgccgggtttagtatgtgcgagcaaaataaatatgcaggctgagattagtgggatgagggtgggaagggccttgtgggagcattaacaagcttgagctttgggacttttctgtatatgataaaattgatgtctgtatagggtacagtggggacacagaggaggaagtgaatacttgtacccaagaggtcatgtaagacttaggttttactatatttgaattatttttacactaacaatagccacatttatttccctgctggctgtgtgcctgccacagtactttacaaatattatctcttccaaccctcacaccatccttgcgaaatgggtgttattacctctacacagaaggggaagggaggctcagacaggttaataatgttcccaaggtcactagaaagctagcccggatcccaagaggtcttaaagcactaaaatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcgctccgagaga

SEQ ID NO: 52765 - DNA, 1035 bp, Homo sapiens
ggataatccaggagagtctcctcttcttagtatccttaacttaatcgcatctgcaaattcctttttgccgtggaaggtaacatattcctgggttctggggatgaggatgtggattcctttggtggctattattctgcctacaccacaggttctttcctcttgggatacagcaagcaagaagcacccaaaacaaaatatccctctttaacagtacattctcttctgtcttcctcccttctcagccaggctttctgagggttgccttgactagttttctccacctcctgacaacctgctgcagtctgcatctgcccccacattccaccaaacccactcttgcttggatcacccgtggcttccagattgcaaaatccgtgggcacctttcattcttaaccggctgcgttttccatgttagctgcccattccttcatgagacctttctgtcccctctctgcttttatgtcactttctggtggttttctcccccttcctttctggcttagtctcctctatgagctgcaccgtctccacccacccctgaaatgtccgtgttctcccggggtttggatcttggatccgttgttcttttcttgggtgagcttgtcccacactgctggttttaaatgccacttgcacagggataagcgcctcctgcttgtgctgtacacatctctggctgctggccaggagcgttggtgaggactgtgcttctggtcatcccatcagctcctcgacttccttggtctcctttgaggcagacatgtgagagagctcactgaggcagtggcttgagaagcatgcagcctggggcacttggtccttctgttcccggcagtatggctgtttccatcgcgatggaatgggatcctctcaagacatctcagaggacaggcggaaggcagcgaacatggcagtgccgaaggacacagctgtgtttagcaggggcgacaggaaagcacgcaggtgtggcagatcatcaggcacgtatttattggagcaaccccctcctttacctttgtggtttgcaacagct

SEQ ID NO: 52766 - DNA, 1035 bp, Homo sapiens
aaacacaatcatcggaatgtagcactgagaacccggctagggcattgtagttattaattattatgattgctgttgatcatttccatctgttctcccacagcgctttgaacaaaactcttttatactccatatcacattgtatcatggctggttatttgcataagtgtctcctcactaaatagggcagttcatcacactggttggttggttggttggttggttggttggttggttggaaggaaggatggtagagaccactaactgtcttccaagatccactctccatttcccccttagtaacagaaccccaccattttatgctggacacatggctactttgaataaagattctttcccaatctccctaccaactaaatgtagccatgtgcctaagttctagcccatgagataaaagtagaagtggcatgtgcaacttccagaaagtgtccttaaaaggagggggtatgcccttccttgtctcttcctccttcccgatcaccagaatgcagacatgatggctggacctcaagcagccattctggaacatgagaccaaagggaagtgctaagtggggtgggggatgaggaaaagatagaaggctccaggtcctgacactgtggggcatctaccagacctcaactaactctccctggatttcctctaagtaagagagaaataaacttctatcatatttaaatcactgttgtttggggggttttctataactcacagtcaaacccactcctaactataacagatgaatttttagaatagtgaagttaagggcttatgtcgctatttagttttggatttggcagtatttgctgtggtctccaccaacagctgtcagcacaggataaaaactggcttcagctgtgaattgtcattaatgcgtaacaatgcattcacaatattttctcccaagcctttaaatgtggctgcagaagcctcctccctttgagtgctccaaggtgacaatgattacattcctgatgataatgcaagttgttatcatggttacttcagggagagttt

SEQ ID NO: 52767 - DNA, 1080 bp, Homo sapiens
gtagtgggattttattgcatattatgtaggaatatgaaagaaaaaggaggagataagagagaagaagggaccttatttagattaacaggtgacatttaagctgagacttgaggattgactaagaactctcaggtgatgattggaggaaaagcattcaggggagagggaatagcatatgtggaggtgttggggcaggaaagagtttgacatgcatcgggaactgaaagaaggtccatgtggctggtgtggagtggggcaggggagtgggaagggagttaattggagaacaggcaggggcaggttatgcagagcatggacatgataaggaattggaatctaattatgagtaatgagtagccatgtaaaggttaaagaaggagtgcaacatgatctaacttatgttcatgaaagatcacaagctgctgagtggagaatgaatttgaagaaagcaatagtggaaacgagaaggctagttaggaggatttttcatgatccagaagaaaggtgattgtgttttgcaatgtggtggctattgtgattgggatgtttttcttctattgcattttacaactaggcactgctagtgtgtggtagcactgttaggtttatttatttttattttaattttattttttttgagatggcattttgctcttgtcgtccaggctggagtgcagtggcatgatctcggctcactgcaacctctgcctcccgggttcacgccattctcctgcttcagcctctcaagtacctgggattacaggcacccgccaccacgcctggctagttttttgtgttttcagtagagatggggtgttgccatgttagccaggctggtctcaagctcctgacctcaggtgatcagcccgcctcggcctcccaaagtgctgggattacaggcgtgagctaccacacccggcctctactgttaggttttgtatgttttgtatgttgattttgtattcagtaacgttgctgctgaattaggtctctcttattagtctcataggttatctgaaaatcatgatgggcttcctatatagtcagttatttttctgtgaatgaagatatttcttttaa

SEQ ID NO: 52768 - DNA, 1002 bp, Homo sapiens
gtgcagggataataggagcattcacagtacaatgttacagttttataactgtaggatagtaaagatcaacatgggtgtaatatttctctgagagtctctgagtccgtgtttcccttgtgtcctggtctcctgttggaaccccagaagctcctcttggccagctgagctggcgggtgtatgaccccagggagttgttcaccttcttttgtctgccttggatagaattggttgtgagtattgcctgtgggtgggatttcaagagctgcagaaccccagggaaagaggcacttctcattctgagtggtattgtcactgcgatttaagagcctcttgttgctaataatagtagctatagtttattgagcatctactgtgtgccagatattatgcctagtgctttatacacagaagagggctagagatacagaaatatacaacagagtgagattcctttcatccctggtgtctggactcgagaccagtgtgctttctgctagggttagattagctcccctgtgctccaagagggacactctgggctgcatttgttctaattggggagtgtcttgagcctagcccagaaatagcaggagttagttcagttcctgtgttttaggaaatacgctggcaactgttgtctttggtgccccagaaatacagagacagaaagactgagaggtagatgacagagcatcatggtgaaagccacaactgtcacacaagtgtggcttgtgtcagtcaaatatgagagaacttaacttctgcggggtcttggattgattttccatggcctgggatttccatacacttgtaatgaagctcctttagaaaaagcttcaaaaagttcagacaatccttcttttcaattagtaggcccacattggaaccaacgaatctaaatctccagcaaatttggctctgagcttctaagcagccaaagcaagagaggtgttttgttaaccttgggttcagatccttggggtggggcctgagttaatgtag

SEQ ID NO: 52769 - DNA, 1003 bp, Homo sapiens
caaggctgcagcatctcaaggcttcactgggtgaagatctgcttccatgctcactcacatggctgttggcaggctacagatccttgctggctactaaccagggacatcaatttcttctatgtgagactcactacagggctactcacagcatagcagcttgcctcccccagagcaaaggctttgagagaaagagaataagaaaaggtgtctaagatggaagccacagtctgtttgtaacctaatctcagaagtgatatcccattgtatctgccatattctattcattagaagtgggccaataagtctggtccacactcatgagaaagggattacacaagggtgtgagttccaggagatggagatcattaggagctatttcagaggctgtctcccacataatacactcaccttcaatggaaatttatctgtgagaagcatgagcagcttgggttaggagtgagttccccaggaaatattttgcagttgcttctgttggaatatgcctggtttggaactattttatgctaatttttaattttaggggtgtggcccatgaaggttcatgcagatacactgtaccgtggctgtgtgaggaccagcttgtaggtacagattcttaggggatttgcctcttttcccttcccgccatccctgtacttcagaccagcttccttgtcatcagcctgtggtgatgactaatttttttattctagtctacattttcatcaaaggtttcacttttcctaactttatgcaggttctcctttccaattccacgcttcatgtgggcccaaagccttcctcctatgcccaagtgggtgttaaaacctaagcctttaccaaaacgctgagaccaacagcccctgcccccacctcccgcctccactgggctgtttgcagcattggctcacacagttaatattctgattttccagtctcctctttgcttttgtcccctggggacttatctcgctttcttgtgagctcagctatgcatataaag

SEQ ID NO: 52770 - DNA, 1049 bp, Homo sapiens
cctggatctcctgggttcttccaaggagcctcagggacctcactttccattccaggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtttcatgtctcttttgcctcattgctgttaatggctgcatagtattccattgcaaggatgtactataatgtatttaatcccccatgaggaacatttgggttattctcaattttttgctctcgtaagcctcacagtaaatcacttttgcatacttattttcttcccctagaagtgagggtgctggttcaaaacacatgcatgtttttaaggtttttaatacatatttaaaacgtacaggttctgtatgcagagcttaagtacttgcttctgcctatgccctttgagacatattagagattccctcccactcctttttttctctgacatattagatgtgcagagctaacaggtaggcattgagtcatttgacaggacctgaaatcaagctctggtggtgatctgtggcacc

SEQ ID NO: 52771 - DNA, 1022 bp, Homo sapiens
cgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttccctttttgttgaggaatttaataattatgattgttataaataattatgtataattataatctagggtagaaaatttagttatttcattaaatttggactagtgacaaagactgcaggtaatgagaagcccagtttataatgtaacagcacaacctggatgttgaaacagcttggcctttagaagcaagtggaacatttcagtcttctagccaaccagctacttacccctgcaaggttgtgagtaggtggaaaagatagatcttttttttgagatggagttttgctcttgttgcccaggctggagtgcaatggcgtgatcttggctcactggaacctctgcctcctaggttcaaacaattctcctgcctcagccttccaagtagctggg

SEQ ID NO: 52772 - DNA, 1047 bp, Homo sapiens
aacctattgggtgcttgggattacttgtacatgtaccacatcctacagttttattatacctagtgatcaagctttgggcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagtgattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgt

SEQ ID NO: 52773 - DNA, 1024 bp, Homo sapiens
tgcagtgacgcgatctcggctcactgcaacctctgcctcctggattcaagcgattatcttacctcagccttctaagtagctgggattacaggcgtgcgccaccacacctggctaatttttgtactttagtagatacggggtttcaccatgttggtcaggctggtcttgaactcctgacctcatgatccgcccacctcggcctcctaaaatgctgggattacaggcgtgatcccacaattaccgtgcctggccacagtttttatattatcttgatttagggcatctatataaaacaaataattaaataaaatcagtattttaaggtaagaaccttacattttgtagtctcaactgactcatatatcctgttttcgtagtccctctttttatgattaatgttatcttttcattattttatagttttaagcctatcttgtctaacatttctttttcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaaggtaaaattaaacttagctaatgggatttttatgtcagtgctaggacactatcagcatatacagttataaataatataataaaaacaaaatttcattggattcaaatagcctgaatttccttaaatttttctttaagaagtctttaagatttccccttgagggaaaagtaattctaatactttttgctctgatagtcaagcacaccaaaaggccaataatgtatatgcactaatttttataggaaacttagatttgattgctttttgattgaatgtatctgtacataaataacttaaactagggatatatactatttagttaataaaccagaaataaaaacagaaaatcagggcaaacaaagggagagtatagttaatatagttgctgtgactagtgtaaaatttgtttcagagcttgctta

SEQ ID NO: 52774 - DNA, 1039 bp, Homo sapiens
ccaaggtgtccaggtttcatgtcatagttgtaaaacctcagcaatccctcagtatcacctagccatgtcaaatggaactatatacagcttctgcagctccagttgtgtggttgctttccaggtatgatctaaggtagcacattatgcatgtggttctgttaggcatcgatctgtggcacagtgttaactgctgaaggcctgttcttatgaaagtttaaatttgaattaaaaagaaaaaaatttgtttcatccaggggcccaaccaggtcatttctacaaaatatctgaacccagatattgggtctcagcagtttcttctttatttaggatcctagcctaaactgtcattccctcccactttctcccttgggtctctccccttcaaaaagatggaagctaggattgtggtttgggtaggtggtatggtgaagaacagtagcctgatgggattcacataccccttcctctcatcctgtgtcagaaacacagtgactcctggcatggaattgtaagcatccacttgtcccattttctcctccctctctgcaatacatacacaaagagtagagtttagtaatctccagggtaggaacatgcctgatgtagtatccctggcattagggagaaagagactgctggtagctattgtgtcgtagtagccatcagaagctggttgatgatgggagtgcaggtagggggaagttttagggggaaggagaggcctgctctaatttattagaggcatatactggaggtctttgtcaggaaagcctgaattccagtccttgaccttttaatgttgtatttctcagtccttttattctggaaatataccatttaaactctttctgtgagatagaaaattttaaaaaatgtttgtgggagacttgatttattaaaatgaggaaatgaaaagtacaaagttatcttatttctcagttgataaaatctttaccttatttgttttcattcagaatgtatttagcaagccaaaaggaacaaactcttcggcggtgcccctgtctcagggccaagtggt

SEQ ID NO: 52775 - DNA, 1049 bp, Homo sapiens
cctcccgggttcaagtgattctcctgcctcagcctcccgagtagctgggattacaggcgcccaccaccacgcccatctagtttttgtatttttagtagagacgaggtttcaccatgttggccaggctggtctcgaactcctgacctcatgatccgcccacctcggcctcccaaagtgatgggattacatgcatgaaccaccgcacctggccctggctggctatattttaaatataattcactcttgacaaatttatgaattagatattataagccccattttatacatgaagaaattgagatagtaattacatcattcattgtcactcacctgataaatagcagaactcatcaaacccaggtttgcagattccttatcctttttctaccatacagtacctgcccttagtaagtgttatttcacctcacaaagaggaggaagttacagttgtgaagaatacatttcatttttacctttgttatttatttttagagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatgtaagttacattttacttttattgggattctgctgaaagagatttttttttaactggctctgcttattttgtgtgtgtatgtgtgtgtttatttcctagactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcaggtatgaatatctatttgttgcatgtacttaggcccactccttctgatttggctgcacagggatgaactacaaaatgagagtgagctcctcc

SEQ ID NO: 52776 - DNA, 1052 bp, Homo sapiens
aaagattctctaattctgaaagattgtctttgtaaagattagtgtaataacttgtaaattttgacttttgaggtgcttgtgaaggtatttatgattagactgtttaagagatgaatagggccgggtgtggtggctcacgcctgtaatcccagcactttgggaggctgaggtgggtagatcacaaggtcaggagttcgagaccagcctggccaatgtggtgaaaccctgtctctactaaaaatacaaaaaatagttgggtgtggtagcacatacctgtagtcccagctactcgggtggctgaggcagaagaatcgcttgaacctgggaggcagaggttgcaacgagctgagatcgcgccactgcacttcagcctgggcacccaagtgagactccatctcaaaaaaaaaaaaaaaaaaaaaaggagatgaataggatagaataatttttttttgcttgaatttctagtttacttacatacattgtattcattgctcttttctcttttctttttttttttaaaggagtatggatgtgtccaacagccaaaaactcaagaaagtaaattgaaaattggtggtgtgtcttcagttaatgagagacctattggtaagaaatggaactgtataagttagttacaattaatttgcttattctgacttttaaaattgagggaaagcatcttttcatgtatgtctttctctttctttagagctgtgttttttcaaactgtgagtagctggttttcagcagcgttttaaaaaatagagtaagattatatcagaatatgatatgtgtagtaaggaaacatattgtttcataaaacttctgtttcagtgattaaattgtacatacatccccacgtttacaaacatatgtatgtgagaactgggttataatattaaatgtatttcttgcgttgagtaatggttaaaaaaaaattgaaacctctgttttagagctcttattgcctcattaactggatttcaagattgggaatttgtcctgaaaaagagagactgggctgggtttagtggctaacacctgtaatctca

SEQ ID NO: 52777 - DNA, 1994 bp, Homo sapiens
ctcggtctctttaagaagtgaaccataattgaggaaagaggaatgctgggaagttctactcagctcaggtccggagcctgacgggaaaagagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgggtgcggccgcagtggtagtgggcgggacggcggggcggaggccacaccacgtgacgaggcgttgcggcgggggcggtgccaggtgggctacgcggctggggcggctgcggatatcgccttagggacgcgttgacattcactggctagtccaccgctctcagtcggagaccacattgcctcgttagtcctcaatgatgggagtgggaattcttggtgggaaggagaatttcggaaagcgtgcggttctcagaggagggatgagcgcccgtagatattttgtggcgagtgcgcaaaagttctcatttcttctttggaacaggcttttcaaccagttgtccgtttccatcccggactattcggataaagacaactttgaagagctttttgttttaggtttaattcgtcccgtttagttctttgacttttaggggaagggaatttactgaatggccaattgagtttcttttctacaggaaggcgattgtgaagcggggctctgaggggcttgatgccccccacccctcacacggagaccttgaaagaggcaggtgactcactttcagtaagggcgttcctgttgttcgcctgcgatggatggcatcttgagctcacatctagcgttaggccgagaaatggggcccttagggaggcttccagtgaaggttgagttataggtcagggccgggaggttgttgtgcccctctttgagaaataaaagccgacgtgggcctctaagtactgattcttatggggtcagaaactatttcttgagtccgttcttctcagagtttattacttcctcccacgtcttggtctgctggtctaattcccttcaataaccttcaacataggaaaaaaccagagtgtgttgtgtgtctttaaagatattagagaagtgggagctgttgccccaaaactgttttcttatgtagctactgaaggaacagaaagcaggaagaaagaaaaaagttagttgtggccccagaagagttgtttttcaaatgccgagccgtgaagcctcatgcactcaacacaaagtttttctttcatatagataagcctgaagaaaaaagaataagcctgagtatgtattttaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagtaagcatttcatcttcatttaaaaatttaaaaaaattccttcttttccatctggtcaactgaaaaattttagttaaacggcttctggtttgtaagtttaaaataacccaaactgagacaggctctcgctgtcgctgagggtgtagtgcagtggtgcgatctccttagctcactgcagcctccacctcccaggctcaagtgatcttcccacctcagcctcctgtgtagctgggaccacagggcacacaccaacatgctcaactatttttttgtatttttggtagagacggggtttggccatgtttcccaggctggtctcaaactcctgagctcaagcaatccacccaccttggcctcccaaagttctgggattacaggcatgagccaccattcctggctggttttttgctctttgaatgaaagctataactacatgatttttttgtgtgtggaaggaaagtaatatatttaccatttttccat

SEQ ID NO: 52778 - DNA, 1069 bp, Homo sapiens
caatctcagctcactgcaacctctgccacccaggttcaagtgattctcctgcctcagcctcctgagtaactgtgattacaggcgctcgccactacacctagctaattttttgtatttttagtagagacgggatttcactatgttggccaggctggtctcgaactcctgacctcaggtgatctgcctgctttggcctcccaaagtgctgggattacatgcatgagccactgcacctggccttactgctttcataggtattattattattgctgttaaatatatctgataaataataaaaatcattttcagatttgccaatattcttttagttattgcaatctgtagtgtctttttaagaaaatgtaaaaactgtcttaattgttattctttttaatattccaactaaaagcagtggtaataggttcttcttcattaacaacatatcatataccaggaatatgaatattattttaatctctaaacagaaacctgccaaaccacttatatctgttccttgcaaaccattgaagccctcagatgaaatgattgagactacgagtgatttggggaagacagagcttttctgctctattaattgtttctctgcatacagtaaagctaagatggaatcttcttcaggtaatgtttgtttagcaattgtaggggtttagtaattattaataaataatattatttgactttaatttataaccttgattcattttcaaattaaaccgacttttaaaagtcaaaacaatctaaacttgttgcaaagaactgtttttcagtatttttgtataaaaggaaggctactttaccaccagagatttaatatttgtaggccaagcacggtggctcatgcctgtattcccagcactttgggaggccaaagtgggcagatcgcctgaggtcaggagtttgagaccagcctgggcaacatgttgaaaccccgtctctactaaaaatacaaaaaaaattagctgggcgtgttggtgggtccctgtagtcccagctacttaggaggctgagacaggagaatcatttgaacctgggtggtggaggttgcagt

SEQ ID NO: 52779 - DNA, 1052 bp, Homo sapiens
gcaatagtggcttgggcaccaacctagcgctccattgatgttaaggtttatgaatcctggaagagtttgaaatagatgcccattaggagattcaatcagaatctcttttcttcatgagtaatttcacagaaaaatttgctcataattttaaacaaattctttaaaaggactgggaaattgtgtacaaaggtaaaagacataaaatgttggagaagtgtaaattttcagtgtaatgttgtaattataaatacgatactaaagaacctggctattcctaagccctaataaaaattacttcagtacctaccaattccttaagctattagatgcttgcattatttctttaaacagtattactaaacagtactttctgatgattgattttgccttgtttataagaaatctttttattgttgtcagtaagtgttgtttctgtggtgcatgatacttcaacagagcttctttctccaaagaaagatacgactccagttataagcaatatagtgtcattggcagacaccgatgttgccttgcccatcatgaacactgatgtcttacaaggtaaaagttgatgttaagatatttgacataaatattgttttgtcatacttgataaatctgtctatatgctaaattttctttttgtttcttatatgaaataagcaaatatagtttatgatgctattttataggttatagtatataagatcttgaatttatgctctattttaacagatacagtttcttcagtaacagcaacagcagatgtcattgtggatgtaagttttaactttttttaccactgtctttttttaataagcagatttttgttgttgttgttgttgagacagagtctcgctctgccacccaagctggagtgcagtggcgtgatctcagctcactgcaacctttgcctcctgggttcaagcgattctcctgcctcagcctcctgagtagctgggattaccagcgcctgctaccatgcccagttaatttttgtatttttagtagagaaggggtttcaccatgttggccaacctggtctcgaactg

SEQ ID NO: 52780 - DNA, 3278 bp, Homo sapiens
ccaccacacctggcccagattttttatatatatatataatatatactataatatataaaaatataaatatataatataaatatattataatatattgtatataatataaatatattataatgtatatttattatatattatatttatatatttaatatatattttatgtattatgtattcatatatggggtgtgtgtgtatgtttgtagattgtttaaacagaagtatttttttcctctgggttcttcttttaaaaaaatactacacaatttgagtcatctgagcaataaaaattatttttatgacaattacataccaaaaggtccttcaaacatttaatgctgaatctagattgcaaataaataagttatacgtaattgttaacgtttccccctagtggagctcatactgtaactcagccatttattttactatgttattagagtagatatatttgatattttaattaatttttgaaaactgttaaatgttcttttctcattttctcccaaagctttctaagagttcacctagtgaacccagtaatgctgttgctagtagtagtacggaacagccaagcgtttcaccatcttcatcagtattcagtcagcatgcaattggttccagtacagaagtacaaaaagacaatatgaaatctatgaaaataagtgatgaactatgtcacccaaaatgtacatccaaagtacaaaaagttaaaggtaaatcacgaagtattaaaaaatcttgttgtgcagattttgagtgtttggaaaacagtaaaaaagatgtggcattctgttattcatgccagttgttctgccaaaaatattttagctgtggaagagagtcatttgcaacccacggaacttctaattggaaaaaaaccctggaaaaattcagaaagcatgaaaaaagtgaaatgcatttgaagtcattggaattttggagagaataccaattttgtgatggagctgtcagtgacgatttatctattcattcgaaacagattgagggaaataaaaagtacctaaagcttataattgaaaatattttatttcttggaaagcagtgtttacccttaagaggaaacgaccagtcagtttcatctgtgaataaaggcaattttttagaattgttagaaatgagagcaaaagataaaggagaagaaacatttcgacttatgaattcacaagttgacttctataacagtacacaaattcaaagtgatattatcgaaataataaagactgaaatgttgcaggatattgtgaatgagatcaatgactcctcagcattttcaatcatatgtgatgagacaatcaatagtgccatgaaagaacagctttcaatttgtgtaagatacccacaaaaatcatcaaaggctatcttaattaaggaaagattcttgggttttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagtttactgtaagctggaaatctaaagttagaattactaggttaagat

SEQ ID NO: 52781 - DNA, 1017 bp, Homo sapiens
ggctgagacgggagaatagcttgaaccccaaaggctgtggttgcagtgagctgagatcgtgcaattgcactctagtctgggcaacaagagagaaactccgtttcaaaaaagagagaaaataggctggggacggtagctcacgcctataatcccaacactttgggaggctaaggcaggcggatcacaaggtcaagaattcaagaccagcctggccaacatggtgaaaccccatctctactaaaaatacaaaaaaaatgagccaggtgtggtggtgggtgcctgtaattccagctactcaggaggctaaggcaggagaatcacttgaacccaggaggcagaggttgcagtgagccaagatcgtgccattgcactccagcctgggcgacaagagtgaaactccgtctcaaaaaaaaaaaaaaaaaagaaaatagaagttaactctagtattgaatgtgtgttgcatatattttcattcttttaatggaagtgcttaaggctatgaactttcctctaaagtcagcttggtcaaccatgtgttttttcattttcatcattttctagctgtttttagttgtagtttctatcttgtcataaaatcaagaagttgggccaggcatggtggctcacgcctgtaatcccagcactttgggaggccgaggtgggcggatcacgaggtcaggagatcgagaccatggtgaaaccccgtctctactaaaaaaaattagccaggcgcagtggtgggtgcctgtagtcccagctactggggaggctgaggcaggagaatggcgtgaacccgggaggcggagcttgcagtgagccgggatcgcaccacagcactccagcctgggccacagagcaagactccatctcaaaaaaaaaatcgaggttggtgttcttgttttcattttcaagtgtttgttttctattcttgtagtctattatacagccaataatgtaaaaaataaacttacattaagtataacagctatcttggttgaatgcctattagcctattaa

SEQ ID NO: 52782 - DNA, 1073 bp, Homo sapiens
caaagtgctgggattacaggcttgagccactccgccctgcctgttaattacaattaatgccatgttctttcattcattaaaagatttttttttttttttttgagacggagtcttgctctgtcgcccaggctggagcagtggtgcacagtcttggctcaccgcaagctccgcctcctgggttcacgccattctcctgcctcagcctcccgagtagctgggactgcaggcgcccgccacacacgcctggctaatttttttttgtattttttagtagagacagagtttcaccatgttagccagggtggtcttgatctcctgaccctgtgatccgccctccttggcctcccaaagtgctgggattgcaggcgtgagccactgcgccaggccgattaataagatttctttggtattagttcacttgacagttatataatgttatgtttgagaatttggtaactctgattcttgtatcctttggagtaatcataccctttaattagcaggatcaggtgagctgtgtccagaaaaccaacgagaaggagtggaaggaggaatgaacgtttcattctcgttaataaaggcattatcctaattatcctttggttttgtttttgtttttttagtactcgtttattttctagaatttacctgacttcaacgtattcaaagtgacattaaaaaaaaaaaaagatggtctgtattacagacacagaaccagattaagtataattcaggatcctattgtgacttggcagtgctgctttcagtctcagttactgatcaatttttatggtccattttagatatttgccttcactgtaatttttatttctaaaattagcatgttatttagcaattactacctacatcttgattggatttcagacatagcattttgtatttccaacttctgtatgtacgaattataagatgatgtttatgagatagtcacacatcgcttcacaagtaagtatagtcaaataacaatatagtaatatccccttatctgcaaccatggttaaccacaatctcagagttattaatttttaaattgtgtgcttttctgagaggca

SEQ ID NO: 52783 - DNA, 11107 bp, Homo sapiens
cagtctcaaactcctcagctctagcagtcctcctgagtagctgggactagaggcacaggccaccacccccagctaattttttaattttttttgtatttgtggagatggagtcttcctatattgcctaggctggtgtcaaactcctggcctcctaaagtactgagattacaggcatgaactaccaaccctggccttaatccttgacttatgcactaacatttatattctgacatttagggaaaagatgtacttagtttttcaggtcagtcaggcaaaatacaaaggttaaatatgtcagtgttggtttaacacttaaaatcgaatacagtgtaagattatccttaataaagcctacattatttgccagaatgtctttagtactatgcccctaggctcactctaagcctttgtgttttttagtgctaacctagttcttaggtcaactgctaggtttcttcacattgaattctaaaagatgtggataacacttcagttatgtacctgatgggtatttctaggcaagaggaggaacgacgtagaagagaggaagagatgatgattcgtcaacgtgagatggaagaacaaatgaggcgccaaagagaggaaagttacagccgaatgggctacatggatccagtaagtcagcctttactgccttccaattggagttgtctatagaacttgcaggtacctagaaggaattacaggaaattttaatatcaaattacagttattttctgctttttttctaacaaagtatattatgtttgatttccttgtatgggtcagaggatttaattgaataggaagtttttttgtgttttgtttcttggtttttttgttttgttttgtttttttgtttgtttggttttttttttggagagagttttgctcttgtcacccaggctggagtgcagtggcttgatcttggctcactgcagcatctgccttctgggttcaagtgattctcctgcctcagcctcttgagtaggtgggattacaagtgcctgccatcaggctcggctaatttttgtatttttagtagaaatggcgtttcgccttgttggccaggctggtcttgaactcctgacctcaggtgatctgcctgcctcggccttccaaagtgctgtgattacaggcgtgagccactgctcccggccttgaataggaagttttgtaggtctttggataattgagtctaacttagttttcagaatattgatttcaaaaataattcacatgatgaacttttgaactttaccatgttttttatttaactcttgaaaatttctcagttcttaagaatgcttgctgtgggtatagtgcaggtatattgaaaggaatttttttcttgcagcgggaaagagacatgcgaatgggtggcggaggagcaatgaacatgggaggtaagtgtgaaatttaaattaatgatataagtagagagtagtatcctggtggagttgtaaccactatttttgttttctagatccctatggttcaggaggccagaaatttccacctctaggaggtggtggtggcataggttatgaagctaatcctggcgttccaccagcaaccatgagtggttccatgatgggaagtgacatggtaatgtatcctgtgggacgtagtaccaaggaaattctcattttcacaacttaggtgtgtttgttttgttttgttttgtttttttaagtaggtgactggacctcttttagtttcccctaccaatttcatacataaatatgtaatattgaggaatactttggcaacatagaagaactcggtgtgtggtaacctaaacagataacggttgccaacaaggagtcaatgctgttagtattatgtggaattacctttggcaataagtagatttaggtgcttttgaactctagtgcatggcaaatccaaattctagatgctagataatgtatctgattattctacatccaagtgagaataatcaaatggcaaactcattctttaagctggtatttgccataagtaggaatcagacttgtagtttgaagctttaggcacgttttagtgatgtgtaggactttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaaccttcttgatgctatcatgtttcagctgtgaatatagcctgtcagatgcttagaacaatcagttgaactggtatgagtggctgcattagggctttacaaatcgttaggactgaattttggtgggtttagagagtgcatttttatagctgagttgaatgtgatgagttcactacaggcttttggcaaaggaggggagctgcagtgagtagctcataagattcattttataaatagaaacataaggattttgtataaggcctcacctgtttataatctacctaagactttttgggaattaaagttagaattataaatggctggttgggtaaaatgtaatactatgggctttctttagatttttcagagtatgtgggtaacattttggtttatattcttcctaaagacagattgttaggtaatgtgtaaaatctaatttgaccttatgttctcacaattaaaggtttatattctagataacaggtagctgatagctcctgggttctcagctggtgtaattaacataattatgaaagccccaactttttcttttttttaagttcttagaggtagaacacagaacaatgagccaaaaaccctgtaatttataagattttgaaaaacaaaggataaaagtttagtcatgttgagtagctcaatagtattttgtttaaaagaatgttgaaattgtgtataggaacagttaaaccctgatgcccttttagttttttatttggagtaatactcttagtaactggtctattataaatggaatgagaaaaagtgtaggctgctgtgtttgcatacctgaggggtctgctatttaggcacatatgtttctattgaaaacttctatctccagaattacctaaaactagatgggaatagtgaagtcactcactgctttattgcagttactttagcttcgtgtttcactgttcgggaagtgtctaaaacatggaattacagcaaagtgtctgcacttttcaaagacctaagggaaaagatggactgatgaaggtgggtggggtttgttcatttagtttgcaacaatatagaatagtactgagaacgtaattgtctctggttatatagtgatggctcggaaggtagtgtgcctgtgagaatttggcaacataagtttttttgatcaagttactgtgccggttaagtgactaaatctatagtcttatgctttttctttttgtagtctggtagcattttattaaaactttcaaccttttaagatttctgcaacttagcagatgtgtcttaagatcttgaaaagcacaaggtttcttaagcagcacatgccactaactggtgagtaggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacttataatgaactgttaattactgttccaatagcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttccatggtgttgtcagttaattgtcaacttcattgaacccccttccattagaacaagagactttgactattaaagtagattgtttattgttgcctgttagtataatgggagcctgatttcccagtgtaaatatgttagaggaacagcttcctaacagtaggtaaagtaattgaatggtttggctttgttctgagttacgttccattcaaatctgtacattgtagaattcttactatggaatgtgtcttcctccttttcacctcttttcttggtgctaattggcaaaagaaaaattctaagtcaaacctttattaacatgctgaagtttagtattgtgcctgtgtacaaaaggagacctattgttggaacaatctgagcactttctgcataggaaacaggataatgctgaaagtaaacactagtgtataaaagcatctcaccaaatactggttgtatgactgacaggtacatggtgtgctaagggagagaatctcattagaaagtaatgctcattatatcattcaccagcacactcggaaatatgagtagttttaccatgattatatcagtgaggaagttttgtccccaaacaggttattaattggtgatacataagagattttctgtacggaaacaagggtcttgattagaaaggaatccattacagtttggttgaattatatagtagggactctactaaagacaagaaaataaggggtgttccatgggacacccacagagggtgaactttgaatgtgtgtgggtgggggctggtcgggaaatgggaaaatctgcctataaaattaatgtttcagtttatttttcagattacatgcctttctttataagggatgctggcacagaccccctaaaataagcttttggtagtactgtacctttgaagagtggtgaaggatgctaatggataatctcctgaaagttgtggcttttgatacccttactgtggactgtagagttgctaaacgttgtttagcaaataatgttgcttagtttcaaatgacatttgactttcatcactaaaacagcaatgtactcagggttgtaagcttactcaaatagactttcaataagtcttcaatgtatatatgatagtttttagcctaatgtgaatttaaataatcttaatagtttcctaaaagtcgatctgaaacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcatattgttaagaccccagtgtatttaataggtattttataagcatagcccattggctcatgttagtgaaaccataatcctctttgcttagaacattaaactcataagaagtactacaaaccccaccactctttatagatgtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctgctacataactgcatttagccagcatttctgcagtgcgtaactgtgaggaacgtagtaccgcaaatggcaatggacattaggacccggatgtagtattcctgcttgctccaagattctcattgccgactgcatacaggtaggtaacaagcaatataatctaacttggtgacttgtatgtacttttattccgtgggcattctggcatcacatttctgacaatgaaattacagtgcagcacctaacacttgtatggtaaagctagcttacatcaaaactgtgtgggtgtggggttagagctgtaatttgtcaggcagaattcagtgctgttgcagttctcagataaaaagtgcaaacttgattctttggtatatctgactcagttgtgtggtttcctttagttgcattgtaactgaagataacatggaacacatcagtggtgtgggggagagggaactaaactatacttgggaactagggtgcttttagcaccttgacatggaccgtatagcatgtgataattagtctctattgtagcaaactgacctgcccatagatcggcaatatcagtaatttcattatgcaatcttggtaattctacaagttgagttgaactaaaagtacaggtttttttgtaatgcgatttaaaatttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacattttaaagaaaatacagttttcattctaattcaggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaagtaagtttcctttagaaatcttaacccctacaggcttttgagtttgatttaaataatttcatttagatatgtggagtgaaacttcgatatttgagatgtttaccgtttctaagataatatccctttatttttgtttggaaattagggatgtatgtgagaaagcaagtgagaggcattataaaaatgtcaaacaatagaatttttaaaaagtggatggttatataacggtcatagaagaacagaaaagaaaacttgacttaaggggaataggccatattgtcaatattcaattcaattttagactccatctaaaactccatgattctttttttacttaagaaaatgtaggagaaggtcaggcatggtggctttacacctatattcctagcactttgggaggcagaagtgggaggattgcttgagcccagcctgggcaaaatagtgagaccatgtctctacagaaaaaaatatagccaggtgtggtggt

SEQ ID NO: 52784 - DNA, 1036 bp, Homo sapiens
ccatgcccagctaattttttgtatatttagtggagacggggtttcatcatgttggccagatgggtcttaaactcatgacctcaggtgatccacctgccttggcctctcaaagtgcagggattacaggggtgagccaccgcgtgtggcctacagtacatttttatgggtggaaaaaataagcctcggtaaggaatttggctagaggaaaacaattagaaaacgaggaaggtaggatttatctccagtgcctgcattcttttactgagtgttctgagtatttttgctgtgaagatatttatagatgaatcaggaaaatttttgccttttgtactctttacaagaaatagaacaggaaaaagatcagtactagggcaagtattttctggtatgcattcacaaatcggttcatgttaaaattttgtgtattgttagggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaaggtaaaaagacctgtgcgtgaacatcattgctaaggtcaattgtttttcaccttattagaaccttgttaatgtgaatccaaatattttccaatgttcagatctgatgagacgacaggaagaattaagacgcatggaagaacttcacaatcaagaaatgcagaaacgtaaagaaatgcaattgaggtaaaattgtgtttaaggtttaagccttcatttatttttttctttgaaacgtatcattctgttgcccgggctggagtgcagtggtgcagtctcagctcaccacaacctccgcttcctgggttcaagcgattctcttgcctcagcctcccgatcagctgggattacaggcatgcgccacgacacctggctaattcttcctgtatttgtagtagataacggggttt

SEQ ID NO: 52785 - DNA, 2247 bp, Homo sapiens
agcagcatcaccaggggcccccgcccggcgggcccggcggccgcagcgaggagaagatctcggactcggaggtgagtgtctatgggagcgacgcgtcggctcccctaagatggcggcggccccctcctcgcccccgcccccgcgctgggcttccattttgtcggctgccggaaggggcgcttgcgcgcgccgctgcgggggcggggcggcctgcggggccgtcggtcggcgggggattggccgccgccgggccttgctctcccggcgggcggaaggctaggggaggtttcctttcggaaggaagcgcggggccgcggtggtcggccctgcagaaggtatcctgtccctgggactggcgtaatgcagagcatgcggcgtaggtttggagagaaccgggaagttccataaaagcgcaggcgcagatcgtgtaggttacagtggcatttggatttgtgttattttcctattttaattttcatactatttagatttttttagggacactcaacatatgtgggtgacagttgctgatggacgtctactctttggggaagtgtgtctattctcgaacattctggatgatggggctcctttttcaatgttaagatagtgctcatgttagaaatctcacatagtaaaaccttgattttgaccaaacggaacagaaaggcaactgataggtttcagataagcaaatactatcttggggattttcacttgcagaggtctctggtgtttgaaaacttctttcctttttcattaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgtgagtgtaattgtttgattttacgtagaattaaaaagggtgggggatttttttgtcactacaaacgctgaaggcttggtttttaaactggggaggataaattgatcttttagatttttcaccattcttacaggaaaaatgcttgcggtataatgcataattgttgctacctaagagaaaagaggggtggggtgggtaaactaagtggtgttagtgggtgctgcctaaaggtaatggtcgaactgagctgaaggaagaaagggagtaggaagtaggcctatgacaatttaagagtagacatcatccaattttgaggtcattaacatgagtgtctctgatacacaggaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacgtaagttgtcttgtttattctaataatttctatcaacttatatgagaatggtggcaataaaactggaacaaagctaagatggaaccatttttgttattagaactcctcgtccagtcattgtggaaccacttgaacaactagatgatgaagatggtcttcctgaaaaacttgcccagaagaatccaatgtatcaaaagtaagattgattaaacttttttggcagtttttaaatcaagtgtaaaggttaaatttattttagtgattttccaattttgcttaaaatatgcaaaattatttgatgtggatatgcttattagtaaaaaatctcaggctgagaaagatttgaagctgttattcagatagctgtttgcttctaaggtggatacattcacatgcagtcctgttttgtccctgcaataatggcataaagtcacgtgtgtgactgagtctctgttgcccaggccagagtgcagtggcatgacctcagctctctgcaacctctgcctcccaggttcaagcgattctcctgcctcagcctcccaggtagctgggattacaggcatgtgccaccatgcctggctcgttttctatttttagtagagatgggctttcaccatgttgactaggctgatctcgaactcctgacct

SEQ ID NO: 52786 - DNA, 1051 bp, Homo sapiens
ttctgattttgaatcggaaaacatctgtttttctgggcaaggatatcagtagattgctcctagggacaatcaagaaagaaaagagacctccaacgcttctctgcaggagcggatagagccctggttatttgctcgcaagtgaaaattgccctggcatacccattcaaatttctcctagcaaatcatagtggcctacagccaacgccttcttcgctcactggccaactggaaacttcagtccccccatgcctcccgcctctcacccaggggccaataggaatgatcagaggttcgcaacttagtgtcatcaagcatagtaattgcaattggctattggagctgtcgatcgtggagtaggcggggccgtgccagctggcctatataagacgaggacaaaggcggcgcgccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggag

SEQ ID NO: 52787 - DNA, 1274 bp, Homo sapiens
ggagcagtcatacacccaaccgcctagatcctactgttaacattgcattccggacatgcacagcggctcacgcctgtaatcccagcactttgggaggccgaggcggcaggatcacttgaggccaggagttcgagaccagcctggccaacatggtgaaaccccgtctctactaaaaatacaaaaaattaacccggcgtggtggcgggtgcctgtaatcccagctattcgggaggctgaggcaggggaatcgcttgaacctgggaggcggtggtagcagggaggcggtggtagcagtgagccgagatcgtgctactgcactctagcctaggtgacagagggaggcactgtctcaaaaccccctccaaaaaaaaaattgcattccacttgttttatcatatatttacccctctatccctctttctgttcatcagtcgtgttattttaatgcatttcatcgtagtgttttgaacaataaatttttaccattgataagtttacgaaatgttggattcacctaatgcaataattagtcatagagcaagttaagctgtatgatggtatgtccaaatagttttgtaagtataaatgttgtgtatggaatgcatgtgttttgaaattttaaaattttcaagttgtgttcagttttgaactagatccttactgtgcttggatgaaggcatatggcatatagtccaccaatgaaaatatacagggtaaattacttaagatatgtaatgttaattcagggagatttctgcatccagttgctgtgaatgttgtcattcaccttctgtactaggatgttctaggatattctagaaaacattgatgtgtgttgacaacaaattcaactagattttaaatatattctgcctcttgtcgtacacttaaaagatgttactggtcttgtgaatcttctgctaaaggaatgctggaaaaaaaaaaaaagataccatactggtagcagtaaaaactttattattattattatttttgagacagagtcttgctctgttgcccaggctagagtgcggtggcgcaatctcggctcgttgcaacctccgcctcccgggttcaattaattctcctgcttcagcctcccaagtagctgggattacaggcaagcaccaccatgcctggctaatttttgtatttttagtaaagatgggattttgccatgttggccaggctgatctcgaactcctgacctctggtgatcagcacacctcggcttcccaaagtgctgggattacaggtgtgagctaccgggcctg

SEQ ID NO: 52788 - DNA, 1068 bp, Homo sapiens
agtgcctatacatgaaggcgttacagcaagcatcacacccacacaaatacatacacacacacacactttaaagttggcatattatttaatttttttagatgataaaatttttgttttctcaaatagcttttaagactcattaggtaggcttattataaatgattgaattatttatgcatggctattataataaccagtatgttatgaagtatgaggtctaactaaatcgggcggccatattttgttgtaaaatccttgtcttttcaaagtttacatacaaaataataacttttgtaaatgtaaatattacccggtctagtaaattgtattcattttcatacttaaaattctgtgtgtattaaatttgagatgtatatacctggtatgcttaaaaaagagagaaagcatatgtataagtagtatgcttccattttttgtgaaaaacaaaacaaaacgacctttcttgcctccccacatttgtgtctgtatatgcttgtacatgtatgaacttagagaaaattgtggaggacacagtttgggatattaccactgattaccttcagtgggtagggaggagaaacgaaagagagtataagggtgcaaatttcacaaagtggaaaaagtattcatggtataatgctaagtgaaaatgtagactataaaatgttatctattaatatataaatctgtgaaaattgaacacacatatagacagtagaaaatacgaacaaatgaaagcattgacttcatgatgtgatgggatatggagaagttttattttgaatttctgttattttaatattttataataaaataattgcaaaagattgatccctcttaattccttaattaactttttctcttttctgtctttttgctaaatgtattacttaaaaacatggcggtacatatcattacaatatttgcggtttatatgtatgcaatgtgaataatttgcttttagaaagtattgactctttgtttagagaccatttgaagaggccattcaaatacagtgattctgcattgttttcacactgcttcccatcttgtaacacacagagggat

SEQ ID NO: 52789 - DNA, 1114 bp, Homo sapiens
ctttttctttctttctttttttttgagatggagtctcgttctgtctgccctcactttcacacaataaacttggcgagactgaattcaactaattttgtaattcagtttgcacaattaaattttgcatttgattttcagcaatatcaacctgtggttatataagaattaagattattaatacaaaaatgagccaggcattttggcttacacctgagggtgagatgggaggatggtttgagcctgggaggcagaggttgctgtgagctgaggttgcagtgagccgaggtcacgccactgcactccagcctgggtgcttgtcacaaaaaaaaaaaaaatgtatatatatttttaaggttatcttgaaaggtctctctttctctgactgtgacttgagctgacttaacggacctgaacttgttattttcatcagaaatgcagaagagcacttagagaattcatctcacataacagactttgtagccatcattactgctttactagttaagtgcaacagccatttgggttcccaaggtacttgctttagttggcatttcatcatcaccaaccacaggtgatagcctgattaactgtgatgcccctgcatatgtgggattattaccaaactagttcctgcttgagccctatactcaagcctaaggacacaacgaaaagcaattctgaatcccatttttgtgtgcctgtctcctatgaccactgccactaccagtcctgtatcagaggacagaaaccacacagtaatttgaatatggaaagtttaacataaagaattatttaccattaatggggaattaactctaaggcttaaagagaatgctaaagatacagaataacagtagagggagcggccactgcctctaggtctgaggcaaagttaacaaggatggaataaatctggatgatggccagcccaccagcttcaaggctgagattcagatcttgttggagaaggtgtggtccactggatgctggaaacatctgaggtggggcaggcttttgctggcaattaaaaaatgcccccctggggtgccaataaaagtcagtaggatggtgagtccctcatctctacgaaaaataaaaatattagctggacata

SEQ ID NO: 52790 - DNA, 1008 bp, Homo sapiens
attacaggtgtgagccactgggcccagccaagaagttgcttttttataagttacttgtttccttctggagtggtggttctgtttgtttaccttgaactttctctttcacataggtttcttttggaaacctgggatcttttattttctcttcatatttatgaatatcagatactactgattactatagctagctgttgtgtttcctctacagttatgtaggtagctaggtagttcttttttccttaaaagtctctcccttgaatggggtggctgattctggcttcttacagtaggcaaggtttatcaagaagcagcatttcttgtgttcttgcctcactgatgagtaacaggcagggaagcaggaacctccaaagtaaggaggccttcagagactcagagtgaagtgtgccattttctttagttctttggtggagttaccggtgctttgctttcttttccctctgtgtttaaagatctgaaattacctctgacatggctctacttctgtcttaggcactaacgtactcagtaggaaccatccctataacaggcctcactttcaatttaagagcagcatgtttttggctttagcttaagagcaaaagctgttaatttttctgttcagttttgatgggaagttttacatagttctcggtgttagtaagttcttatgaagcgttagctgtgtttactgttattaaaatatatatgatcatctcttttgtgacatgaatgattaaaaaaataagtagttgtttatagtgagaggatgtgatttatctcttagtttttggtttggggctttggtctgagaactactttggttcatcctaaattttattttactctatttggcaatgtttttgtttatattgtgcacttgtcatttgggttgaaaattacagctccttggggaatagggagggataccaaaagaatgtatgatagaagatatgatggtaatgttactttttccttttttgcttttccagtttgaacaaaaaagtg

SEQ ID NO: 52791 - DNA, 1578 bp, Homo sapiens
ctgcaggatgaatttgtaaaagttgaattgttgggctgggcgtggtgtcaaacgcctgtaatcccagcactttgggaggccaaggcgggtggatcacctgaggtcaggagttttgagaccagcctggccaacatggtgaaaccttgtctctactaaaaatacaaaaattagccgggtgtggtggcaggtgcctgtaatcccagctactcaggaggctgaggcaggagaatcgcttgaacctgggaggcagaggttgcagtgagccaggatggcaccactgcattcgagcctgggcgacagagtgaaactttgtctttaaaaaaaaaaaaaaaaaaaaaaaaaaaaagttgaattgttgggtcaagagttctgtgtattcaaagtatcaaaaacattgcctaattgctctttattagttttgtaccagtttgcattcctaccagcagtatttgactgcaggggttggcaaatgtttttctgttaagggccagatggtaaatattttggactttgcagcctacatatggtctctttcaaaaacttttctttgtatatattttagtcttgggccatagtttcctaattttggcctataatatagctgcaagactttattttttatttttatttattttttatttttgagacagagtctaactgtcgcccaggctggagtgcagtggcgcaatctcggctcactgcaagcttcgccttccaggttcacgccattctcctgcgtcagcctcccgagtagctgggactacaggtgcccgtcaccacgcctggcttctttttttttttttttttttttttttttaagtagagacagggtttcactgtgttagccaggatggtctcaatctcctgacctcatgatccgcccaccttggcctcccaaagtgctgggattacaggcgtgagccaccgcacccagccatctgcaagacttttatcaaaactttttgtcattaccaacctgctgtgtgaacgtgatatctcgttttattagtttgcatttctcttgttgaaccttagtattttgctctctctgaaatatttgtttgagccctttgcttttatatgtgtatttggttatttgtctgtatctttactgaactataggtcctatctttatcttttaaggaaattaccctttgtgatatgaaataaaaccttttaaatcagtttatctttttatctttttgatttggtttgtgttttctcatctctagccatttttaaagtcacatttgatcttttatatttttatttataacttgatcttttattctggatttttttggtcattattagaaaggcttgtctctgcgactcaaaaataattcttccatagtttctttaatattactaaaataattcttccgtagtttatttaatattactgttttatttctttatgcctaaaacttagatacatctgtaaaattttttgatgtgagttagggatctcatttttccatatgactacccttttcttcaaatactatatcctgaatttaaatgtaatgataaggggctgggtgcagtggctcatgtctgtaatcccagcagtttggc

SEQ ID NO: 52792 - DNA, 3912 bp, Homo sapiens
ttattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcaggtaataattgttggacttagaaccataaaacacaattaaaaattaccgatcataatatatagcttttattacttttgatgttaagtgaagtatgaacggttaaattcattgtaagcttgtcatttttcttttgtccttgttctttgcagagtgactgaatttctcccagtaacttttggtaatggtataaatggttgaaaatagctctaaacctcatttctccctcccctggttgcaatgttttgatgagaaaggcaagatacttgaatcacctgttcattttctttggttgaacattggaacctgaagttggatttaacttctttgtgctgtaagcactaattcaaactgctgtctcaccacttagtccaaattagggagttattttatttttttaattttaatttaattttttgtttattaactctcacctctatctgaaagggagtttttttttaataaaaaaaacccaaacatttctaatttatgttttagaagtttcttgaggttcctcctgagcctctttgcccagtgtaccctatactttagctttagttaacattcttgaatatatcacatatttccttctatgccttcctttcctcctgctattccatttgcctgcatgtcattttctctctgtatatttgcttgtgaaagtacttcttatccaacaatgcctaactcataaacctcttctactctgtcatcattctaactgctctacatcaagaatggtttccttatctatatttccacagcattttcatgcctcattatttatagtacttatcacacagtattatagttctatatttgttttaccttacctactagtgtaggagttgagggccagattgtatcttactcatctttgtattcttggggcctaacctggtgtagtaaaatagtaattcttcaataaatgttcaatagctgtgaaggaaagcaagtattctataccagtccttgtatttcttctaacaatgctaggaaatgtatggtagaaagaacaaaccagtattgttaaaaagacagcttttgagtatgtacaagtctgtgcaaggatatactatatttttctctataattcagtatatatttccaatatcccttcttggggtatgagagtcatgtttctcaaggaacataatgtctagtagtagaatggacaagacaagtcaggccgtagaagtgccaatgtccagctgaatagcgtaagatttaatttacagttaaagacagtggtagaagagtttgtcataaggcagttcaaaaagatgtctttcaaataactgaaactgtgttttagggattcttagaagagagatgatttttaacttagtgaacagggaaggttttatagaggagaggtgaatttttaactgagctgagtctggaaaactgtataaagattaggatagacagaggggacttggaatagaataagtagaaatgggggagaacaaatgcaagcaattttcagagcaaaaataatttttttttttttttttttaggtttgagcaaggaaaaaatgtagggtaaggctaaaagctaggtggggccagattgtgcagaactttgagtgaaaataccttttgggtgtttttgggacccagttcactctaacgagcatctttgttggaaaagagaggtgattatcaaatgatagctttttaggtcactctttgtaagatttgttattcatatacatgtgtttgtttgttttttttttcctttcaatagctaatcaagttgaagaaacattacatacccatttaccacaaaccccagaaacaaactttagggtaagttttcagtgtgtatgtagattgctgtaactgtgacaagtgtcaaagttttctttatgtcagtttctaaattctaacaatgtattaggtagagcactgattttttttttttaatttgcttaatatttgtttaaggtcatcatcggagacattctaaaaagcctcaaatcttagggtctttatttgtatttggtatttggacatataacacaattacttttaggcgtaggcataagatccaaaagctaatgaatgtccatagagttcttcatttccaatgagcttttctttgggtgttaaacctgaagaggaatcattttaaaatctgaatatttattaatcctttatattgtgttttaggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagtaaacatttcaccttttttccccccttctttttgttccacacattgaattattcatttgagagaggaagtgcttaagaagtgaaatagtttgttgacagggtgaaaggaaactcttaaagaaggttgaggcgatttgaattaccatataaggcattaacgagctatatgaaacttttcctgagtagtaattaaggcttttaatcatctttgtttcttaataccactgtgatttttgcaatgcattttagcgcaaggctttgagaactatacagcagatatggttgaagatttatggtagtttataagtttgtggtgcaatcaagtttatgtaggatagtaagccttttgcagttaatgctaatgaagtacaggctatatatggatttaaatatttttcaggaggggttaatggacagatcatctttggaagggttaattgattgaagaaccagttcattggattagtggatagaaggtaaaggaggctttgatgaatgatacatgattccaagtttgagatctgtgagtaataagagtgaaggtagagctctgctatttcaaggttgctctggagataaaatcatagagatcttaaaactgtgaggtcctgaagtcagctaagctatccatgcagttaatgatgttgctgttgttggaatagaagaaaaaagttatatcagatgctgcaatcattttgaagtgcaagaaggggtccaagggacgaatatgcaatagcagcaattatttgagggtatctgtgttttgtaaagatggtatgaattggctctttttctgaaatgacatttaatctgggggaagcttatattttcctatctttctgtttatattagaaggtttgagactgtcagacttctgtggaagtgctttctttttcttttctttctttttgttttttctcttttttttttgagacaaggtcttgctctcttgcccaggctggaatgcagtggtgcaatcactgctcactgcagcctcaacctcccaggctcaagtgaacctcccagctcagcctcttgagtagctgggaccacaggcgtgtaccaccacactggcgaattaaaaaaagatttgtagaggggccagacgtgatggctcacgcctgtcatcccagcacttggcaggctgaagccagcagatcacttgaggtcagg

SEQ ID NO: 52793 - DNA, 3295 bp, Homo sapiens
tcactgagtcaaattgatgctcagttagcatgaattccatgacgttcagtggaagttggatgtgttagggtagtgataaagctataggagttggatggatatgagtatacttgctacaaagaagaaagtagaaggaatataaatagatttttctgttctatttaaatagaaggtaaataaaagcatgtttatagaagcaggtaatggagatcttagatatctgaattagggataaatagatgtcccaacacctggggaaagttcatgtggcagtatatgcttcagaagactacagccatgtctatatgaagggcagatcttgtatctcttctcctgccccaatgtgggcatgctggcagggtaccaaaatcatctctttcttttgtacttgaaccatgtgacacttccttgggacaaaaaggcacttagagcataaaccaaatacaataggggtagagaacactgagaaggttattagtattgttgttttcagaacaatcagaggttccagtggctggagaatataaataggatggaacagatagaaacacttaaatttttatatacttattcagaattataaaatgtgttatcaaatactgaatatgaatatgaagtttcatcatgattatgggaagaacttccccaaaggcttactccctgattgattggacttgagaattaagcagtaatgtgagtaggtcctgggcataagatccaaaagcattctttaccctgaccccacaataagggacttgtagtatgtgagtggatagagctaggttttccctgaggagtcctttttgttgtcagcaataccagtcctataggatcagacctttgataattcttctagaaatcccccagagcagctctcatgttataaactagatatgtgattctttccttcttttctttttcttgtcttttccacacccgtctccaccttccctccttcttttagaagagtattgcctttcaaaattgcataatttattacttttattcatttcccatggactggaaaagagaactctagtgtattatattattagtctcaaaaaagtactattagcctctcataaaatactgatagattttacagttgtggtcagtgtttacttttgaccatcagttaccagtaacttctttcatggttcaataaaatcatagctttagtttatggcaccttttcaaaacttcctttggcttttctttgtgcttaatttaggtagttttgcttttagctcacttcctaattctcttttttacacaattcattttggtcctaatttctttactttactatataaacaaggtgctgaaatgtgtgtgtatgtatttaacttcctctacccatttgctcttggttatttcttcagttatgatattctggatttgccagtcattgtccgtcctcctgcctctattactggcataatgtcattgggtctcacagtttcatttcttcattctaattctattgcatgtttctataatgttttctgtagtatttttacagttacagatgcttttacacgtactgtgttgcttaattcgcctaacaaccctgtataagatggccagagtagaggatgttaacatttataggtgagagagctgagagatatagagatttagttactcaagccctcatggccaggaaggagccaatctggggtcataatcaaagtcttttttttttttttttttttttttagtctaccaatctttctgtaaataaaagttgtttaattttaaaaataccaagggaaggtttcaaaatagatactttaaagagagccagagacctcattttcctcttttgccttttccatagggtctaaaaactgtacattcagtaaatactacattaaagtcatgatttctttttcttcttgttcataataatagaggacgagctaatgtgtagtctctcattgaaagaactcaattaaaatgggaaagcaaatgaactaattgtcataatagtcattcacacagttttggaaagaaaatgtagtaattcaaatgttggggctcttttagccatattgagttaatttggcaatagaaactgtgttattcatttctaaaatactttcatgggatattaatattgatcttcatttgtagtaaactaagaaggtaaaggtattggtaaaggaatttttttgtgttttggcatgtgtttttctgcttctgaaagcttttgggttaccaattagatatttacttctcagaaaatatttattagtatttggctactcattgatttgtttatcaaatacttgtaaaattagtgatcatgggaggatccaaacataaaccaaacatgattgtgccttgaaggcattgtggaccatacaaacagtacttaagatgtatactattttactatattacataaataatacgtactcaaggctaaaggaatccagcagaagtttgcaatagccatcacagagactaagagagctgactgcagaccgttaatgtatgccaatgagtattggttgtttctggagttttctgagattaaaataaaaatatttaaggaaattttctttaatacactatataatgaaggaatgtcatgattagtcgatgttagaaaatcttttaatacatatatttcatcagcaggtcaaataagggtatctgtaatagtcactttattagatgccaaaagacatctcatgtaattcagacatttcttagaatagattttttcttgatcatagtaaggaactactacttcagatcagtaacagttattgaagttgaagtaaaatgatggaaatcttctgttaatattactaaaagaatacaagttgcggatgtcatcgttattatttaactcttgttggatttttacttcaatccatgttaaagaaattagaagaaaaaataatggaaaaagggaaataaaattatcacttgctattaagaatatttatgaaagaattaatagaattcatgaaaatttagtggagtacctagttgaattataccaatacttctataaataaacttcccagttagatgatataatgaaaaagatacactattcccagcagcaactaaaaagtacttatatcaaatacaacttgaaataatgaagagaccatctttttaaatgtaagaaatatgtagatgtcagttatttttaaattaagatttaaggccaggtgcggtggctcacgcctgtaatcctaacactttgggaggccaagcggggggcgaatcacttgaggtcaggagttcaagaccagcctggccaacatggtgaaac

SEQ ID NO: 52794 - DNA, 1523 bp, Homo sapiens
gagtggtttggtgggattagggttggagtggtaaggagccttaatcattagggttttaatcttcaatgcctttgttactagtgcttagaaattaaattatttagatatggtaatgttatattttatataactgtgctagaatatgcactgtgtagtgtaaaatgtatgtttacttttaaaagatactaatttttgacaatgttaaatgtaatacagtattttttaaagaatattttgaaaatacagataattctagaaaagaaaaatctcgtataatccctcctgtagagataatgaatgctaatcatttgatgttttccttttagtctttgaaacatactaattctcataacagttctatgaagtaggtgctgttaattccacttcatagaaaataatttaaggatcaaagcaatttttaagtgtctcccagaaaattaaagtttttaaacttaaattccagtgttatttccctacagtataattgcctctgttttatttagttattttagctcacagaaaggaaaaagaaatgaattataccatggcttatgttatttttttcttatttttagagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttgtaagttaccattttcctttattggggcaggagtctaatacgtttgtgcttaaagaacagcttttgatgctctctgctccttgtttttgtgttgctgttatttaatttctagattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcaggtacatgaccatatttaatcttgatgtctttgttcagttcaggtaatctgtatttttagtcagaattatttatgaaaatgttgttttgcaatattgggtttactggccaagtgccatggctcacacctgtaatcccagcactttgggaggctgaggcgggcagatcacctgaggttgggaattcgagaccagcctgaccaacatggagaaaccccatctctactaaaaatacaaaaattagccaggtgtggtggcacatccctgtaatcccagctactcgggaggctgaggcaggagaattgcttgaactcgggaggtggaggttgcagtgagccaagatcgtaccattgcactccagcctgggcaacaagagtgaaactccgtctcaaaaaaaaaaaaacaaaaatgtatatatacacacatacacacacacacacacacacacaca

SEQ ID NO: 52795 - DNA, 1023 bp, Homo sapiens
atgtaaatatgtatgtgtatatatatgtatatatacatatagagagagtttactatttgttttaactggtattctttatacataagtagtatttgttgaataaatgtgcattaaatattcatacagagttctataagtagcagttttattcatgcatttgtttatacacgtttatgcatttgaaatacaagtttttagagtgtggctttttttttttttgagatggagccttgcactgtctcccaggctggagtgtgatcccggctcactgcaacctccacctccctggttcaagcgattctcctgcctcagcctcccaagtagctaggattacaggcgcccaccaccaggcctggctaatttttttgtatttttattagagatgggatttcactatactggccaggctggtatcaaactcctgacctcaagtgatccacctgcctcggcctcccaatccctgtgctgggattacaggtgcgagccaccacgcccggccagtatggcttttttatttcaaaagtgatttgtattctttaacaatattttgaaagttaaaaaaaaacatgaagaaatgcagtgtatctctcacagataacaaatcctgtcattttggtgtatagccttctaatctttccagcatgtgagatttgcatatatacttcttatttgacaaggaaaggttcaagttgcatatgtagtgttgaaatctgattcacagaattaaaattgcaaaccagataatcaaaattatatcattaattgttacagtaagggatttttcttatctttatgaaataggaagaaatagatgtggattatatatttgtgaattgatgaggtgtgcacgggatgaactggatgaactctataacaaatgtcttttatgtagttttgtgtgtattagatttgtattttattagtgaattttgatcaaatattagttttaaaattgataaacctaaaggaatagtaaatgctatatatatttctaatttttaatttttgtgggtccatagtagg

SEQ ID NO: 52796 - DNA, 1281 bp, Homo sapiens
taattgttcttaaaaccttgtagtaattttggaatttaagcgtgtttcaatttatttcctgttaatgtgaaaacacactataatggctaagttttactattcattccttatttttgttctcaaagaaaaaaaaaatccccacatcttcattgttttgtcattttccaaaagactgttcttttcctgatactgtatcaggtactaaaagttacctggattcagtccattgaaagatgagtgatagtccacaagagagggagaaataggatgaaacatcttaattttaaatttattctttacttttaatttagtcaaaacctattaaatttttcatgtattatatctgctgtggtagagaaagaactggaatttagaagtaaggcagatctacatttaattctagaccttatgttcaaatacagttttaccttggggaaagcagttaagctccctgagtcccagtttttctgtctgtaaataactatgataccacctatgtcactgggatgtttttaggattatagaaagtaagaatgaaagaatgcctagtatgtaactgaggcattgtagatggtcatttctgctaccttcctttcttccttatatataattcattcaacaaacattagatataatttctgttttgaggggctgcctgtctcctgagaaagataagacgtataaatgagtaaatagagatgctatgatggaagtattatgggtacagtgggccacagaggtagcatagtgagctctacttgatagggaaagatgagactatcagcagaagcttcacagaggtaactcttgatctgggtcttacaaatgaggtttgcttttacagtcctcattagggaggagagggaaatggggttagagatttagaagacattccagaattcaggcatatattcactttactgtgtatttattttaatatcaagttttacaaattgattctttaagaaggaagattgctcttaaaatctcctaattggtgctggacgtactttaaaaattatcctgaatgtgtgacatgttaataatacttagcattatttgctgctgaatccctaattgggtgaagacttaagataacggactctggttgtttgtatttggacacctgtgatgatatcccaggtttgctcttactttacgcttatggagtattttttttattattagtggtagaatatttgccaataagttgcctaataaggttactaatttccttaaattcatatttacaagcacctttggagggggttatttcaattt

SEQ ID NO: 52797 - DNA, 1050 bp, Homo sapiens
ccactatgcctggctaattttttttgtatttttgtagaggcagggtttcaccatgttgaccttgctggtcttgaactcctgacctcaggtgatccacccacctcggcctcccgatgtgctgggattataggggtgagccactacgcctggccgcattactttttcaatgaaatagaatagattggaaaatatcaaagtgcattacatgttatcatgatatttattcctctataaaactttttagttttattacatacatgcatcatacacaaatgcaaaatctcagaagtacatgtgtaccatgaaacttcctattgaggattacaatcataaaagtttgaaaatcactgatttcaaatatttcaaaagtgttgagtataaacatttcgaagaattatgcttttactaggaatttgttaaaaatgaatgttgttttattctcttaatagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtaatattggtttcacaaactatgaaatgcaatggttgaaaaataatggttattgctttgtttttaacggttttttttggttgatttttaaggcacatttaacatatttcagatatttgttgtaaaatatcacctgttaccttgattgcttatttatttacttgcatacctatttatgcatttcccccttaccaaaagaatttcatatggcttctttaatatattttctttttccctacctaatttctttgaagtttcatttatctggtagtttcagggtagactttgaccaatttaaattggaaagaaacattttcagtattatgttagtttttgtctatatgtgacatgatttagtttcagttcctacaacttaccctggctcttaaattttcttatattgtatagtattatttaatttctcatacttttgtgtacatttgtacatat

SEQ ID NO: 52798 - DNA, 1049 bp, Homo sapiens
gttttgtttttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataaggtaaagtatagcatgttcatgataagattttgagtatacgtgggtctatttgtaaaattatttttaactttgcatctctcaaaatcataccatttgttttgaaagtaagggagataaggagttccataagacaaaccaaatgtttaattagtacttaatgattatttctttgcagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggtaaagacagaagattatcttacctactgagcatgttggttgttttaaagcagttgatgatgatttaagctttcactgtctaagttaatctgttttattgtttatgtataacgtaaatgccttttcgattcatttacacttagttcattcttttttgatctagttttcttatattatgtagctgttaaaatgaagtgaaagatttgcaaagtataatgcagaagaagatgatgtgaaaaacatttaacatccttaggttccccattattaggttgatcgggacctcaaagagcttctagttcgtgtacttatttctaaatgggatgccttaaattatggtaacattctaagtttatacttttattgtcttaaacagccattatatttctgaatataaatggcttgaatatgcaaattaatatgtggaagatt

SEQ ID NO: 52799 - DNA, 1013 bp, Homo sapiens
agctgggcgcggtggctcacgcctgtaatcccagcactttgggaggccgaggcgggtggatcatgaggttaggagatcgagaccatcctggctaacatggtgaaaccccgtctctactaaaaatacaaaaaaattagctgggtgtggtggcgggcgcctgtagtcccagctacctgggaggctgaggcaggagaattgcatgaacccaggaggtggagcttgcagtgagctgagatcacgccactgcactccagcctgggcgatagagcaaggctctgtctcaaaaaaaaaaaaaaatatatatatatatgtgtgtgtgtgtgtgtgtgtgtgtgtataatcattgataaagacaaactaattttttgatctaaattctaagttaatttcgtcacttgttatgtgtgtcttatttttattttgtcagaccacagataatttgtttcttactccttgactaccttcttctttttagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcaggtaaaattaaccttaggtactgaatggagtctttggtcaatactaggaactactgttcttttacagatcaggaactgtgtaaacagttgtcattaatttcatgaaacctcagtttccttgtattctgtatcaataacatttagctttttttgttgaacaccttatttcactgtcgtccgtgtgaagagaccaccaaacaggctttgtgtgagcaacaaggctgtttatttcacctgggtgcaggcggtctgagtctgaaaagagtcagtgaagggagatggggtggggccgttttataagatttgggtaggtaaaggaaaaaggggggttgttctctggcgagcaggagtgggggtcacaaagtgctcagtgggggagctttttgag

SEQ ID NO: 52800 - DNA, 1003 bp, Homo sapiens
tttgaggatttgcattgttggtttttaagttggtttttaagttagactatttgttgccttttttatgtaaagataaagttaatagaaaactttcaagttttactaattaaaaagtagaaaaccagggtatggtggctcatgcctgtaatctcagcactttgggaggctgaggcaggcggatcacgaggtcaggagtttgagaccatcctggccaacatggtgaaaccccgtctctactaaaatacaaaaaattagctgggtgtggtgctgcgcacctgtagtcccagctacttgggaggctgaggcaggggaatcgcttgaacccgggaggtggaggtcgctgtgagctgatatcgtgccactgcactccagcctgggcagcagagtgagactctgtctcaaaaagaaaaaaaaaaagaagaaaaccaaaacccagttaatcctaaagtgactttttgctccaacagaaattactcaaacctgaaaacattgtttaacttccttgaaatggtttctgtgtaagtacatataaatcacgtgaggtttccttatttttgtttattttaatcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtatggcttgattggaaagcatttatctagcctatttaggttgaatgcagtggtcccctaacttcctttcatcagggattattttcatacatttgacacattcaatattaggaatagtggcttgctgcacaagtttcatatctcatactttagaattgctagtttcttccgttgaattaaaaaaacacatgttcttagtatgagggtttgtgtttatgtactgataatcagcttttaatgctaatgttaaaataattgtaaagatcctaaatttatgttttaatttatatc

SEQ ID NO: 52801 - DNA, 1096 bp, Homo sapiens
tctatccttggtctttcagatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggaggttggtatactctttaaaagtaaagaaagaaaaaacacgttttacacattttcaggtgactcaagtaattttaagtataagacagggtgtttctaaaacctttattgtctgtgaataccaagcctgtggggttgattacactttttagtgcttctgaaagctcttattgtttttatgaaggaaaaccaagtattggtattcaatagtttttagttatgattccagaaaaataacttagaaatcaagatttcatgatcattttccaattccatctctgtaatcaaagccatggtccccacataagaattcctgttatataataaccagcatgctggtagagggtaaatagaaccttaggatggaaaaccatttggctcaaaataactgatagatagatctcatactactagtgtggaatcatgataaaaacaatagttaacgttttgtgtgcttgccatactctaggcattgtgctcagtgcattgtgtgccttgcctgattcaatcttcatgacagccttatggggtggggagggggtactatgtatctcaaatttctgatctggaaagtaggatgttagacttgccttggttatgcagtccagaagtggcggaaccagaacttgaatccagatacatctgactccaaagcacatgatactaaccagaatccccattaacagtggtaatctgtttaactgcatttatccctaatgtctaattttgttaatgaattattctttctgcatatgaaatctatttacttagaactttgtagtatgattgatgtatatagtgcagtcatttcatttgagatataatttgttgtctaaacataaattatttatgtgcttttctttttctttagagtcccaaacttctgaacacgaactctttctagacaccaag

SEQ ID NO: 52802 - DNA, 1593 bp, Homo sapiens
ggtgagtctatatctggaacatagtaaatacccaaatgttagtgattattacagtgtgctcttctgcatttaaactttttctttcttccttcctcatatggattggattaaataatctctaaagccctttcttgctctaagaactctgaatctttaggatataaaactaaattctttattctacaaatgtataccctttccagctttgagaaccctgactcttaaaaatccaaaactaaattttatgttctgtaaatttttggaattcttacagggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggtaagtgcacagcatgaattgtatcttgatttaggtagggggaaatatacagataatctactgaaaagggatacattttaggtcaaaaaccccataaaactttggtttgggctttacttaattttttccgcacttttattttatttaaacttttcttttatgtttctctccttgtcaggggttgaacaggcctcatctagcccacgttctgaccccttaggaagtactcaagaccatgcactctctcaagaatcctcagagccaggctgtagaggtaaaatttgtttctctccatttggtatgaattatttatattattattgcggatttaaatttgtaaattgaatatttaaaattatttaaaatttagagtattaaggttagaaagagaaattaatcttatcccgttttaaggaggttgttataagggtaaggttatgtcttctgctcttgagtttattatgcaaatatacagaattttgttttatttttgacactgtgcaagtgcctcaaaatatgtcttcttgagccctgcgtctgtatagtaatccatgtggagcccagttttttttttgtttttttttttaagaaaaatacctggaaaagccttgcttctaatgtaggaatttttccttacagtgagatctatgtaactgacaatgtttgtgggtttcacttcagctgccaggaaatttggtattacatgagcatttcaaataaagcaacagtgtataattttaaggcccacattagttttcatttttcactacttttgacaccctattctaaatttttgtttcactttatcttttgcttttaatttgtgttttatgtaaaatacttatacaatctttatggaatgagatggggcagaatggaggagtatatccatgtaacttgattttattccactttccaactatatcttctttctgtcttaaacctaggtgattgtatgcactcttggcttcactccagtctaccctgttggttttggggcacatgtaactgtccttattggagcacttagttgctgctgtgggcagtgactaactcattgagttcctatagatgaaatgtaatctgtctgctccaaagctatgtaaatacactcctgttgtggagatttactaggccattaactgcc

SEQ ID NO: 52803 - DNA, 1050 bp, Homo sapiens
tttatgtgttctctacagctccttagtttctacagcaacagcgttgttcagagcctatatggcctacacatcccaaaatatttactttctggccctttataaagacagcttaacccctaatctaaaatatcaatagattaaaacggtttcaggagactccacgaacggtgtctacttgagtggaatcatctgcctttttctttgtggtgcgttttctggttttctgcataaggaagaggggaaagaggaatagtcagtttttctctttatatctccctgtcttagaatttgagagattacttagtctactttagcaggagctcagtactgtttcttgtaccccttcttctgtctaggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccaggtacgggatactgtttgtcagatttctctttgaagtcttagtagtagtactaaaatagagagttactgcagaaaggtaattataaatgctagacgtgaaagagtgtacctttaacatttgaatatttttctctattgtcagagagtggtcaaaggctggcctcaaagtgagaggaatcacgtgcttcaatatactttcattggcttttaaattagaaattttgatttaattgggcagagctcaaatagcctgcattttaaaacttctcaggaaattaaaaaatacaaacagggttgagaatcactaatttactagccccagatgagtcaatcactagttaaacgaaacctgcagaacttttagtccattgtttctaaatctttttttgaccagagcccctctttttagttaacattgtgaaattctgaaggaacttaaaagctga

SEQ ID NO: 52804 - DNA, 1648 bp, Homo sapiens
ggagaaaggttgagagccatattaggttggtgcaaaaataattgcagtttttgcccttacttttaattacttttaatggcaaaaacctcagtttacttaagaatagtacatatttcctatactctctgatttctaattttcttttttctctttttttttttcccctgtggatagttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcatag

SEQ ID NO: 52805 - DNA, 1081 bp, Homo sapiens
gggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgcactctgtctgctgggtgtgctgcttcacgctacgtctcggacccgtgcacagctcccaccccctgggcagccctgtgaggtcgtgtcctctggcaaggaagttttgggcctggcatcagcacatgcaagcagtggtgctgggccctgcctgccactggtgggtgggagtgcaccaccccagtacccctgctggctttaagggaggagggttgatgtcccttcttc

SEQ ID NO: 52806 - DNA, 1029 bp, Homo sapiens
gggacatcaaccctcctcccttaaagccagcaggggtactggggtggtgcactcccacccaccagtggcaggcagggcccagcaccactgcttgcatgtgctgatgccaggcccaaaacttccttgccagaggacacgacctcacagggctgcccagggggtgggagctgtgcacgggtccgagacgtagcgtgaagcagcacacccagcagacagagtgcacagttaaataccatgtttaatcatcccacaatggacagtagtgcagtagtagaaattataagtgtctctttaaaaagtcactcccccaaagtttccattccccaatacccagataaccatggtggaacagggccagggtgagggggactcaggaagtcttggttccaaggagatgaaagtctttccaagtcaaatttgccttgtgagcagccaagagcccaatgagttgatgcatacgcgctcactctaacacgcacacatgcaagggacacagaacacatacagatggagggacagagaggggaccacagcggggccatcgcacacatgcgctctcatgccacaacattccagtccatctggggctatctcctctggggacagggagcggtggcctaagccccgaagcagcaggtgccggtcagatggagaggagggaggccgtctgtccagcctggctgctctgacaagggccctggcagcgagagaggccacccgccatccctgacacagtcaatcctccctaatctcgggccggatgggagaagggagtggggctccagtgttaagggggggccagatatcatttctttttttttttttttttttttgacggagtcttgctctgtcactcaggctggagtgcagtggcacgatcttggctcactgcagcctccacctcccaggtttaagcaattctcctgcctcagcctcccgagtagctgggattacaggcatacgccaccaaacccggctaatttttttttttatttttagtagagatggggtttcaccgtgttagccagg

SEQ ID NO: 52807 - DNA, 1010 bp, Homo sapiens
agtttgcagatattttctcccattctgtgggttgtctcttcactttgttgattgtttcctttgctgtgcagtagctttttaatttgatgttatcccgtttgtccattttcgctttggttgcctgtccttgtggggtattactcaagaattttttttttgctcagaccagtgtcctggagaagcatctttatttttaaagccattcataagaagtagatttatacatagtgtataaataaatctgtgcttcacaggtgctgttctaaggtattaggaagaattggttaatcaagaaactaagttggtctttatcccctgaaaaagtcaagagggtaaaagcaaagtcagtgataatgaatttttgccaatttttaatttttcagggtgtcctttggtagtaatagaacatgaaattttaggggttcaatcatgaggcaccaaagtaatttttgtatccagtcaagatgcctgtaatttttggtgtaattgtgaagggtttgggttgaactgttttgaatagccattttttggttcattatactttctctgagtatcatgtttctttcttttctttttttgaaagtcacttcagagagttcttattccatctcctggggcatccaaatgctgaagcttccattaaggatggtttcatttctcctcaagtgcaatgttcccatgcagaggcggataaatctcaagtttcatatttgtctaggaagcccttctcgcctcccaggcttgaaatatgagtggactagcctattgtttgctttaagctctcctagttttgaagtctcatagcaaatgaacatttattgtcagagaaataagatttatataatcggtggctttcagtggtctgcaaacatttttagttgggggaggggagtgatgctactgacgtctggtgagtatgggtcagtgatactgttaaacaccttacagtgctcaggacatttccctccatgacaaagaattacctggtccaaaatatcaggagtgctgag

SEQ ID NO: 52808 - DNA, 1155 bp, Homo sapiens
aattgctgctggtgagtaggatttcaagacctttgtggtctaatgtggagagtggatagacatgaggggaggaatattgaatttgaactatgaaccccaggactgggagtgggcttttgctgcatgcagtgttgcacggaggcattacaaagcttggcattacatattgagaactgcaagtattgctaaaaaaaaaaaaatggggcaaagtgaaatcttcagatccagataagttatatttgaccttatatatcatgcttaggagctagcttcttaccctgaaggccatgtatagctctggaaaggtggtaagattgccttgtgcattgagaattgccttggcatttcttttgggagagaacttgggagttcaaacttctgcttaatgcactagggaagggaagagaaaagtatgcactgcagatctcattctaattagggatgactggcgagcagcaccagtttctagtttgtgctgttttcactaaggtaggtcaagcaactctgcatccaaagtggagagaaattgtatcataaattgcttttgtcttgcctgcctgcagagctgcaaaggcatttggattgtcagtctgcatttttcactcttttggaaatatacatatattgaatccaaaggcagatattgtggaccttttgcaattccaaaagtagaaaggaatgtcatcaatatattcccgtttctcaacttaaagagggtgaagcctgtcctgcttagtttaagtattgcaccctttctgtaccatgaacctctgaattgttggcaggaggagcacagaggcttgttgattgggtcctggaacgtgtacagtataagcagttcagccaattaattgtgtacattataagaatgtgtacagcttaagcagttctgacaattaattgctgccaatcctgctatgtgccagagaaaaaagtgctttatttgagcgcaggaaatgaaagtccacttaggtatccctgcatgtaaggtttgactgtaggaagactgaagtgttgttctctctaacagcatcgtctccctgtttccagtcaataatcacacacggcattttgacccttagcaagccagtggctttctgtggaacaaataaatgacttagaggataaatgagccaagcacccagatagccatct

SEQ ID NO: 52809 - DNA, 1131 bp, Homo sapiens
tttttttgtttttgtttttgtttttgttttcctgtttatgaagtgacattctgtgtaaaaggtctccatggcaggaactcattgagaaggagaacaattaatgaatgtggagcagtatttctagaacctaaaatatccgaagacaaaaaacactctctttcacttcctttgttccactcactagatggctttctcaccctcttaaaaactcgtcttcaaaataacctcaaatgttggttctcagggctctttatggagcagtagtctctgtttttatttcatctgaaaatgttttcattctttgtttttagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtaagcatgctatgaataaggagcagagaaatggttaaatctgctcttacatttggtatatatgagcaatgaagctgatgcttgcgggcagtgctcataggctgaggagtgtatatataaagctgcttggtgtcagcttctttggtgctgcccagatgtacaaagggtaatttgaccctagagatgttcatgctatgtaggtctgaccattgttttggtaaatgcagaaagctgctcattatctagtctaagctggttcttggctacaggtaagtacagttgtatggctgttagta

SEQ ID NO: 52810 - DNA, 1015 bp, Homo sapiens
atgctcctaatattaaatgataaaatcaagttatgcaactacatattcaatatgctgtcaattttgtgaaaagaagaaaaaattatgtaatagaaaacagtctgaaacaagatgtacaactaaatatttatgtatttttttgactagaggaattattatctcttcatatttttctgtgttttccaggcctttctttggtatacttgtattcctttttatataagggggaaaacaacctacttgaaaaagcaacaacaaaataataacagcaaaaacctattggtgggagcctgagtcagtatttctctactcatgagtttactcagtgtttacctgagtgtttacatttttttccgataaaatacattcttgattcctgctgttatttagctcatggattatttctgaaaaactaaccaaattaaggcagctctgcagttatcctccactcccgcttaccacttaggagtttgctccatctttggtagagccccaggcagctgttgacttagacatggtgagcttttttatttccacttttgggttcagtactgaagccctactgttagaaagcattgattacaatttgataaaagatggtctgtctgtgttttccttgtgtgccatggaatggctatttttctgtttaattttattgttaagtggcttgaaaaatagtgttttggacctggggattctcatctggagacaaataggaagtgatcccaggagttttggaaattcctacaatagattgtcagcttcttgagagcagacatgttgcctcttttagttatgctagatattcttagcgggtaccaaggcacatagtagatgcataaaatatttgttgactgaataaattaataaattaccaataagggaattgttctttgagaattaagctttaaaaacaacaaaatcagagcagagatatggaaaggcactttaaggagaccaatgcttttgagaccaacaagattgactaaaatcttaacaaatatattaacacata

SEQ ID NO: 52811 - DNA, 1120 bp, Homo sapiens
ttacaggcctgagccacagctcctggcctctgcttcgttctgaggacaatcactctttgttagcttattatcttgagacattttaagagagacgtctgtgtttaccagactgatgggtaacagactatggggaacagaacactggattgtctcattctttcgtcagctgactgaccagagacaggctcttagttgcacctcccagttcagcctccctgcctcccagtcatcctccagctgctgtttgggtaccctctaccactagagtactagtgccctactgccaactgcctccagtagaatatcagttccacaaaagcagggatttttgtttgcttgtatccccagtgtctagaacagagcctggcacatagaacttagtaatcatttgttgactgatttcctccatgtctctctgcagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtaaaaccccgtctctactaa

SEQ ID NO: 52812 - DNA, 1052 bp, Homo sapiens
tttttgccttttacgtttgtgtggcactgagacctgaagaagccagatttggaacttaatcaaaagcttctgagagttggatataatgacagcaccggaagtatttggtctctgtgttctctttcagctatctcacgtgagagggcagtggaactccttaggaaatgtctggaggaggtgagtagttcccataggatcctgaaaggaatgtttgtctctctgtttgccagtgttgttcctgttcctcagttatattttttcagatttttgccagaaggtgtaatacatacccactaaccagatgtgaagttgctaccagggatagagtttggtgtggatagcaagctcacttttctctcacagattacctcctcaatgtcagttttataatttaattctttctggtttatccaaaccagtggttctcaaattttagtgtgtgtaagtatcacctgggaaacctgttaaacagattgccatctctgccccaaccctcaattctgagtccactgttctgaggtacaaactgggaagctctgctttaactggcagtcccaggtgattttcctacaggtggtaactgaggctgtacttgaagaacttctgctctagactttatttttttatttgagacggagtttcgcttttgttgcccaggctggagtgcagtggcacgatttcagctcactgcaacctccgcctctgggttcaagcaattctcttgccttagcctcccgagtagctgggattacagttgcccaccaccatgcccggctagttttttgtatttttagtagagacagggtttcaccatgttggccaggctggtcttgaactcctgacctcaggtgatccgcctgcctcggcctcccaaagtgctgggattacaggcatgagccaccacgcccatccctgccctagactttatacctgctctgttcttgtgccacctgtaattgccatactgcctgctcccttaatagtgctcgagtctttgtaatctgtgagaaaaagcctcccctaagaattcaggaggaccatagaaagcaact

SEQ ID NO: 52813 - DNA, 1097 bp, Homo sapiens
actacacaccgagtaagtattaatactctagggagggagcagtggcagagccctgccctcagctgcttcccaggtttgtccactcttggagttgggtggccagggcttgaataggatggatcctaagaagcataaccaggttcccctctggaagctgcactcttctgtcagtcagtagggtcttccaaaagctgatgtaagttctattttttgccattcaaaatgagatagtacatatctctagagctgggttttgttttgaaggaggattggaatagatgtcacagtgaataaaacatttttattgggttctaaaatccttcatttctaagagttcaagttttttcacttattttgctttgcctagatttttggcatctcagtaaagaatgagtgggtaaagcaagtagctgtatatttgtttggaacttgcaaggatgaacaggtccccagcatgacaactgaaggtttctttgcttaaacatcaaagctttctaaggctacaaatctgagccttcccttggttgtcacctaatggctgcctcctcttgaaagaaaaagccgtcgctctacttgtccgtaaagcgtcagtttggcaaaacttcagatacagggatgcttttttaaaattttattttttaattgacaaataataattgtacatatattcatagagtacatcatgatgtttcaatacatgtaatgtaaacagatcatggtagttagtatattgatcatctcaaacatttatcattttgtgttgggaacatttagtatcctccttctagctatttgaaactatatattgttagccatagtaattttacagtggtatagaacaatagaacttattcctctgtctatccataattttctatcttttttttttttttgaggcagagtctccctctgtcgcccaggctggagtgcagtggagtgatctcggctcacagcaacctccgcctcccaggttcaagcaattctcgtgcctcagcctcccaagtagatgggattacaggcgtgtgccaccacgcctggctagtttttgtattttttgtagagatggggtttcaccatgttggccaggctggtccaga

SEQ ID NO: 52814 - DNA, 1167 bp, Homo sapiens
aggtggcaaaggctggcctggctccaaaggaagactgtcaattcctctctttttctgtgtccacgcttggcaggatgcttcctcacgcccacctctctcccccttgctgtgactttagcttccgccagatgtcacaccgctgcttgtcaccgctcagactcttgtcgctgattttgttgtttcagtgtatttatcacaaccattctctttagctgtaaaatttatggaatttcacgctcttagttactacagtgtttctttttcataagagagggaatatacaaggagtcatatgcacaagagttggagggaagggaacacttaatctaacttaagtaaagtttgcctgtgtgcagtgcacactcgccacccccaaatgtagaagagtccaaagtggcactgagctcagttctgtgggactcagatgctcagaagtttttaagaagtctatttcagtctcggaaagaagtacataagagatgtgcttatcagccaattcccctgtcttcttaaatttgatcttttagtaaccaacaaaagttggacaattttattggctctctgtagcccacttcttgatcttactatctagtcaaatctgttgataatgcagtcaaatcctaaaagtggtggtggtagtgttgtggtaatagtcaatctgcattattacaatatatcaggcattgcactgagcactttacatgtatttatctaaaccttaccacaaccttataatgatgggtacttttattatccttattatacagatgaagaaatctcaaaatgacctaaatgcacttcactgtgaaaataaactcatgtactcattaaaggaggaaaagatacatttgtctagtttcgtcctcaccccaccctcactgccttctattaagaggcaaaattttggtggtacctcatgctagaagctgaagttcattctgaattcccaggctggttcatttaaaattttttctttgtatatcaattagacacaactttaaacatgttggtgtttgcattgcagaccattgatggtgattgccaagacctttgggtagagagtatcttagctaaatgtttgggttcacttggatgaatgtttggatatttaggttaattcaatactatatataatgttcagtcttagcttatggtgtggaagaagcc

SEQ ID NO: 52815 - DNA, 1087 bp, Homo sapiens
aggtggatcacctgaggccaggagttcgagaccagcctggccaacatggtgaaacccccgtctctgctaaaaatacaaaaattagctgggcatggtgacaggtgtctgtagtcctaggtactcgggaggccaaggcaggagaatcgcttgaacccaggaggcagaggggtttttttgttttttttttgagacagtcttgccttgtcgcccaggctggagtgcagtggcgcagtcttggctcactgcaagctctgcctcccgggttcacgccattctcctgcctcagcctcctgagtagctgggactacaggcacccgaggaggcagaggttttaatgagccaagattgtgccactgcactccagcctgggtgacagagcgagactctgtctctaaataaataaataaatacaagcagtgggcctctctggaagcctgttggctaagagggtgttagcatgatcagatgagattggtaagatcattagctcgttggctgttctttgatggagcatttggggaaagaatgaaggaagcggggagaccaatgaggggcctgcatgtcagttaaagccgtagcaataacttttgttggatctggggtgctaatggggaacatggttctaatagaagggctcctaaatagtcttttcctcagaatttccttaatactctatggatatctgaaaacatataccatcatatatagtcctaactactcttttctagaagaccatcttatttattagctcagagagatgaatcagctttgatgttcagaattcatagattagatattcatgggcatgcttagcatgcacaacttaatatatgccttgtagtgtgcaagcgtgtagcaaagcatggtttctgcatttgagatttttaaaaactgacttaacggtatatggaatcttaaattttcctagaatctgccagctcatgaaaaaaaaagaattcaagtgtccttgttgcaaacatggtgttggttttatcattgcacaatcagcaattttattttgacgttatttggggggaagcagtatttttgattagcaagtaaaattaatgtagaaaacaaatactgt

SEQ ID NO: 52816 - DNA, 2168 bp, Homo sapiens
gccttaattcaaggctgtttggtctggttagtagtaggcatgtatagcatgctcctgtcctagaagaaacctgttgctttgagccttctattctgaccatgagaattattcttctcatgccttaggtggctggcacaaaggcatcatctgtttattggtatcagtgaggtcctgtgaacagatggcccaggtgaaaccctgactttgcaagtcttgtcccttatacactaccaaccatttgttacatgtgattgaaatatcactaacaagggtaatttcacatgatttttggcaaacgtggttagcaggatgtgacatgacgcagcactgccttcttcctccatgtgccatctcccttgaggcctcatcttctctacttgcccccgtctcacccatgccgaggcttgccttcagctcacctgctccagatgggcagcacagtgggaggacactggcaaaggcagatgtgtttattttccggagacaaaatgttgtgctgctgcagatggcagtgccttggagcaagaggcagcctttgacactgctgccacacagcctgggcatcttgacagacagagccagcttacttttggtgatgcggaaattcaaaaataaaaaacgaaaaccaagatgttcattatgcagctcttggactgtcagtgcaagcagcagcccttttagacctggggagcagttttcttccctaccaaaccttagtcagctagtgagctaactgtggattgtcactgtaggccaagagttacgtgtctgttcattacttttgtctcccagccttaacaggacataaagtaaaaactggaaacaaatggctacatttagatggatactcagtttggttctgcaaaacatatgtgtatcccaggtcccatctcacaggagtctcttaggattgggggtggctcatgttggccccattggagataccgctgttctgtttttagtggtcattttgattatccaaagacccagagacagatgtgccttgaagttgaggtgtctcaattaatatgacaacactttgtgcttatagtgtttttctactaggaggagtaagcattctgacagctgcccttttaagcagtatgcgtatgcattagttaaagcttgactaagtccattaggaagacaaagactggctgttgaatcattacacttactaggatcctaaaaaaaataacttgggaagattatttgaaagttactggctttatcaggaaatttttttttctttttctttctttttttttttttttaaatgtgctgtttttcctagccctagctagttaggagtttgcaggtgtaaagtcctccccctccccttccctgtctctctccagggggttgtatgtgagaaggtgttgctttctcactcagagagcatatatgtgctaccctgttggatgcctgctgcgagcccagagaacccccgtgctcattgaatggaataagcctattggatggctggaattttgcagccccataatgccaacttttcacttaaagcatctttcctatccacaatgggagtgaagcagtatatgtacttggtctagatttatattgttttaaaactcgtgtcttaaaaattttgtgatttcctattaaggtttggtttaagcctaaggcaggatagtgctgtgtctgcttagtaggaatgtgcttttacttttaaaatgtttactattagaagtgcagatttacccccaacttttaagattgctttaaatcacttgccccagtctgggtaggcataggtgtgggcatgccctcccacatactcacagatacaaacacacacaatatcctggcatcttggtgcctctttttacctgccctggcccaagatcatgtaggaatatgaatttaggggctgatctcaacaacctcatgaggttttctttactctctcccaaaaaacagttacctaaaatgaagggcagtgggaaggcttttcacaaggggaaaggtggatttttctatttcttgacctgagaggttgttacgtgtatatttactatgttcattcgctataccatgtatattttatgcttttttttttcttctttttgagacatagtctcgctctgtcgcccaggctggagtgcagtggtgctgtctaggctcactgcatcctctgcctcctgggt

SEQ ID NO: 52817 - DNA, 1027 bp, Homo sapiens
gagtgcagtggtatgaccacagctctctgcagccccttgacctttcaggcccagatgatccttccacctcagcctccctggcagctgggactgtaggtgcataccactatgcctggctaattttttgtagagatggggtttctccatgttgccaggctggtcccgaactcctgggctcaagcaatcctcccgcttctgcttcccaaagtgctaggattacaggcatgagccaccatgcccagcccacttgtgtttttatgctgcgattgctgtttggtcaaagaagcaatttaatggctataagttagtttttcgtgagggatcatttgttgtgcttttttttttttttttttttttttgagatagggtctcgctctgtcacctaagaggtggcacagtcacagctcactgcagcctcaacctcccgggctcaaacaatactcccacttcagcctcccaaatagctggaactacaggcgccaagccaccatgctggtattgatagggaaaatagaagtaaaataacattgaacatatattatgtgctaggatttttctagatctacacagtccagtatggtagccaactagccacatggggctatttaaatttaagttaattaaaattaaataaaacttaaaattcagtttctggtggaaaatctcctggtagactttgcctgaatgctaaatcaacttttgttcttaaaaaaaaaaattctgttcctcagtcacagccacatttcaggtacccaatagccacaactattgtattagacatcacagatctggaacatatccatcatcatagaagttctcttggacagtgctattctaaatacttacatatgtatctgttattaagtatccttattatgacaccataagatgtgtgttatccccattttacttacaaggatgttaagtatttctcttagatatgtttccaaagcacatatatactatgttaaaggttaagattccagcttcaaatatcaaactctttcatggtgtcttctttattaat

SEQ ID NO: 52818 - DNA, 2327 bp, Homo sapiens
ggcagcagctaacttcacacgccgaaacctggctgactgtcttcggagtcgggtaagtaatatatcagacattgttagatagagcagaaaaatcctttgtgcttcttttatattctcattatacatgagtagtatttttgcccttttttggccttccagaacccctcctgttgctacttgttcattcttaagtccaatgtctttgtgcacagttgttattaataggtacagcccaaagggcaaatattcattcccagagaattggttgggacacaccaatatgaaggcctgtgacaacttaccctttttttttccccctaaaaactattttttagagcagtgttaggttcacagcaaaattgagaagaagtataaagatttcccacattcctcctcacccacatgtatagcattccccattatcagcatcttccaccagggtgatacattgtcacaaatgatgagcctatattgacagtaatcacccaggtccatagtttacattagggtttacttttgctgttgtggatgttatgggtttggacaaatgtataatgacatgtatctaccattacaggatacagagtattttcactgccctaaaaatcctttgtactctacttattcatccttctccatccccacaactcctgacaaccactcatctttttactttctccatggttttgcctttcccatcatgtcatatagttggaatcatggattatgcagccttttcagattggcttcttttatttggtaatacacgtttaaggttaccctatgtcttttcatggcttgatagctcatttctttttaacattgaaaaatactccattgtctagatatactacaggttatttatccattcacctactgaaggacatcttggttgcttccaagttttggcaatatgaataaagctaatgtatacatccatgtgcaggtttttgtttgaacataagtttttttttgcgtaaataccaaggagtgtgattgctggatcatatagtaagagtacgtttagttttttcaaagtgtttttgtaacaaaccatattacttaatacctgtgactgaaagtctctatgtgttagtgaaagtagaactttgaaaataataattcagattatttttatttttatttttttgagatggagtttcactcttgttgcccaaactagagtgcaatggtgcaatcttggcttactggaacctctgcctcctgggttcaagtgattctcctgcctccatttcccaagtagctgggattacaggcatgcaccaccacgcccagctaattttgtatttttagcagacacggggtttctccatgttggtcaggtgtcaggctggtctcgaactcctgatctcaggtgatctgcccgccttggcctcccaaagtgctgggattacaggcgcgagccaccgcacctggccggtaatgtggatttttatctcgagattgcttatctgtgtttctctttttttctttttcttttttctttttttttttgagacggggtctcactccagttgcccaggctggagtgtagtggtgtgatctcagcttactgaagcctcaacttcccgggttcaggtgattctcccacctcagcctcccaagtagctgggactacaggtgtgcaccaccacatctggctaattttttgtatttttagtggaggcaggatttcaccatgtggcccaggctggtcttgaactcctggactcaagcaatctgctggccttggcctttcagggtgctgggattataggaatgagccactcactgtacctggcgtacttacctgtgtttttctatgactttttcccaaagcatacagcattgttcctccttacttattctagccttgttgctattctagagctgtctccatttcatcgacagcatgttaaaagatgcaacactaagttaaggattgaatgcattaaagattgtgtaggatgtgctaggaaagttcatatggttgctaaaggtgtgtgttattcccttcccacagggactaaataaatagagccttaccacgtgatctcaccccctgtgcctgtttacttatctatgaaatggagataacttcctaaccccacaggggtgccaggaaaatgaatgcttgtaaatcataatatttaacattcatgtgacttttgcccaaagcattttgcttaataatttaatctactcactattccactgagaaagatagtctctatcactgagatgaagtgaaaggcataaagtgtcaaagggactagctccaggtcacacagcaggtcagacaaagctaaaataatggtgccataatt

SEQ ID NO: 52819 - DNA, 2114 bp, Homo sapiens
tctaatcattcatttcacgatggagcttgtttagagtaggcaagaatgctgaaaaaatagtaaccttctgggactcctttctccaagtataaaatgataatacaacttccaatcaattgtccagtatgtcactttgtaaaaacattttgatactatagagtagacatttgctgaggattgccaccttattaagtggtataacttttggtttgcttatatgccgcatttcatgtctcttttctcttggcctatgtagaattgcttttaagttactcggagtactccagcccacacagaattctctcttttctgaattcctatagcatgtataatccgaactacattatctaacactgagtatcataatattggacatgtatagaattcattagtttttctcacttgtgagttagacaggggtaagtcatattattaacatttcacacatttggaaataacatttcacacatctggaaactggggcttagagaggacaagtaatttgccgaagttcagagtgccaagtccacatcataaccaaggtctcttggattctagttcagttggttttccacagtatgacatgctaatgttgttcattttgttggccatttgtttcatgtatgtggatctcgtaagttcctcgtcaagaatcagaaattccccagagctacacaggcagtttcctgtacaactcaggggtctctaagtatctatctcttgtgtttttattaaatatgttgccctctgctactcattggacatattcagtgtttaaaaaacatttttggccttgtattaagctaattttaaagttgaacaggttactgcctaggattttagcctttcttctaagtgtgacataagttctttgtaaacaagctcccccttcaaataaaaatatcttttttcttattataaaaataatgcgaacttattgaataatgctttcttataaaagtgaggcatgttaagtatagaagttttaggaaaaaccaacaagcaaaagaaggaaacgaaaactgcccatactcttaccactggcaagcacttagaatatacccttctgctcctttttctttgcatagataatataagtgaatgtttttcgtttattaacaagtttgcaaactaacaatctttaaatctagcctgcataacaaataaaagtgtgtttgtttaggagttttgaggcaatttgatattatctacaggtgcattttgtgtgttttttccctccaagtctaagaagccatattactggtatctacaactctgaaacacttgtaaagtatttgacagtagcattttgttctttaaatcctattaaaggattttggcatttcagaagctttcaaacaggaaacgtgtctcccagggaggattattcagcactatttgaaaaatgaaaagtgaaagtgaaagtgagataggaagatttaggccttttctgaagctgcagactgaatgtggagttttcttccttaggcaataactgtaacctgaatatttatttatctgtctaatctgaatgactctggttcagctagataagattagagtattaggatttttgtgaggtattttaaatagcttactgtcaaaatattcactagaatttttgctttggcaatcattttaattttctctttttctttggaagtggaatttgtttactttttaaagtgattaatattctcagttgattttctattctttcttgaaatggttccttaattttaattatagcaccagtccttttcatatatgcttttgtatgtgtataaatataataactaacatttgtagttgtggaaacattttagggctttgttatcatgagcctaaagataatcgccattggctggattccttcagtttcttctgtcgttctgttccttgcatttcaaatgcctttaaatgctttaaattgtattttcaattggtagctttcatgtatattctccaaccgaaattggcattacacaatatgctgatggtttaacatgaagagtgaaagagaaaaattgataccattacctattaaaatcttctaaaagcaataattagttaaattattcaatatacagtcgtcccttggtatctgtagggat

SEQ ID NO: 52820 - DNA, 2467 bp, Homo sapiens
ccactgatttcaattctgcagtatttacaacatcaacaactcatggaatacttgggtgaggtttcctttttttttttttttttaagatgggagtctcactctgttgcccagcttggagtgcagtggcgtgatctcggctcaccacaatctctgcctcccaggttcaagcgattctcctccttcagcctcccgagtagctgggattacaggcatgtgccaatacgcccagctaatttttgtatttttagtagagacggggtttcaccatgttggccaggctggtcttgaactcctgacctcaaatgatccatccacctcggccccacaaagtgctggtcacatgcatgagtcactgcacctggccttgggttaggtttcacttcctccattagacatttgacattttattgtagcagctttctgggttaatatctctttgtgattgatagaagtggttggaagaggaagagtagggaaaagtgtgacattacagattaaacagtgaaaatcagtaccataatgactcctttacacccatgagatacgtaccatgatgaccagggctcggtgaaagaaagatttctttttttttttttgagatagtctcactttgttgcccagtctggagtgcagtggcgcaatctcggctcacggcaacctctgcctcccgggttcaagtgattctcctgtctcagcctcccaagtagctgggactacaggtgcatgccaccacacctggctaatttttgtatttttagtggagacagggagtcaccatgttggccaggctggtctcgatctcctgacctcaagtgatccagctgcctcagcctcccaaagtgctgagattacaggcgtgagccactgtgcccagccaaaagaacgatttcttagatggaggacctaggaaccaacagatgggctgctgtattactcttacccctttcattttcctgtatgcttcttcccaaggcagcatcaaattttgaattaatttttgctgcttaataaggacttaaactggtacccaagtcagaaagactctgcctctaattttctggggcttggggatgaagataaagtgttacacccagtgtttgtccaccacagtctgtggggcagagagacccttcctgggactgaattctcaatttgaagcactgttgttcaaagatctcccttctgggtctgacaagaagaaacataacccttatttattgcattcttctggcttacatacattgccctcactaatcaatggacatttcagcatttcattactaattttgagagaaggccaccatggaatttaataaaaatattattgaagagaattgccatcattctccattttccctgaactaccacaagcttctcagaattttagacaaatgtttttcccctcagaactgagcatcagtgctgctttggaaaaacattccatgtgaatactgtggtttcagtgtcaggacctgtacttgggcagttggaagagagtgtgccagttttttactgggagatgggaacaccaatttaattgatgcaattaggttgtaggttttttacagtttttcttttcttttctttttctttttcttttcttttcttttctttttttttttttgagacataggctggctctgtcacctaggctggaatacaatggcatgatctcggcttactgcaacctccgcctcctaggttcaagcaattctgcctcggcctcccaaatagcagggattacaggcacctgccaccactcccagctaattttttgtatttttattagagatgaggtttcgccatgttggccaggctggtcttgaactcctgacctgaggtgatccacccgtctcggcctcccaaagtgctgggattataggcatgagccaccgcacccggccggttttctacagttttctaatactcaagatgttgactttgacaatacttatgtttgtatacttgtaatcttataatggggaaaatgtgtataaagatgttttaatatgtatgtagtttttcaataaatcttaatgccttgaagggaagatttgctgtccagcttgaatgctcattcttgggtcagtgcctgtctaaccttgaggagcatttcattttcaggttatctccatcccagggaaaccctctgggtctaaactgagaagctgctgcaattgtcccctcactggcttctcagtcctagtgaattgatcaagttaacttaccaagtggtttgggttcagctcaggtgaagaggataattgagtttacataaatggtaccttctattatagctctttgtttaaaaaacttattttttagagacagtctcattctgttgcccaggttagagtgcagtggcacaatcatagctcactgtacccttgaactcctgggcttcagcatcctccttcctcaacctttggaatagctgggccacattacaggcatatgccaccatgcc

SEQ ID NO: 52821 - DNA, 4703 bp, Homo sapiens
gccactgtattccaggtggtgtaagagaccaagactgtctcagagaaaaaaaaaaaattaacacacacaaaattttttttaattcataacttggctgactacttgtagtttgctttcaacaacttatttattgattcattgatttacattttagggaagaggaagacgaggaggaggaatttggagactttcggcttgtttcaaatgataatgagtttgatagtgatgaggtgagtatgaagggaacaaagtaatcataactgagctccatgtattgctgccctcaagtgtttttttcccctcagttcttgagaattctaagtttggcatcttatcagaaacaatttcctagaatgaggtatttgggcagatgtttataaatccttttttcattgaggacgcattttattctgcttaatttggatatgatgctgattttgtaggatgaacacagtgactctggtaatgatctggcactggaagaccatgaagatgatgatgaagaagaactcctgaagcgatctgagaagttgaaaaggcaaatgtacgtgttattaatatgtccattccttcaggtgtatttaaaatttggtcactaggccaggcatggtggcttgcgcctgtaatcccatcattttgggaggctgaagcaggcggatcacctgaggtcaggagttcaagaccagcctggtcttggtgacacaggtcaagagatcgagaccatcctgacaaacatggtgaaaccctgtctctactaaaaaatataaaaattagccagatgtgatgacaggtgcctgtagtcccagctactcaggaagctgaggcagggagaatcgcttgcacccaggaggtggaggttgcagtgagccgagatcgcaccactgcatttcagcctgggtgacagagcgagactctgtctcaaaaaaaaaaaaaaaaaaaaagttgatcacttaatatgtcctgtgtgctaataactgtgctttacaggcattaacatattatcttatgccaggcacagtggctcacgcctgtaatcccagcactttgggaggccaaggcaggcatattacttgaggtcaggagtttgagaccagcgtgaccaacatggtgaaaccctctctactaaaaatacaaaatacaaaataaaatacaaaaattagccaggcatggttctgggcgcctgtagtgccagctacttgggaggctgaggcaggagaattgcttgaatatgggaggcggaggttgcagtgagccaagattgccccactgcactccagcctgggtgatagagcaagactccatctcaaaaaaattatcttatgagtgggtactattattctcctcattttacagttgaaggaactgagcctcagaaagattaaatttacccaagatcacatagctagaaggcagcagaggctggattcaacttagattaggtgaaatctcccctaacagtcagttaatagtttgccactttttaacttaaatcctcctgcctcagcttcccaagtagctgggacaacaggcatgtgccaccacacctggctaattctttctattttttgtagagatggggccttgctttgttcccaggctggtcttaaactgttggcctcaagtgatcctcctgcctctgcttcccaaagtctgggattacaggcatgagccaccaggcccagcttttttttttttttttttttttttttttgagacggagtctcgctctgtcgcccaggctggagggcagtggcatgatctcggctcactgcaacctccgcctcccgggttcaaagcgattctcctgcttcagcctcctgagtagctgggaatataggcacgtgccaccacacccagctaatttttgtatatttagtagagacggggtttcaccatgttggtcaggatggtctcgatctcttgacctcacgatccacccgccttggccttccaacatgctgggattacaggcgtgagccaccccacctggccggcccaactcatttttttgatatgctgttctggtcatgaaagtaaaatatttattttaggatatttaaaagaatacaaactgggtgcagtggcccacgcctataatctcagcactttgggaagctgaggcgggtggatcacctgaggtcaggagttcgagaccagcctggccaacatggcgagaccccgtctctactaaaaatacaaaattagccaagcgtgatggccagtgcctgtaatcccagctactcaggaggcaaagctggagaatcgcttgaaccgggaggtggagggtgcagtgagctgagattgtgccattgcattccagcctgggcgacgagagaaactccattctccccgacccccgcaaaaaaagaatacagaaagatataaataaaaacttatccatgtccaccatccaggatataaatgaaagttagtttgttccccttaatcttttttatgcatatatttttatatagttgagatttgtacaatctttctatatgtataattttgcatctttttttttctacttagcatatccagaaacattttcctatgatgttaaaaaaagttttataaagataattctaataggtatttaatattatattgtatgtgaatgatttggaattcacatataggacatcatattgatccctattagatttatatggttgcttttatcccatcatttcattctattaagattcactttgggttctaatttatcacctatcaaattaactctcatacagctttaggttatccatagatttttctaaggtagtggttcttctctgcagagctctttgttcaaataaaatcttttaaagaatgacagataaaagttgaactgttcaaagatggtaagtgggaagtttgggaaacttagtgactagtggcctctgaaggaattttccaggaactctaggatttagaacaacttagctttaagaaaatacagtataggctgggcgtggtggctcatgcctgtaatcccagcactttgggaggctgagatggacagatcccctgaggtcaggagttcaagaccaccctggccaacatggtgaaaccctatctctactaaaaaaacaaaaattagccaggcatggtggcacgcacctgtaatcccagctactcgggaggttgaggcatgagaatcacttgaacccaggaggtggaggttgcagtgagccgagatggcatctctgcactccagcctaggcgacagagcgacacttcatctcaaaaaaaaaaaaaaagagaaaatacagtataggtcttcgataaaaatcagttttcagaaagccaccaaacttctgccattttggaccacatgggaccaaggtgactttgaatccagggtgacaccagatttattctccgggggagctgaagtcataagaagtaactagtcgttttgattaccaggagctctgagccttagtcttccttctgatgtgggggtcaagatttgttaggctgtaagaagatcccagtttattacctttctacaccacaccatctctagtttgtctcttaaagctggtgtgctcaaatgcaaaatgaaatagtttgaaccttccagcaggtattctaatacatgtaaaagagattaagagttttctggctttcaaatcacccaatctaagttgaatccaggctctgctaccttctagctatgtgaccttgggtaaatgtaatctttctgaggctcaattccctcaactgtaaaatgaagagaataatagtacccattcctatgataatatgttaatgcctgtaaagcacagttattagcacacaagacatattaagtgatcaacttttaaatacagatgctccacatcttacaatgggactatatcctgatcaatccatcataagttgaaaatgcactttcatattatccagatataactccatcgtaaatcgagaagcatactaagtgcgtatcacattcatgtcatcgtaaagttgaaaaatcattaagtcaaaccatcataagtggagactattacaaaaaaatttaaatattatcaaatgtattatgtttattattattagaagtgactctgttctgcttttctttgcttccatattctgtgagtatattcattgttgcattttctaatcctcaaaattgctttctaggaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgtcagtatcccaataagcccttctgagtaatagggtacatcttaagacaagccctgtaaccagccagaatggtccttgttttgaacaccttatttctcctgttgcaggaaaactatgttggatgatgataagcgacagctacgtttataccaagagaggtaccttgctgatggggatctgcacagcgatggtcctgggcgaatgaggaagtttcgatggaaaaacataggtatcttggttgttgtctttaaaagcaatcagttacgggctgagcatggtggctcacgcctgtaatcccaacactttgggaggcagaggcaggtggatcacaaggtcaggagttcaggaccagcctgaacaacatggtgaaaccccgtccctac

SEQ ID NO: 52822 - DNA, 1044 bp, Homo sapiens
tcctgagctcaggagttcgccaccagcctgggcagcacggtgaaaccccgtctctactaaaatacaaaaaattatctgggcatggtggcccgtgcctgtaatcgcagctacttgggaggctgagacaggagaactgcttgaaccccggaggtggaggttgcagtgagccgagattgtgccactgcactccagcctgggcaacagagagagactgtctcaaaaaaaaagtcttgaaaaaaaaaaagactgctttagctttgcccatatatcatttatgattaatgtatgtacaaagtttagaacagtgtctgatgtataataaatttcatataaatgttaacttacttcctgttccctgcccccaatacacacaactgctagatcgaacataagctctatgagacctgggatagtggtttgttcattactgtatccctggtggcctggcacatatggcacatagtaagcactaaataaggatttgttgaatgaatagatggtaggctcttcttggcaagcttaccttagaactgtatcgagctggcatgactttagatggctgggaaaagagtataaagctatcattccttggtgacacatcttttccttgttgtgatgtagatgcctccactccagcctcatcagagttaaataaacaggagaaggagagcagcatgggtgatccaatggaagaagcacttgctctttgctcaggctcttttcccacagacaagtaagtctcagattgctgggaatttgggaaggcctggccttttgataaaatcaaaataactgatcatcttaagggctttgcaccttttctgagaatcttgcagtggatttgagtctcatatatgcctagtaagcaaattataatgctttggtggagaacagggtaaaaaaggcaagaatatgaaagctatttaatatcattaatagagaaatgccaatcaaaaccatagtgagacacccattaagatgacttttatcagaaaaaccccaagagtgttagtgagaatgtggagaaattggaaaccttgtgta

SEQ ID NO: 52823 - DNA, 1055 bp, Homo sapiens
tctccttcccctgggctatttcgagccagtttggtcagctcagcttctaaggtaagatggtaatggtttttctaatctcctcctctctttgcttcccacattgctaaataaagtttgtcccagccaaccaactcccaccacgttggtactgagcttatgtgtgttcagtttaaaaaatccaccccctttgtgtattaaaaacaagcttcatccagtattcttactttcttggaggtatttttctttatgcttctcatggctgtgtattgtccccctcaactacaatttcctgagagtagcttaaatattgcaaatagcaacttttgtggttgtcatgacaatgactgacatttgtaaaatgttttgttattgtttgtttttgtttgtgtgccagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggtaggtagttttgtgtttctgtgggcgggaatggtgctgggtactgcttaattttgtttaaaaataagtgagcttctgtcactccatctgtgctttctcttctgagaaagagaaggtgtacagaccattagtattacattctataagtttgaacaaagtctgtccagaaaataaacataaatagctcttgctaacattctggtccttcaatttctgtcttatttgaaatgcatagatcttgtattgtaaggtcatcaaatttccctgtatccatcctgctatgttattattgttgggtaaggttgagaattcacagactggtggcacattacaggacataatgccaagccctgctctagcatcatctgaagctaaaagttatcctttacactttaccttctgagtaacattttattctttcacaaaacttttccctccctctttagattaacacaagcctaaagtttgaatcttttgctttctggtttgagattcagcttttaact

SEQ ID NO: 52824 - DNA, 1020 bp, Homo sapiens
agtgaaattggcaaggcagttggcttcctctctgttcccaagtctctctcatcagattctactttacttctgtttaaggacagctcttccaagatggggtaagtgattctctctaagaaaacttaaaattgccttggatttgcccctcctgtaaaaactaggaacagatactgaaccaatttactttcttattttgcagttactttcctactgaagaaaaatcagaaacagatgaaaactcaggcaagcagcctagcaaactgggtaagtagtgattcttgtgcagaacttaacatttcttttgtccctcagctttgatatttaaggactgcagtacggtaagtttccatgtttttaaatctggtcacttcccagtttcatatgtagctatgaaaagggtttatgaattagaatatttttcttggtctattttttgcagtttatttatagtagaccatggtacataatgtccttagtgaatgtgtgttgattgagtgagcaatgaaatgtttctgtatgtagatcaaaggaagacgtataattgattggacaatgaagagtgtgatcataggcattaggaaggataagagaaagaagagaactttcggccaggcgcagtgactcacgcctgtaatcccagcactttgggaggctgaggcaggcggatcatgaggtcaggagatcgagaccagcctggctaacatggtgaaaccctgtctctactaaaaatataaaaaattagccaggtgtggtggcacgcgcctgtagtcccagctacttgggagggtgaggcaggagaatcgcttgaacctgggaggcggaggttgcagtgagccgaattcacgccactacactccagctggggtgacagagcgagactgtctcaaaaaaaaaaaaaaaaaaaaaaaaagaactttcaagtgtcacttagctcagagtaataagccctgattatataatgctatcttagtactgtaatttacctttaacttaatgttttggaacatataacttgagggg

SEQ ID NO: 52825 - DNA, 1050 bp, Homo sapiens
ttcgtgaactgccagttcatatcattagctcattttactcgagtcgtttctctttttctttaatataggtaaatttatcaatgtttttcttcatggcttttgagccacagacttgaagctctactccctacccaccttttctctcttttgaacaattattttataatccctgagtagtatactatctagggtgcagaagttctctttgatacttcaattcataataatactcttgtgttcaaataacaaaaaagcccagaatactagagtctcagattttccttttgggatgtgactagaatatttctggagttgcctaaaatgcatacctaattattgtattatgtctaaagcatttctacatatttctgttcaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggaggtttctggcaattacgttgttttgttaccttgtcatggtgaatatgagagaaaaagtcagacttgaaaaagagtataataagcatgttcaattgtataagaggttttaggggcatgatgagggtaactacctcatatatccctaaatcttaggaacttcagttctgtcagtaccactgaatatctgtagatcatcattatatatctgaatacagatattcagtggtactgacagaataccattgcctgggcttccacctgtttatatattttaatataataatgctaatattaaaaatggctttgtattcgtaggaaattttatctttgttgtttatttaggtttctctagcagattaaaaagcagtcctaaccttggctagattgaggcctggagtaaattcttagggaggtagag

SEQ ID NO: 52826 - DNA, 1049 bp, Homo sapiens
taacaaatagggaattttaaaaggagaccaaaacccatgaaaaattaagcccttgaatagatgagattataatcttttttcctaccagtttaatacttttaaagaatttttaaagaatgttcaaaagaattgcacatatttagaaatttcaggtataaatttctgtctgattttttaaagtctgatttttgaaacgttgaggaagaacagttgtggcagtcaattagtttgggttaagttgtatgaatttgactcaggagttagtagcaaggggtttttggtttctctgtgtatgtgtggtttccctcataattgttgagctaaaaaaaacttagcttataagtcttaaaggaaagagttttgagcatggcaaactgacacactggttggcgtttgggtttagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtatttgagcccacaggttttgttttttgctttttgctttgtattctaacagatcttcaaggctattgaaaaccttataatgaaaagttatagaatctttttccttggaggctttgcagagcagtatctctggcatgattcacgtgtagcacacctagaggtgtggggtggacaagctggctttattttttttttagatatcatttgtcttattataaaaaaccccattatagacaaatatatagaataaatgaaaaacttaatcttctatcagagacaggttctataaccatatcgtgtatccttttaaactctcttctttgcacatatgtatatgtaatttaaacaaaaacaggctgggtgcagtggcacatgcctgtaatcctagcactttggaaggacaaggcaggaggatctgttgagctcaggagttggagaccagcctgggcaacat

SEQ ID NO: 52827 - DNA, 1003 bp, Homo sapiens
ttgttatatgggactaaaagttacctaaacagtcctagactgataggaaagggagaaacattttttgagtaccaactatattagacactggtacattctttgttagttgtctttcttaattctcacagtgccaggtattattttgcaaaatgaagagactgaggctcagagaggttaggtaatttttccagcattatacttggcttataaagggacctacacagtggctggcatataatgagcacttattttttaacttggaacatgttttcctttagaaataattgacacgaaatttgggtttccagaccagccataatatacatgaagttagaatcaacattcattcattcattcatgcaataaacttttatttagcactgtgttgggtgctgtgtatacacgtaaaacactccctgctctcaaagaaattgaagtgtaataggagtgatagacaggcaaacagaccattacaatactggatggtaagtgctgcgatcaaggtatataattgagggtgcattgggaacctagaggaagggtaccttacttggagcctagaagtcagggaagtttctgaaatgagctcagtagagataccaaggcagagaggtgagggagggcttttttggtggaggggttggacctgcagatgtcagagacaatggaaagcacagggtgatctccctggctgaagtgaagatagcaaggacattggtgatcagagcccagatcattcagggtttttatgccatgctaggagcttggactttagctctttgtaagtagaggaccactgaaaggttttcagcaaaggaaatgttcaatcagatactcactttaggaagttaaatctggtagctgttgtggtggatgcattggaaggggttaagagtaaaaacagtgggaacagctcagtttctttacctcatatagaataaggtttccatgagaaaatgcatgtaaatttaaattttgtgatgtcagaaatacattatttctg

SEQ ID NO: 52828 - DNA, 1005 bp, Homo sapiens
atagcctttgagaaatgaaccctatagggtttcaggaagggtatcaaagagaggcatcagtcaaaacattgttgtcccgagtgtttggaagcataatttttcttcctaagatttttttttagcttcctgcgagttattatccctctttagggaaagatgtaagcagaggtaaaagaaataagggtccagactccatctgaggtatctgttttctaagcataataggatgctgtgtgtttaataatttctagttgatgattattgatttattaatgtagcatgatgtggtgttggactacaaaagtagtcttcagctaaagcatcctcttatttgaatttcgtttttgtcctaatcaacctgccatttcttttagaaaaaagaaccatctttggagagtggggtccattcatttgaggaaggaagtgagttatcaaaaggaaccacgaggaaggtgaggtagagccctgtatattagtcacactgatctctttacacaggagattatagatttcttagggataaatattttattttgtctatcatatttttctgttacccatcatattgctttgtacatagtaggaacaaaatatggattggattgaacaaattctctgagacttgggaataaatgaattccttgagtttatactgcatttgggcttactcatgcttactatttcctttcctcttttcttggagagagcaaactcttgagtgatgaatatctatctttctggatattcatataattaatgtagtctcacttcttgttttctttaaggaaagaaaggcagccagattaagtaaagaagcattaaaacaactgcatagtgagactcagcgccttattcgaggtaatgcaacccagtaaactttgaggcaaaatcacaacatttctttgtaagctcaacttggatgttggggacttttatttttttaacacttctaatgtgaactcaggttataatattaagtttagaattgatcttggtgaaaggcca

SEQ ID NO: 52829 - DNA, 1062 bp, Homo sapiens
ccctcctgagtagctgggattataggcgcccaccaccatgcccagctaatttttgtatatttagttgagacggggtttcaccatgttagccaatccagtcttgaactcctgacctcaggtgatccacctgcttcggcctcccaaagtgctgggattacaggtgtgagccgccgtgcttggcctgaactgtttctttttgttttctgaatcaaggttgttttctcattgggccccagatccaatcagcttagattaaaaggactgtcttaaattaaaagggctgttttaaattaaaagggctgtctttaaattgctgaaaccatgagttaatagtacttcttaccaactgggctttacctctctgtaacatacacatataagaaatctgtacctgtgcccccaaaatatataaaaatttaaataaaaaatagaccagcacatgtcaaataaaataaataaataaaagatatgctgtgaaaaaaaaaatagtacttcttagactttgctaatacaaattcgttgaactcttgcctgacctctgggcacaaaacctcctgccaccttctccttaactgttgtcatctctccacctgtctgtcaacttgttatccatgtagatttaagatcttcttcttcaggcttgtcttcctaaactatctattaagctattattaagctatctcatagttttattctttaaatctttcaaaattgacagttccagttcttggtctactttgtaccctgacatttactaatatcttcaattctctaagcatgcctcttgccaatccacttgcccatttattttgcctctactcttaggctgatagaaattgctgggggaaaagtggtggattttatttttttggaacagggtctcatctcactctgtcacccagggtggagtgcagtggcatgattatggctcatggcagcctagatgcccccaggctcaggtgatcctcctacctgagcctcccaagtagctgggactacaggcactcaccatcactcttggctactttttttgtattttttgtagagatggggtttcaccat

SEQ ID NO: 52830 - DNA, 1045 bp, Homo sapiens
gagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaag

SEQ ID NO: 52831 - DNA, 1007 bp, Homo sapiens
gagaacctctagaagcaaggcatggtataagtgtcagaaattaatctcctcatgagtaaggaccggttatggtccatcccttaagttcccagcctctgcatggcatctagtgtaaagcaggcatcaaaaatttgtgagtttatgggaaagtgatgtttgagctgggtctcttaccccgcctatcactgcaccagaccgaataggagggagaatgggagttcccagaaactttgagactagcaaggaagtggttgtgatacgtctagcaagatatgataagggtctgcaccagcataagaaaccatcagaatggcagtgaatcatgtgagagcagttcagaaggtaaacatgtcaagacgtggtgaacagctgaatagatggaaagaacaagggatagaggaactgtcatttctgacatgaaggtgctgttcgctgagataggaagcacagggcaagtatgtttgtgagtgaaagataaagtgtttggtttggacttcttaaatttgaagtgctggtaggatatccaggtggagctgtccagcaaacacttggaaatgtgagtatgagacatggttggaaacagagatttggaaggatagttgggccgtaagagtggatgagacctttaaggggagagtggaatgagaagagagctgggtttggaaccacagtgaacagttaatgaggcaaaagcaaaaggggccctttagaaagactgaaaaggacttaggcaataggagactgcagaagatgccgcagccaagtagaaggctcagaagggaagtagaggcacagtgacagatgctgcagagaaataattgaaaagtatcctttggatgtcaaccccaaaagtcatttaagtgacgtgatgagggcagaagctgattgacagttcaggcatgaactgtagatgagaaagtggaggcaggtgcttcccaggtccggcggatagagctctgtagctgcacttaagttcaaactgtgacatcttccagggtaggccgcgt

SEQ ID NO: 52832 - DNA, 2754 bp, Homo sapiens
tgggtccccggtgcccccgcccctctccattggcctttgttgccgtcggagcgccccgcttgactcgttccggtccgccccctgggcccggcggtcgcgcctgcgcactggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcaggtaagggtccccaggagggggaacggtgcatgctccaaggactgggggatcccgcatgaaaagcgtggtttccaagtgatggaagcgctcctgagtgaggagaagggctctcccacgatgggggcccagtttgaaggaggctgtgtgcagttccgggggagaaccatgtgaagagagccctgagatgggggctgtttgtccaaggaggctgtatacagtcctgcgggttggaagtaatctgggagaagggcctgcacgcacggaaggactcccagacatccgtggaggcctacggagaggcccggcaggtggcaggggacgggctccaggtgtccaggagaggagggggcgacacagatgggcctggagctaccgcatgccgggggcgggggctccgctgggctggaataggctaatgtctcttgggagaaggcgccagagctggactgtgagctccgccccactgggcctgacgcgagggcgagggtcagggggcggtgggtggggacccagtcccgggattaccccccgtgggtctggggagtcggagcggaggctccagagcatgcgcggaggtggcagctggaaggggctgcccgacgtggtgggggcgtggctgtccgaatacccccacctctccacacccccccgccccgccccgtttggcttggaaaaaggagcgcgctgatggggtgcattctctcttaggttatgctggcagtgtgcaaatggttatggtcccctcccccattttaggggctcttacacttggccctcagtcacagtttgctaagaatgggttgagggaagctgccaaagtgcatttttctgccacaggaaagactgggaccgaagcgatgggttctgggggtgggtcctcctgaagataggccttaggaaaggtattggttacggaggaatcaaggacagggcaggggctacctggaaggagttgtctgcttggtttgcaagtttctgctccaatactgagtagtgatgggggcttttaatccaaagattttccattgaattgtctgttaaggttacactctacatttataacatttattctaatatttcttaatattttcatggctcctatcttccactggatatctttccgttttcctctccccactccccagaaactgtcagggctgtctttagagccaagatctaaaccctacaaacacgttggaggatgggggagtttatagccttcatcctggtgaggcctaggtgatagccttaacttcttatttgcaggcaatgaggaggaaaagacataggaacagaggataaactgaggcaggattgcctcaagaaaactggagtccttaggatgggctgtggggtggtgatacctcttgtgtcttaagtgtcttaccctgtgatgggacgaggagcctggacctgggaatccttcaggtcatctctcaccacttccttacatttggtctggggatgggaatcaaatttccatttaggccatgaacttcattactttcctagtggaattattttgttttttttgtagcagacctaactccctcccaccctcccaaggaaatagctcctacgacctcactcaagttatccatttagtgatctctaagtacttagtgactgttttccctcttaacaaccagccttgtatagactgtgtagtcgtaaggataagcacagggagcaactgacttgagtacttcctctctgtcaggaccctctctccatcccaggaacttctgtttttcaaggctggggactatttccaacaacccatgaactagagtagtggggtaggtcattgaggtccacatggattgctggttgctggtacccattctagactaatgatttttatcctgatgaattcctaataggctctggagtgatgaaaaattgactttttaaaaatttgttacaaaaaataagcttataggaaaggagctagaacctgctgtttggagtcagccaaagccttgggaaaagccgaataggacaggctttgcctcagtaaagggtataattgagattcagtctggaagctgcaaattgagggaccccataactgcctccttcctaggcccggactgttctcttataagaagttagagtggtgtcccaaggtggcctgaggacataatacacaaaactaaagcgttgtgtaaaaaacaacaacaaaaaaccccccaaaaactaaagcattgttgctagcctcactgggcttatgcccaggtctgccttctgtgctcaggtgtgttccaagcacatacagtggactgggtgctccctgagggtagaagcagtgtctggtttatttgtagaactagcaagtgcctagtgtataggccctggcacagaatacatgtttattaattaaatcaaatcacattcaagtgtgaacata

SEQ ID NO: 52833 - DNA, 1261 bp, Homo sapiens
aaatgattattcagtctgggaggggaagaaggtgaatgaaatataagaacttggggagggaaaggatgtctcttactggctacacccacaaacgtgcatatttgtcttgtgtagtgtttataattgtttctgggcaattgcaggtgttcgtgtgtctgtgtgctgtgtgtgcttgtgtgtttttgtggtgtgtctatggatatgtttgttcattcatttcatatcagtatgttgaatacttcctgtgtgtgtgtcagacactggaaattaaacagtgaccaaggcagatatagtccctgcctttgaagaactcagtctagggcagtgaaggatatgtgtgtaagtgtaaattgccaaggtctaagtgtgtgtttggatgtgtgtgatggggatgtgtgtctgtctgtccgtgagcttgtgtgcaatttctgtccagcactttctgaggtaggcagccaggtgctagtagataggttttcccttccccatgtagctgagttctgaagaccttttccatccaggctgggccttcatttccctgtctgcagagtgggactgggcttggacaggtggttagagggaaacagagcagcttagctctgggaagctgcccctcccatgaatggttctgacctcttcctgacccccagctgagggtatgccccatccccccagcttgtctgactgtgaaagcagaagtctgataatgggaggttctgggctggtttatccctctcttctcccacctgggctagttctctactgccaagaacaatagcagcatattattccctttttttctctcttccccccaagctagaaaataagactggagacagcagccagactggcaaaagagggtaaagtagctggatctggccttaccctatccctttcccaagggcctcctctgtcttgaaattgatctcttctgctgctgtctggaccttctgtgtggaaggatctgtggggcatggagagaatcttgtgttcttcccagagccagtgtctcttctccagcattctaattgccacctcttcttcccaaacccgttagttctttctttattcaagcttttttttttatcattgtctccccagttgctgctttgtttcttcctgcctgagcttccaaccctaacctcttttgccccaccccttgactccagccttctctttctcctggcctttttcttttgtgacctccagctctgtcctcttctccaaccccctttctcttttccttagtctccaaactctg

SEQ ID NO: 52834 - DNA, 1002 bp, Homo sapiens
tcttactctactagaagaaagaaagggttttgttactaggagccagatttagtctctctgcttaacatgcaataggaacttattatatattaacttaatgaattaaaaatagacaataaggataattttcctaactggagagagattaaaaaagaaaaaagagaaaaaacacagatgagcttgagatgtcccctggaagcccttggctgggttgggtagcaggaaagaggcattctctatactctcgtgttcctgttctgggaggccttgttcctcctctgataagagtagttaggagattgccagactttaccctcaccagcctctttgtcttgtagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccggtaagtgatgcacacctaagccaccaaatctgaaagacaccaaccttgaaagaggggccagaaaggtaaaagaaaaaccagtagagggtagtatcaccaaatctaaggaagtttttgaacgggagatgccacgtcgggtaaatgctgaaaaatagtccaattggacttcgctattggaagattattagtggcttttgccagagcaatttcagcagaaagtagttgagctagttaatctaactacattgagttaagaaataagtacagtacctactacatttcaatattagttgaatgaataaagagttttaaagaatgagatatgggtatgtttacagattaaggagaaggagctagtaaagagggagaggttaaaggtatgggacagaggggagaaatgaatgggatgtccttgatgaggcagaaggacagaggggagaaatgaatgggatgtccttgatgaggcagaaggacagaggg

SEQ ID NO: 52835 - DNA, 1027 bp, Homo sapiens
tgcagggcagagagaaggtagaaacttgtacaaggtcagtcatacaactagtaaagcatcagagctggcattaaagccccggtgtcctgcctttcaggccagggctcctccgtgcccaggatgcctcacagggtgggggcctgtgcccgagggaccagttctctgcctgtccctgccaggtacacccctgtgggccgctccttcttctcaccgcctgagggctactaccacccgctggggggtgggcgcgaggtctggttcggctttcaccagtctgtgcgccctgccatgtggaagatgatgctcaacattgatggtgagtggggagagctatggagccaggggcaccccaagtccagtgaccacactcccagcctcatccctcccagctctgcaaccacactcctagtctaattcctacagccctggcacccccttcccccatcccaatgccctttaaggaagagggtataaattgctgtgcctccatgtattgtggaagacagaacctgagctgagctatctttaccctgtccccacagtctcagccactgccttttataaggcacagccagtgattgagttcatgtgtgaggtgctggacatcaggaacatagatgagcagcccaagcccctcacggactctcagcgcgttcgcttcaccaaggagatcaagggtgaggacccaacaggaggggaagggaaacagcgccactttagccctaagaggaaatccccttggggtatgctcaggggagagaccaagcctgggcacatgagcaacctattttagccctgacaagcagtgtgtgtatctcaggcctgaaggtggaagtcacccactgtggacagatgaagaggaagtaccgcgtgtgtaatgttacccgtcgccctgctagccatcagacgtaagttggcaggggtgctgagtcatactttgttggtggagaagggctgagatttaaaactatctttccctccctccctcccccactggccttgagaatgagccttggggactggccct

SEQ ID NO: 52836 - DNA, 1021 bp, Homo sapiens
agagatttgttagcaaattaacattatttctatttaaacagcagtttccaaggggtataatttatgttatgacttagaccttgatttctgttgttgcttatttaacatatatttatcgagctcctactatgtgtcatatactctcaggtgctaggaacatggagattaacaagacagacaaggtcccagctgttatggagcttacattctagaagggggagatagacaataagttgataaacacgtaaagtagtttcagatggtgataagtgctataagaataataaaataggttaaggggatagaagtaagggaggaagagggtagagagctattttagttgttagggaggtcctcttttaggagacatttgagctaagtcccaaattatgacatagaatcaaccttgtaacaacctgagagaagagccttccaggcaggaggaagtacaaaggttctaaagcagaagagaatttggatctttttgagggatagacagaaggctatggtggctagaatgtattgtgtgaggggaaaagcagtaggatatgattctgcagagggtcaaataatatagcctgttgaaaccacgtggcattttattactgttttttggaaaagctttatccaggttggctgtgtggctcatacctgtaatcccagcactttgggaggtcaaggcaggaggattgcttgactgcaggtgtggtgtggtcccagctacttgggaggctgaggtggaagcattgcttgaacccagtgagctgtgattgtgccgctggattctagcctgggcaacagagggagaccctgtctcaaaaaaaaataaaaaaacagctttatcgagatataattcacataccataaaattcaccattttaaaatgattaggtagttttagtatattcacagaattgtacaacagccatcaccactatctgattccagaacatatcactcctgaaagaaagcctgtattcattagcagttatgcaccattcgttctctccccaacagcctg

SEQ ID NO: 52837 - DNA, 1058 bp, Homo sapiens
tgtcctgcagatgaagaatgccagctacaacttagatccctacatccaggaatttgggatcaaagtgaaggatgacatgacggaggtgacagggcgagtgctgccggcgcccatcttgcagtacggcggccgggtgagcagggtcagggccagacaacatctcggggcatatgggggtggttgggttgtatagccaggggcttttgctcccctacccacctgactctactgaggctcacctaggcgccccctctacctatccccagaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagtaaggagggttcgctgtaggggtggaagggtgggaaggaccctggagctgcctgccttcctgtagtccacaggggctgatattgatcagtaatgtgttctgtcttgactctgcctgcattgtgctttctggctcaaacttctaccaattctttttctatccatctgtgatcaggggaagttaataaggagccatatctatgtcaaagatgatgattttagggcatgaatctcctgagagaggcctgaattattgttataattattatcattggtaataaatagtagtagtgatgactgtaatgtttacgccaaaattatacttaagtacctaatttatattctcttatttcatctttacagtgagtaggtggtgatatgtccattttcaggagactgaggctcaaaagaggttaagtaacttgtccaaagtttgcacatcatcaggaaagtgtcagagttggaagcaaatcagatctgagcttcaagacttgtgttcctaattggaaacaaaatagagcagcttgtttagctggttgtcagggcctctgtgccaccgtagctgggagtagatggcaccaatgaggaaagtgttatagccaaatggtttaaagaaaccaggcagtaatggcttaagaagtcaacaacccctcacctgg

SEQ ID NO: 52838 - DNA, 1004 bp, Homo sapiens
caggaacttgagaccagcttgggcaacatagtgagatcccatctctaccaaaaagaaaaaaaattagccaggcatggtggcattcctctagtcctacctactcaggaggctgagatgggatgattgttttagcctagcagctcgaggcttgagtgagcccagattgtgccattgtactccatcctggttgacagagcaccctgtctcaaggaaaaaaaaaaaaaaaaaccaatctctcagtgcctcttatagtgctaagcacctaagatggatggatttttgtcagaagaattcaagtgagactcactgcctcctttgtgaccatgcgtgtgtacaggaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatggtacagttctcttgggacagtgataatggtgataggactcttctcagcgtagttccctggggtctcctgggaaggactcagtctggattcttggctttgaccagagctgttacttaatgtcagtgctcctcttataggagaaatagcatgcctgagccattgagttatcccagatcctaattacctgcacacactccttcccagcaacatttactggggtcctttgtgtgctggtcctcatgccaggctatgctgggccaggtacagagacgggttggtctagattcctgtccttaggagtgcgttcctgtcctcaggagtgcattgtttatctgaacatcgtgcagcacaaccaagcagaataggtggtcctgttagtatcgtgttgcctggtaattacttggactttttgagaggcttgctatctctcctcttttcctctcattttttagaataagaatgattatataaatttctgtcac

SEQ ID NO: 52839 - DNA, 1050 bp, Homo sapiens
agaaattcgaggctagtctgggcaacaaagcaagacctcatctctacaaaaaaataaagttacccagtcatcttgtgcacctgtggtcccagctacttgggagtctgaggctaaaggatttcttgagcccaagaggttgaggctgcagttacccagcttgggtaacatagtgagaccttgtctcaaaacaaaacaaaaaaaactttttgaatgagttctctatattctctatgccctatacctcaccagccacttattctttagcctctttcagccaccttgccttctgtctacctttctcctaaatctcctctgcacaggattgccaatgacttttctcagttgtcctcttgacttctggatattttcttctatctctccttattatttttgtcattaccaggaatccttggtattctacaggttcctattgtctgccttctcattctgcctttacattttattaaaattcccattcatttcagttgcttcaatcatcacctattgctattatatgtgattaaaatcttgattcaatccttgaaccctctgcagctttggtctgtccctttggcctctctccctctcttcaagagtttattgatcacctattatgtatggaacactgtccaacatctggatatattgatgaataaaacagatatagtctctgctcttagaaagtgttttgttggaccatctcttcagtagtttgtcctctctacaaacctttgtctttactacttctgtatttgacatcacagttgcttctaagtaccttcattcaaacttcggagacagtcttgtcttttcgcttcaccttcattgttcttcttcaaatttttctcaagataatatgccctgctcttgatccacacttctcaactgagttctaaccttccttttttttttttttttttttgagacggagtcttgctctgttgcccaggctggagtgcagtggcgtgatctcagctcaccgcaacctccacctcccaggttcaagtgattctcgtgcctcagccttgaaagtagctgggattacggtgc

SEQ ID NO: 52840 - DNA, 1098 bp, Homo sapiens
ctccccttgctcttctttttagctgctatggcctttctgtttctcaaacacatcttgctgtcttctagcagggtgcatttttgcatgttgttccctctgcctggaatgctctctctcaaactccccctctcctctaagtcctttgctgtcatcagatttcatttcaatcattacctactcaagaatcctttcctgactaggtttttatttcccattttatgctgttattgttccatgaagttttctgttgtgtcatttatcagcgttgtaattttcacgatttttaaaattagtccctatttagtaagcactttgagagtaaggaccttatgtgtttcctgtcattattgtgttccctagcacctcatacactgcctggcatctagtaggcattcagtaaatatttgttgaatgcactaatcatttctctccctgcccttagctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcggtatgaactctgttgtccacttgcccttgtcaaggtaccatgctgggaattgatgaagagataggaccctggccaggcagactgaatcagacataagggggagaagagcagagtgggtactggatggtgccagctagagaagacccagcgcctcaccattttgttttctcttccttgctcagctctgccgtttttcaacagccagtgatattcctgggagcagatgttacacaccccccagcaggggatgggaaaaaaccttctatcacagcagtgagtgatattctgtagctgcctcataaggttctcctcttcgctctgagtcctcaaaactgcccatgatttccttccctcagctctggctcttgagccttcataagatgtccatttagctcgctattcccaattcccattcccttgatatctcataaaggtagctctgtatggtgtcttttttcagggagagtaatgagagtgtagccagagacttgactca

SEQ ID NO: 52841 - DNA, 1030 bp, Homo sapiens
agccaaaagttatattacaagtggcaactccttagttcagaagggtatgtgaactcaagaggaactgtgtatttctttgtttccctccccatttttttgtgcctagatactccactatgagctactggccattcgtgatgcctgcatcaaactggaaaaggactaccagcctgggatcacttatattgtggtgcagaaacgccatcacacccgccttttctgtgctgacaagaatgagcgagtgagtgagggactgaggcctcccatcccctccttctgtctcccttatcttaatagagaagaagcccttgagataaaggctggggatttagtccttgtcctatctatcctccctggccccttccctcctcctagctcttgtggtccttcctctgccaccgccttcactagtgtccacctcctcccgtccttcccttatacttcctttccctcctcctagctccctggcctagaccccatatatagaccagctcctagagaaggggaagggaactaccatttattgaactcctcctatgtgccagatactgtacaaggcgtcttcctcacagcaaccctgtgaggtacgtattattattatctccaatttaacctcagaaaggttaaacgacttgctaagatcacacagctaataggacttgaacacaggtctgtgtgactttagaagcatattattttaagattcagtaccctcagggaatagcaactttggctttgttcttgggattttggtgaaatcagagtagaattgagccagggtcctggttagggccaggcaggtcttgggatcttggttgtgtttgtctctatacagattgggaagagtggtaacatcccagctgggaccacagtggacaccaacatcacccacccatttgagtttgacttctatctgtgcagccacgcaggcatccaggtagctgggctttatcttgtggttccaatgggtcaaagatgagttgttcattcatattgcctctagaatgtatcagtcatcactgaatgacat

SEQ ID NO: 52842 - DNA, 1057 bp, Homo sapiens
tagtagagacagggtttcaccattttggccctgctgttcttgaactcctgacctcaagtgatccacccaccttggcctcccaaagtgctgggattacaggcatgagccactgtgcccggccaggactgctgtcgtaataagccctgagtacacttgcaggttgcttataagaagagtgctttatgacattggtagttttgcatctgcctgttcatgggtgaattatctacccagccatattcttaacagtgatcctgttcccctattatcagccatcttctctgcccagcctgggacccctcaccttcctatcttcccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacaggtgaggcctgggatcaggttggcctcctttttgcttcagcctattgtgccagatcttcttaactttccttgggtagaaggaaatgagtgctgtccaatttggtgtcattgggctcgtctgcccaatcctgggttgggtttctctcttaagttggtatgggaattggcatcccagggctgggcgagggaattagcagcagctctcagttcaccaggaaggacttctttcattttttccttttcagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagcc

SEQ ID NO: 52843 - DNA, 2092 bp, Homo sapiens
caaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttct

SEQ ID NO: 52844 - DNA, 1443 bp, Homo sapiens
gctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatat

SEQ ID NO: 52845 - DNA, 1402 bp, Homo sapiens
cataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattggaaaaaccaattctaaaatggctaaaactaggactttcaagttcaccacaactaccaccaattaggagataattgtaaaagaataaacaaaacctaattttgttcctagccaatattataaaccatgttccagcatactagataatagtagcatactatatttatttccataatttgtcttctttagagcctatgaactcctaggagcagaagctatattctcttcatttttgtcatctcagggtcatggcatataccaacagatcagtatgtgcaaatataattgaaataggctagtagtctgtggtttatgagtatgggctgggtgggcagtggatcaagaagtgataggagtacacaggatgaactcagaattcctgaatcttcaggtaagcagatacttaactacattatcattgtcttttcccactcaccccaagttggaggttctatggttttgtactttaagctggtggtataattgtcaagcatgtaaattctggcattcttcctggtactgctagagcattgttatttctatgcatgggggtaagaaggctcagagaaggatcctggcggataccccagtgagaaatcgtcagtggcagccagtgtgtacatacgtggacctagcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagctcaaggttttcagtgaaggcttgtcctggcacctctgggcattccttttcattact

SEQ ID NO: 52846 - DNA, 1039 bp, Homo sapiens
gatcatgcttggcttattaaatttgaaagtatgcttcagacgatcacaagttcgtaaattaattttcaaaatatttgcggggctgtcttgttactaatggtgttacaagttcctgaattccatatctctttttgccaatttgatataagaaaaacttacgtaaaagaaaccagtgacataacgatagctaagaactttgttgaatagattacgtgtcaaatggttgcaaaaaagcactcaaactggggagatgagatggggagagagttacaaattttttttttttttttttacaaattttgttacatggaagtttctctaatcaatttagaccatatctctttttcctgctccattgtttcgctttcccccatatcgtcttaaaaggtctgtctggattgtgaaaagatttcgactcttattcagttttgatttgtgtatttctgaaactgtcctgcccttttaaaaaaattaccatactactgttttactgtacaggagatgtgattatttgggaccataggtgatctttgtacataactgtcctgttgtcaagtctggaaaacaagtcatgaaggtcagaccctttattaatcatcccaaaacttttaaagatatttcaaaaaagtttttaaagttttttctttttctccttagggtttttcatatgatattgtgcccatatatatgggaaatgtcttagaaaacatttgttacatcaaaccacctagtcaactggtacaactaagccaagtacagctcagaaaatacattttacctcttcttttttgggtgtcccattgctgaaatggatacccatttagctgtcttcacatttggggaagtgtgtagttagattatcaactatatgcctgggtctcttgaaaagtaaagttttttcttcagtacagtttatacatgattgaatgtagcctaataatgaagataagctatactttggctcaagattgtcatcagaaacaaaattttcattattcctgagacttgtatataattggtatgcttagctttaagttga

SEQ ID NO: 52847 - DNA, 1029 bp, Homo sapiens
gcactttgggaggctgaggcgagtggatcacgaggtcaggagatcgagaccatcctggccaacatggtgaaaccccgtctctactaaaagtacaaaaattagctgcatgtgatggcgggcgcctgtaatcccagctactcgggagactgaggcaggagaattgcttgaacccagaaggcagaggttgcagtgagccgacgtcgtgccactgcactctagcctggcaacagagtaagactccgtctcaaaaaaaaaaaaaaattatattgttgccttctataaagtcatagtgattctcctctaagtgacttaaatgttttaatacttaaattatcgtgcatgaaatttttcttgtccatatgccacatgaacaaatatttggcactaaggcattaatcataatagtagaaagatgtattatagccaaacaattgccactttagttggagtcttcttagacacaatatccaggaaatgctagtgaatcattttgtgggtcaacctttctacaaatttattctttagattttctgtccattgctttttttgtcctttcctcaccccgttttgtgttggggggccaagttggggaaggagattctttccttccttcttttccccctattaaatgattttgattgaatgttagcttttgttaaaagagtatgtatgttaagtatatttcaaatgttactagtttctaataggtgaatggtctcaatgactaaaaaacaaatattttttagaaacattatgacctagagtatacattctgtaacttgagattttatgctagtttgtccaacctctaaatacaccttgaatagatagtatatgtatttattcaaaaccattaaataatggaatagatacatgttaaaaattatgtatacaacatgattataactgcaatatctattttaaaacatgaataaaaatttgaaggaatcttaaaatagtagtagattgtggttgcatttttattttatttatttattttttagacagagtcttactctgttgcccagg

SEQ ID NO: 52848 - DNA, 1050 bp, Homo sapiens
cttctctgctagtaaccacagagtaataaagataagttagagattggaaggatacaaagagagactgccagctgttttagttgtgttttataaacctctggatgattttgacattttgttatactttagcaatcttctttctgtctatactgtagtgacacattcatttattgtagccatggataatgtcagtagacttttggggaaaatattctttcatgttgtcttctgtagactagaataatatttttcattctgtcttttgggagcagagaattaagaggtacctaataaagtgagatggaggtggatctctataagcttatagtaattacaactcacaggaaaataatttgctctcctcttttttacattaaagtttctctcttcccatttttctgctgtataagtcaggtggtaaaatgggacttaatgaaattattattaaattttactttataatctgtgcaccagagcatgatggagtcaaaagagttggtatcagaatgtaggaagtagtgattgaagtaagggtggtaggataggctgtacccctttagaagatctaatgtattcaggtagatttcatttttgaagttattaccaattattcttaaggattcttaaattctcacgtgacgttctaaaaaatgcatcacagtataattctgcaagaattcttttcttctcagactaaggttattagtgaaaggaagccactaaagattggttagacattcttatctgtgtttactcagattttatttcccaaattactttcccaagcactgttttagaagttaaaatattttatgtatttttattagtctagttttactacttacggtaagctaagaacttgtttaacaatatacacttaaatattttgctaaaagtactgtatttgaacaaaagattccactcctaaccctattgttgtaataaaagactagtgtcataaaatatagaggaaactcagttatcagtttatgttaattaccagaattattcattatttgtgttaatttactatatttgatgctaaaacat

SEQ ID NO: 52849 - DNA, 1817 bp, Homo sapiens
taattttgaatttttagtagagacagggtttctccatgttggtcagggtggtctcaaactcccgacctcaggtgatccacctgccttggcctcccaaagtgctgggattacaggcgtaagccactgtgcctggccttgaatcttttaaattagttttagattatatcaatactatgtgagtacattctcattgtaatatatttagattttataaacaaaataaaagtgaccctgtaatcctgtcacttccctctctagaggtaaccaccatttggaatatatcctttcagtttctctgcttttacaaatgtgtgtacaaaaaatacgtattgatttgtgaaaatttggtatttcctatatagtctgtaagttttgaatatataagtattgaatatctttctgtgtcagttacattggctcagatgtttgctgggtaaaaatggaggttttataatatccttactagctaggtactgtaaggatgggaggagaaaggaacacaggtatgtttgctgctctcaggaggctcacagttagaagaattgaaaatatataatcattataatagacaaagtgtcctaatagagatatgtactaggtgtcttcttggtacagaggaaagattactcttggagaaagaagttaatatgttagggagtgcttagagatggtaaaagagattttgaatcactttctaagaatattttgcaggtcagatgtatcctggaatgattaagtaatatgctcgcttcattcttctctgtctagtgaaatgtatgtcatcttttggcaataatcaatctttttggtgtcttaagccaagattctaaaagcaaaatctttatcatatatgaatattttttagaattttgacagctttatacagtggcagaaattacttctgttaatatttttatatttcatcttacagaggattatgtgaatatattgtttcccttctttagggaggtggttgactcaatggttcagcattttaaagtaactatatttggagaccgtagaccagtttatgatggaaaaagaagtctttacaccgccaatccacttcctgtggcaactacaggggtaagatatgcattcctgtattggaaaggtatatttttgaagtgtctccttttacacgcatttattaccatttttattacagtccatatatatgtgaatatttatcactgattgtttttaactttttgttttgaaataatttcaaacttaaagaaaagttgcaggaatcatgcagagaactctcatacaccctttatgtagcttcactgaggttctgaacatttccacctttgttttattttttttctttctctcttgtacatacatacttattttttcctgaaccattcacaagtaggttgcacataccatgccccattaatatttattttattttattttattttattttattttgagacagggtctcgctttgtcacctaggttggagtgcagtagtgtgatctcggctcactgcaacctctgcctcccagattcaagtgattcttgtacctcagcgtcctgagtagctgggattacaggcacgtgctaccactcttggctaatttttttgtgtttgtagtagagatggggtttcgccatgttggccagactggtctcaaacttctgacctcaagtaatccacccagctcaacctcccaaagttctgggattttgggagtaccactgcactctgccagtatttaatactttaatgtatattcctaagaacaatgataaaaacccttgtacagttatcaagttcattaaatttaacattgatatgatac

SEQ ID NO: 52850 - DNA, 1047 bp, Homo sapiens
gagtaagccaccatacccagcctaaatatatatatatatattttttattataaatatataaattataaataatatataaatttatattataaattataaataatatataaatttatattataaattataaatttataaatatataatatatatttattttatttatttattttttttttgagcctcactctgttgcccacgctggagcacagtggtgtgatcttggctcactgcaccctctgcctcctgagttcaaatgattctcgtgcctcagcctcccgagtagctgggattacaggcatgcaccaccacacccagctaattttgtatttttagtagagacagggtttcaccatgttggccaagctggtcttgaactcctgacctcaagtgatcagcctgcctcagccccccaaagtgctgggattacatgcatgagccactgcgcctggccttttttttttcttttttttaatatgtagaactttaatatgcttccaaatttcaaaagtataccaaaacatatactcagaattgttctgtccttattttttccagtccattccctcccatcctttgaaagtaactagtttctttgtttctggttcatgcttcctgtgtttctttttgcagaagtaagcagatatgtgaatattttcctcctttcttacacaaaagatgtcataatatttgtaatcttttgtactttgcttttgtcacttaatagtatagcttggaaatttattccatggcagtttcaagagattttcctcattcttttttcatagccgcatagatgttggagcatttagggtagtttccagtattttgcaatgacacataatgctggcacgagtaactatgttatttaaattttatctacaaaaaaaaatggtatattttagtctattgactttatttttgccatgttttctcttagatatttttataagttaaatctaaaataattgtatttatctttttcaacatttaccagttgactcttttcccatcaacaggtagatttagacgttactttacctgggg

SEQ ID NO: 52851 - DNA, 1025 bp, Homo sapiens
ttattaagtgacatcagtaaaattactagatgttttcttagttgaccattttgggtcagttttatatccatcattttatttacttttaaaaaatttctatcctacatgcttcttactgtgcctttggtgttgtatatttttaccatgtgctcattgcattttagtcttcatctttttaattcttaaaattctttttctcccatttcttttctgagttctgccatgcttgtttcactacaactcctgttgactggttagttgctccttgagtttctaaatttctcctctgaactttttcttcataactgcattaggaatttttcagtgtgagtaaaaagtagggttttaattttcctctgctttgtgatgatattgtctgttgagttttctttgtcagaaatgtcgcggtgcctttttacatttttttctatggtattattgtatgtatacttaccacttttttgttgcttatattggcatgagatgagtttcccaaaccatctgttagaagggacttaagggtgttaggaacattaggaacaccttcggagcaagatagttttccaggtttctgtgctcaaggcctctctcctccattgttctggtggactctttcttcaaaatgcagccacatctcctatgcctctcagtaacttaaggggtttaagtaatatgaactaccagccatgagttccccaggtcctgactagttctgctaccaagggatgcacctcctaccctttaaattgcctgcctcaaatgttaacaattaaagaatttgtgacaggtatacaggagttttttgtactattcttataacttttctgtaagttcgaaactacttcaaaagaagaaattacaaaagagcatgcctcacttgtaaaagggtggtcctttctgagatctgtcacttccaaaccaccctccacttattgttctgccactttctacacctcctttccttacctccttctgagaatcccccatttaatctcagttctaaacattgtagttcccgcttggta

SEQ ID NO: 52852 - DNA, 1544 bp, Homo sapiens
ggatccttgaacccctagagtccacagatggacggcagggatccaagaactcctaaaatcatgtgctaaattatgtatatgtgcattttgctgagagtttattgcttacatcagattctcaaagggatcttgactccataagagggtagggatcacctactttaggaattattttggttacatttgatttttaatagtattggaaaagagctgtgtcactatattatacctctataaaagtgtcactttgcttctgttaaaaatgcctggaatttttttctcctgctttataaatctttaaaggacttctttcttgagctttacaaaattctgatcttcaagcagtatgtgatgactgggctaggtaaatatcacataatttgaaattatggaataccttgagaattattggatctcctctttcattcctccttccctctcccagcataaatacctgaatttattataaacaggattttttattaatggaagattttggcccttgatctatgggctttgcaaattttatgattttattttttaatgtgtagagcttgatggggtaaggaaaaattttgccattaggtctgtcatgactgtgaccattattagcaatgttatatgtaaaatctggtgtttatatcatcttgcctgtatcacagaattttttgtctgttcagaattgagtttttatggtaatgaacaggctttataagtataaatattttacatgtgacagttctgtaacctccatttttcttgttgggaacaggtttgaaggttgaagtgactcattgtggaacaatgagacggaaataccgtgtttgtaatgtaacaaggaggcctgccagtcatcaaacgtaagaaaagtttgtcagagcagcgatggtgtgaggcagcttgctctagttagtggggttgggagtttttctggctcataatgggcaagaattgttcatgtgtacttttttttcctcagctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtaatgccttcacactgctaattaataccctgttgttcatgattcttttggggtcttttatggccgataacttacctcatacagaacatttattttggaatatgaactgtttttaagttttaatttattctaaattttctgtaatgaaataacacgaaacaagttcatccataatcctaccactctaatgtaaccactgttaacattttggtatactatacttctttcagtcttcatctggtgtacattttacttaattatacttaattactgtagagctgtcttgtttactacttttttacttaacatattgaaaataagtggtttaatgaagttgattttaaatttttatttacatgtaattggcactaagtaagagctaaaaaaaaaagatatatacatgtagtacaaaacttt

SEQ ID NO: 52853 - DNA, 1050 bp, Homo sapiens
ctcctgagctcaagcagttctcccacctcagcctcccaaagtgctggaattacagatgtgagccaccacgcccagcctaattttttaatttttttgtagagacagggtctcactatgttgcccaggctagtttcaagcttctgggcttgagcaatcctccagcttggcctcccaaaatgctgagatcacaggcatgaactaccatgccaggccaaaatgtattattcaacctaatgcatacatacaaattttgtataaattaccaggaggtcacagaatttctgcagtccattcatgacccatggtccccaggttaagattcgctgttctgtagttagagcaccattgattagacctgttggaaaatatattatggacacagtgaagaaaaaaaagagggttctaatgcattaaagtaggggatttgggggaattttgagagtaactacaaactttttctatttttaggtaagaagtgcaaattatgaaacagatccatttgttcaggagtttcaatttaaagttcgggatgaaatggctcatgtaactggacgcgtacttccagcacctatgctccagtatggaggacgggtaaagtctcttgttaatgttttaatcatacacatattgtctgtaagtatgaagagaaaggcatatcagaaatatttcaattcagcgatttgaaatgtttactttctgtttattgaaaatttttgttctttttcaccatgttatttttttctcctcgtgtagaatcggacagtagcaacaccgagccatggagtatgggacatgcgagggaaacaattccacacaggagttgaaatcaaaatgtgggctatcgcttgttttgccacacagaggcagtgcagagaagaaatattgaagtaagacatgtcattaccttggctttgggacttttttgtgtttagactttaaattactcatctaatgttctaacagatgttgccttaatatgaagtatatgtaatcactgaaccatttttttttttttgagacagagtctcactctgtcacccaggctgaagt

SEQ ID NO: 52854 - DNA, 1016 bp, Homo sapiens
acgcctgtaattccagcactttgggaggctgaggcaggcagatcgtttaaggtcaggagtttgagaccagcctgaccaacatggcaaaaccctgtccctactaaaaatacaaaaaattagctgggcatgatcacacatgcctgtaatcccagctactggggaggcagaggcactagaatcttttgagccccagaggtggaggttgcagtgatctgagatcacgccattgcacttcagcctgggtgacagagcaagactttgtctcaaaaaacaaaacaaaacaaaaagagttcaaaattcaacagtgtatgtcattgccttctctatagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacaggtaatataaaagcataacaggttctcacccaaatcccaatattgtctgcatggtaggattttcaagttccacaagctattagcggagtcagtgatccatgtgaaaaatgatgacagaactgactgcccaaggtttcctattgaaatatattgtctaggctcattagtaatagaatcatgtagtaacttagttgttttactacattaattcaaaggagagattattggtaataaagtgatacattcagacagatagacaaaatgatacgatatctaggtttgcttctaattaattctggggaggtgagagaagtaaaacaaaattggccttgagttaatagtgattgaagctgagtgatggacacatagattgttacaccagtctcttatttgttaataattttgaaattttctacaacaaatagtatttttcggaattattacatcagaatagaaagtttgtttttgtgttcattgccacttctctt

SEQ ID NO: 52855 - DNA, 1039 bp, Homo sapiens
gaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaactagaattctacttttattttgcataccctactcctgactcctatctcatacacaattctgagttctcaactcttgatattgctgtcttaagaaacaaaattttatatatatatgtatacatacatacacagacacagacacacacatatatatacataaaataactttctgtgagagtgcgtctctcccctcccactcagaacatacatttaccatttgcgcaatttgtatataagcagtagcaacctgaactattctttttcttttttctttttcttttctttcttttttttttttaatgagacagagcctcgctctgtcaccaggctggagtgcagtggcgagatctcggctcactgcaact

SEQ ID NO: 52856 - DNA, 1078 bp, Homo sapiens
ctttctctatgtactctctcacctaattttcagtcactcatatatgctagagtggagcccttaatttaaatctatttggaaggacttttttaagaggaaaaatattttttctaaattataaagctttaccttttgagtgatttcttttttagagtgctcttacactagtcagcattgctagtttaaagttgattaacttgaaagagtatgtatactatatttctattttgctaacaaattggtatattaattaccattggttcttaattacaagaaaacttgtgcttagaattttaagataaaaggctaagtgacaaatgcttcttgaaatttgtcctatttattgttgcatttctggtgtagaatttctaatcttttttattttaaaaaagtttttttttttaagttaaacatgaaattcacagtgacccttctgctcctgcccttgctcactaactatatcatgaatgctagattttggtcttcttttttctgtgatgtatcttacgagactgactgtaaaatatcagtctggcaactagataattgattttcatatgaagaagagttgggagtttaatgtatattcttgatggttaatgtgtctacataaagtgctgatacatgtattatatcacagtatcaggttactggcatggaggaccatacacttacaatattgtagctgctatatttatttaagtagattctgacagttactgcactaaacagtaaggagataagcaggattcaaggctagtgttagacccttttttttcctaagagtaaggacacggaatatcaaagtaacaaagggtgctgccattttagtttcaatttaatatcaggatattctttgttttagaaatgtagattttgacttttacagtttgaaaaagggtacctcagcctcttcagtactggttttttggcacatttcaacagaaatattagattccctttctttttcttaatagtgatcttctaacaagtttcttggaaaaactatcattctaagggaaatccctgtttataacctattaatatatttctattcctagaagagagtctagcaggg

SEQ ID NO: 52857 - DNA, 1053 bp, Homo sapiens
atgtttacatcattgattaaatctcaagaatcttttgttcttaaaatatggaagttaaagattttaatttgaattaaagatagaaggatggtaaattcaatatagagggttgagatttaccagtgagaaaccctgttgaagtatcaggtaaatggtgtgacaaaattagaatcctgtcaaatcacctatccagccatcggggtcccttccttttttagactaatttctaaggtaaccagaatctaatgtatctatgttagggtctcagtaaagcaaagacgtttgtcagggcgtagactcttgagttaaattttttaatcattttttaaagcaaggcggttcttagaaagtgccttttcagaagatggtgctgtagatttttatttttcaagtagcacgaagctaagaattttaaagataaattattttagaactccaagagtgtgacagtttcataaaaataatgttagttgttgtcttgaatctcgtccaagggaaccaaggaaagcttttatgcagtaaagtatctaggtaaatgctcaccaaatttattttgtaaatttgaaaacaaaatatttagtagaattacctcttttaattcccaactgtgttggaggaaatccataatgcacataaaacagcaaacctacttaactttttaacaagattatgggtatagtaccaatgtccaaagggaaatgtaacttgcctggaatcataggcaacattttctaattaatctttttttttttttttttttttgagacaaagtcttgctctgtcacctaggctggagtgcagtggctcaatctcagcttactgcaaactccgcctcccgggttcaagtgattctcgtgcctcagcctcccaagtagctgggattacaggcatgcaccaccacacccggccctaattagtcattattaaggaggactgctcataaaggcagtaccaaatcatcattcagatcagcttaagtgagaaagcaaaatgataatctctattgttagagaaattttcttttctagacaccaaggaatattttaaatgatt

SEQ ID NO: 52858 - DNA, 1049 bp, Homo sapiens
aaactctagagtttggatttttaccaataaaccattaacactattttgtaacttagaatatttaatgttgtttatatagtgggcattaaagacagtctttagacagatttctacatgtggaggggaggtggggctttcctgtaagtttgatcctttttttcccctttagtagcaaactaacataacagattggatttattttacctgactacagttttggggaaacctgtcaaataaataattgttacatgccttttttttttaaatttaagcacattgaaactgcttaaatggtcacatttttcagcattaggattaagataccatttttgtaggcctggaaaacaaatagcaaatgattcaaaattcattgaattgactttgaaatgaaacttttcccccataatttgttatatggaagatttgctaccctgatcttttccctagcatacttctaaagttgattgaatccctgagtatcaatgaagaaatcagagtttaagtggctagggagagccaggtataaagactgattaatagagtacttcagctaattaaaaatttaaatagtaataatttatgaatgtgaataaattggaaggcagcaaaaagcatgattatagaatattaagttcaattatatatagacagtccagtttcctagtgaataggtcaagattatttgttttgttttgtggcactatcatagttcactataacttcaaactcctgggctcaggctatcctcccacctcagcctctgaagtagctgggactactcacatgcgccaccatgcccagctaatggtttttttctttagagatgggggtcactatactgcccaggctggtcttgaactcctaagctcaagtgcttctcccacatcagcctcccaaagtgctgggattacagccatgagccactgcatctggccaagatcaagattatggatattggtatgttaacttttaaaataaaagtacatgggctgggcgcagtggctaacgcctgtaatcccagcaatttgggaggccgaggcaggcagacc

SEQ ID NO: 52859 - DNA, 1022 bp, Homo sapiens
tattgtacaactagatggttattccctgtttcttggccgatttttggtacctttctttgaagaagagggttagattttaagaaagaaagtgtgcttatttcactcatgtctttgcagaatttaactttgctttactttaaaaattccaatcatcatgtacctataaaggttaaaatatagtgaaagtttctgcttcatgtgaattcaattctgagcacctgcaggtcatatcaggtgtctgatgcagttacctttatagatcgtggcaggtccttacatttcaacaggcttatgcatttccatggggggaagagattctgtttctaggaaattacaaagggcacaccactgcagggagtgtaaacaattctttgttgcaacagacaagattttttttaaaaaaagaaaaaaggatgcattttaggtacacagggtatggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccac

SEQ ID NO: 52860 - DNA, 1028 bp, Homo sapiens
taaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactattcttgccaaatatttctactgaaacccagtttcagcaaggcaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggaaattgaaactttatggtggagaatggatgagagcaagtctatgatatatatgtagtcattgtataattagaaacaccaaatgctgaatcctatcactgtgttcttgggggccaggccttggatttggttgtcatttaaactccttgaagattatatgtaattataatgagcagaaggcaaataaagtttttgaacaaaagtccttgttttcagtatttaaaatttggtaatatattttctttttcagttaaactatcttccccacaaaaaatattatacttcagttaaactatcttccccacagaaattattatactacgaacaagttatgagtgagactgagaagcttgaagaagctggtttttaagcagctcatataatattttgtgttaaagaaagtgtcattgtttcctgttgggaggcaaataacaacaacaacaaaagaaattgtcatgattctttctgagccaaactgtcacg

SEQ ID NO: 52861 - DNA, 1002 bp, Homo sapiens
gcctctacctggctgtgtcccagttggcccctggtccgccctcctgatgcttaagggaggcccacagggggcaagggcccggtgggagggcttgggggtggtcccggcctcggtggggagggccggctgggggtgcggagttagggttgctcgcctgcggaaggcagtgtgggctgcagtgatccaatggtctggctcagtgcccatcccccggagaccccatagtggccttcccacccagttagcccagtggtgaggagcggaaaaccgagactcaaagcacaggctggcgggaagtgcgcggcgccgcgactccgggccgctgggcggcgctgtgggcctggcggcggagtggaaactctaggccccagggagcgctgcggacggaagtagggaaactgtgagggcggcaccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacaggtgggcggggccgggcgcaagtcagaggccgtgcgggagggaggccgaaggggcgcggagcctccgggggcgacgggtcgggggtgcgcggggatgaggctgccgagggcaccggggccagagccggatgacccgcagacagcttgagctcagcgagtgccagtgcgatctccggccttatagacgtctcgccccgaacatcccgtgctcggggcgtggcagcaccggggcctcaaccgtgcagggtgtggataaacccatcgtaagttgaaaatacctgaagtggaaagtgcgctttcagcttagacgaccgttttatctggacgcagccccatcggacgtcgaggagcc

SEQ ID NO: 52862 - DNA, 1048 bp, Homo sapiens
acaacaacaaaaaaaacaaaggtgagcaggaggctctcatcctccctcctctccccacagaagccttgtactacacagatgacacagccatggccagggccctggtgcagtccctgctagccaaggaggcctttgacgaggtggacatggctcacaggtgagggggatggtcctgggctgaggcaaaccaggtgggaaagttattgcaccccttgaccagaggaatgacatttgtgcatgtccacgcccccaaccctccacagaagcctgtgtcaggctggcacagcttcccaagctaaaacagcagcactgctggtgcaggctccttaggcccccgaggctttctctttttccaaactagcctcgatttcttctctcccaacccttagaggcatcttgtaaatctgaattctgtctccccttctgttccctagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaaggtattcagggcgggctggcttctgggctgtccccttcctcttctgcagcagggcttctgtgacagcaggtctcctcctccctagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagtgagtatggggctggaggtgtgtggtgtgggtatgtgggtgatccagggggcctctggcattgccgcaaactgtaaaccttcctcaattgcagaccctagggaggcatgggcagaagcccctttatcttgtctatg

SEQ ID NO: 52863 - DNA, 1027 bp, Homo sapiens
tgtggccaggcagctaccccttcgttttcccactgtcccccaggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaatcatgtcctgttttctttctgcttatccccaggtgttttgttacaatggtgtgaggagaccaggtaggttcatgggccctgtctttctttgacttggtttagcagtggcttctctccacagacgagagtgtctgggaaacctgggagccagtataagcaactgaagccccttcagagtcgcttttggctctagtgtgtgcagcaaaatctagaagcagaccattattccagac

SEQ ID NO: 52864 - DNA, 1020 bp, Homo sapiens
tgacagttgcatcaaggctggtccagactctcaccacgctttctcttttgtgctgcttggtcctgactgccttttgaatctcttttagagctctgagctcttcaccctgacctatggtgccctggtcacccagctatgtaaggactatgaaaatgatgaagatgtgaataaacagctggacaaaatgtgagtgagctccttcataggagagacagaaatggggcctcccagcacactgagtctacattgtcctttagagcttaaaacagggttctctctctttcttagccaacattttgggtacatttctcactaaactcatttactgggatgtttttgagattatccccattttccctttaccaccaacaaccttatgttcaaacataagacatttagactccatcatagtctcttctctaacttccttcccaggggctttaacattggagtccggctgattgaagatttcttggctcggtcaaatgttgggaggtgccatgactttcgggaaactgcggatgtcattgccaaggtcattattctgggccacctgtccatgctgaagaattgctgctgagaggcactgcttaccactctttctatctcccttagagaggcctttaatctcccaaaagactggctaggcagctctttgggtcaaaaaaacattccaggtcgttagggaatagcatagattatttaatccctgtggattaaagccccactgaaatcaaagcctgagcttttccactgtgaaggtgtagcagagtagcatgggggtaaagaatacagactcggtcgggcgtggtggctcacatctgtaatcctagcactttgggaggcccaggcgggtggaacacaagatcaggagttcaagaccagcctggccaagatggtgaaaccccatctctactaaaaatacaaaagtttgctgggcgtggtggcgggcacctgtaatcccaggtactcaggaggctgaggcagagaattgcttgaacccaggaggcggaggttgca

SEQ ID NO: 52865 - DNA, 1086 bp, Homo sapiens
ttaggcattccccagagtttgccctttctactgacctcctattctcccagcccagatctctccaggagagggaacccaggaggctgtccccactgggatgcaggcagggtaaagaccgtcatgctgattgggtccaaaccccagctttgctactcactagctgtggagcttaagtaagtgtcttaatctctgaacctgtttcctcgtttgtaaaatggggtaataatatctacctcataggattatggcaaaggttaaatgaactaatgagtttaatgtgtttagctgtgcctgacaaaagcattagctgttgctcctgttaatcggactttctctgggcctagggaaataatttgctcagaaggagcagaagtgacctggatgacgctgtataaatattccggggacattgtgtctctgtgtgctgtgtgtgtctctgaggctttgtctgtttcttagaggaggtacctggccccgtactctgtgggtacatctgtgtgtctcagatatgtgtagagttttgaatcccagtaagtctgtttcctctgcatgtgtgtgtgtgtatgtgtgtgtgtgtgtgtgtgtgtgtgtgtgtgtgagagagagaggagaatatgtcttgtctctcgccattgtgcaggccctgtttacattgtctggtgtctgtctctgttgtgtgcacgtctgtctcccatgtgtctctgccctctgcctgcctctgtcttcgcctgctctagtgttgtcacctaggaatctgcagtgagggccaggagggctcttgctagaggtgctgatctctgttctgtcttctctcggcctcgtgcctctgcctctcccatgcttcctgcctgaggtgctgtctgtgcaccccccacgccacaaccagccctcacccaggcactccctctcgctgcccctggaggtgggctgttctcccctacctcacttcccgcctcttgggagccagcctgggcaggagcctgccttccctacattcctgtgctctgagctcagtgcctgcttgccccacctgcacccttcacttttgtgggggaagtctccctgggggaaccacggaatcacttc

SEQ ID NO: 52866 - DNA, 1037 bp, Homo sapiens
gcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacaggtaggaatgaagagaggggaggggtgggccgagcgagagaagccagcttctcctgtgtgggggtgtgggccgccagagatgcctgaggactgggagtgggacatggaaagaggagactcctgccctcagcagtcccaggcccagaacacaggccgctgggagatgacggcggtgtctgcgtgggtgtgctgacgcctgatcccggatccccctccagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagtgagtgcgcctcggggactgagggggccctcgtgggcgctggagaagaagcagaggccgagcctgagccgtttgctccgtcccccaggcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcaggtgcccccggcgggcgggaagcggctgggcgcgggcgccgcgggccgggagggaaggctggagtcaagtgccccacgctcatgggggtctttggcagaaagaggaggccgaagctcggtcgcgggaagaggcggagcggcagcgtctggagcgg

SEQ ID NO: 52867 - DNA, 1025 bp, Homo sapiens
aagtttagagaggagggatgaatttgctcaaggtcacaaagcggaagggagcgcagcagagaccaaaaacagggagactcgacttccaactcggaagcttttcaacaaggcaagctggcccggagtgggtggggctcagactctccctccaggctggttccaaaatggtgggggcagtggcgtcagcaacgcccccgccccttccgtccaccgccctcctccatctccaggccacccaggcggggggaggggacggccccgagcaacccacgtgaccgccgacaaccgagcgcgtgacgcaaagcggcgggcccaacgctcgccttgtcttttgggaaacgtagttctgatggcagccaagtcggccaggagaggagggcgtaggactacatttcccaggaggcagcgggtctacgccgtcgccgtcgtcggagagcggagacgctgggcgcgctgtggggcgggggcgaggttcgggctggttgttccgttgcgagctgcagctgcgatctctgtggtaggcccaggtgagtgagcgcctctgatggaagttagggcagcttaaccggctctagtggtttcgtctcttatcttttttccccagctgctggtcaggggctcggggaaggcctggcgtggagtcgctccccccagcttacaccctggcctcttctgagcgggctccgttccctccggctcctccccttccccgccctttaggtcttcccctggccccggcctagctcccaaggctcttggtcgccttctctgcagagcagctcctacgccgctttatcttgcagtcggcctgggggcggccactccctactcctcccgttttggtcgtatgaaccccgttatttggatttcttttcccggaactcccgagtgcccttccccccacccagtccccattggcctggttcggtcttctcctagggcgcatgtggctgccactcagtaaatgttagtaccgcttccgttctttccagcctggtggccaaaaacgggatagtccaaatttg

SEQ ID NO: 52868 - DNA, 1111 bp, Homo sapiens
tttcgtttgtggaagtactgttgtagtctgttctgtaattctagacagtctgacgtgtgtattatgatttagaagcttgttaaatagccaaaaccggctcctgccatgaacaacttgtggagcaaatcgggctcagtttgttctttgccgggagatgtattttgtgagccaatgttcatacgttaatgataagttttactgcagccatttgggcttaattgcattttgtaagagagttgtgttgaggtttctgtaagaagtgatttgattaaaaacctctatatccagtgtaattccatctctttgttttttaaacgttttaacaccagagaaagatctccaattttggagactgatgtttttagttttgtagactaggtacagttcaattttagcagtggtgatggtagtagtagtaccaccttagtgtatttatttaataccaaatatataggtacttttaaatttggtttagcctgcaaaatatggattacaaaaagagtgatctattttgttccgaggaattggagggaggaagcttggaatatttctgagattagcacagagatgggaaatgttgatgactgggagggtacacagacatacgatttattattattattattttttgagacaaagtctcgcgctgtcacccaggctggagtgcaggggcacaatctcggctcactgcaacctccgcctcctgggttcaagcgattctcctgcttctgcctcctgagtagctgggattacaggtgtgtgtcaccacgcctggctcatttttgtatttgtagtagagacggggtttcaccatgttggccaggctagtcttgaactcctgacttcaggggatcacctgcctcggcctcccaaagtgctgggattacaggcgtaagccaccgcgcccggccacgatttattatttttagaatggatagtcctaaccactaagcattttagggcgctaccctgtttctgtagggcatattgacatcctgaatgcaaggaagtctggttaatgctattctctcaaatacagggttttggtggattttttcacacatattctataaacatctaagatctgttcactgtttgactctggttgatt

SEQ ID NO: 52869 - DNA, 1052 bp, Homo sapiens
gtttccccaatgattaattgcatagatgatcctgagcttaatagacacgcattgactgaattctcagaggagtatctcaagttgcttacactggggatgttttgatgaaaaagttctaagtgaacttttagcttgctgttgattttccctgctaacatccagcatcgaagagatttgtcttccaaaggtgaatgtgaccttttgacttaggtctttcttgataatacgacctttccttctagcacacctcttcagtgtgacacatgctaatttagccaggaaagatataaaatgctttattgctgtgtaggaagatacctgatcacttattacttgtaggcagatttggtttttgtttgtttgtttttttgagacggagtctcgctctgtcgcccaggctggagtgcagtggcgcagtctcagctcattgcaagctctgcctcccaggttcacgccattctccttcttgtaggcaggttttaataaatagcaagaaaatagaatcagttatgaaatctgtttactcccagggaagttcctaaatctctccctccaaccactctggttctgtggctaaacatagtttaaggtgtttactcacttgtgtgtcaggcactgtgtatgtgcttccttaattctcctggcagtcctgtaaggtgtaggtcacatttggaagatggagagagttaagtattttgtccaggaatgggtggcagagccaagattgaacccagttcgtttttgctaccaaagcctctacttactgccgaacctggcccagtattacaaagtgacttgtccatttaggactgagcattttagaatgataatttgctttagtgtatttcctcacctaacacccaccttagtgcccctcttgaagtaacactgtattatggacatatggacagcccagaatggaacgtggattctagtctcagttgcttattgtgtgttgagattatgcgcagatttgctagttatctatctcttttggtcttaactgtgaaatattggtaacattacctttatctttttttttaatatctatt

SEQ ID NO: 52870 - DNA, 1392 bp, Homo sapiens
aaggggtttctccatgttggtcaggctggtcttgaactcccaacctcaggtgatcagcccgcctcggcctcccaaagtgctgggattacaggcgtgagccaccgcacccggcctaatttttgtatttttaatagagatggggttttcccatgttggccaggctggtctggaactcctgacctcaagtaattcaccccctttggctttccaaagtgctggggttacaggcctgagccactgtgcctggccctggataatttttttattttttattttttttgtagagacagggtcttgccatgttgtccaggctggccttgaacttctggactgaaaagcaagcctccttccttagcctcccaaagtgctgggattacaggtttgagtcaccacgcccagcctgtatctttaaatgttttaaacagttaaattaaatgaccattctccccagagggacatcacccccactttttaggagagtacccaatgcacatttggatattcttttctataaattgaagaccttagaattgaaattagtatttactgatttaccttacttaataacttgagagccacttaatagcagagtacatgtcatgaaggggtctctgatttgatttattcagggatggggtggagtatgaggccttggcagagtgttactctagagatatcacagctgccctctattctgtttctgtgtcttttactcaggagatgatgacctccagagaaaagagtaaaatagtaaacatgtttcatatttcacctgagctcagctttcctcccataactgtccagaggcattcagaacgcaagtcaggcccaccccactgctttgtctaaaacgctttatgggtggtggtatttctttcttggtatttttgtctgtcttatctctatcagttgatggcttgttcaccaagaatttcctacttcttccctttagtgactgttgaaagcatggctctcctgactggatgttggtggcagtgaagttttgttcaaacgtggcactagtaaatgaagtgtgtctccctaacgagatcagtttggtcttatgtgcctttgaataaggtgtagaagggatgagaatgatctcaatttctaggttagcagaactgtgatacatacataattttattccttgactgtattgttaatatttgataaactgatttttaaaattattgttccttcttgtgaagagaatggagattgaagaggaagcgtgaaagtgtgtttattcatttaacaagtacaaagtgtccactctgtggctaaacgcaaagcactgaagatgaaatggagaacaaatcagatgtggtctctggttcattttgtagcctcctgggtttggtatcctgaattgttaaacttatttagtta

SEQ ID NO: 52871 - DNA, 6899 bp, Homo sapiens
tctctcttttttttttttttggagatagggtattgctctttcctccagagctgcagtgcagaggtgtgatcacagctcactgtaactttgcactccctcctgtcttagcctctcaaatagctaggactacaggaacgcaccactgtgactggctaattaaaaaaaaattttttttttttttttgtagatatggggtcttctcaagttgcccagattaaaagaaatgtgtttctaaaatgtccaaagaggttcacatttgcaaaggaactcactcatttgttctaatgcattttcttacattaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgaggtaagggggtgtgactttgtatattgagataatcattgcatcagtcgatgtggatgtttgaagatcttttgttagacttttcctgtgagtgtcaaatggactggggggttggcttgaggtgcagggttgggctataagatattccaggtctctttaaactacaaatccagatcagctttgactgccatgctgattgcctgattcctttcctctgccagcacatagtatttcccacccactttggaagaaagaacattttatttttatttgagctgcttgcttcaaatctctatagctgattatttttcaccaaattatttttgaaggcttgaaccaaagtttatgtgcatcactgcaaagaaaggatagctaagaggattaataatatgaacaacatggcaaggaaaagaagcttcaactcactaaaataaacttacagaaacttatcaggagtaatttgtatacaatgtgccaattactaacaagctgcatctgtttagtaaatgtatcttaaaactttttaaaaatcgctattgaaaacatcactttatcttactgaatatgagcacagttcttttgaatttattgccagtatttcctaattcagtcagttttcacaccttcaggtggatttccctattttaattatgtcttggaataggatgccaaacctccagcgtctttcctctcttggtgtgttgtgagttggatttttcattctttaaaagtgtttaaactttcttttgtggatagataagaagctttcagtaaataacaagtttctatatgtgagtttgggaaatattggtgtatttaaattggtgtgctgaagaggaatctttgtacattttcattctttttcccacaagtacattagcaaggagatgatttgtcatgtttgacacttggaacccctgctgtttatttcagatgagtatctagaatccttgtcttagatgaattgattagctgtttatttcagatgagtatctagaatccttgtcttagatgaattgattacgacatttaaaataaacctcagaagtcagtgattaaacttttactcttgatgatttccagagccctatagtacttctaaggggtctattaaacaaaggattagtagttttgtttttttaccatttaacaaaaacaaggtagatattaaatggagtctatgagaagccagcctgaaaaagcaggtatgcataaatattgaaaagggaaaccctaaatttatttacctcaggaaattgcttttaaagccatgggaccagcaagactcttagtaactcctaccctgtacccagaatcttgatttagggagtttaaacctcagttttagctcatttggttatgaaagatacctttttaaaatttaatctagtaactagaagaaactaaataattggttcaacaccaagaggctatgcaaccaaaactgagagacaaaattgaattgaaaaatgttaaccaactctgaagtatttatgacagctggaattccgggcagttcttttctccttgttctgcaaatcatttggcacttgctcactgacttggcaaatgaggaaaaaatattttaggaaggcagtatgtgctggggtaggtctagagacactttacatgctatcatatacctagaagagacttttctggaggaatttctccactagaaagtatgcttttataattgattgtaatctgacttctctgtttttagaaacagataaatttgccactggatgttcagtttttatttctggcttatctgtttcatggttttttcttttgttttccctctcctgcaaggaaagtatctatccagagagtttgagaaaccatgcctttaaattaactaactgctgagttctacagaattggagaaaattgattatttccttgtatttcacagactgtatccttttaagtgacatctcttaaataacttcatttgcaatctgcagagactcattttcctgcatctgtgcaatgactgtgagttttggatgcagtatgcccagggccctcactagtaattggtaacagaagcagcagtagcctgtgaggatgggaacatgaattaaaccctccttagtgctggtggtggatcacctccctcaagcatagccctttaatcgggttgtattcactttcataatctgcatctgcctctcccttcttttcttatattgttactgttttcaaatgaaaagtgtggaaggtaagtttttttttaattgtacttaattacaataacaaccagcagtaagatatatctttgccagttgctcttattcatggtgtagataaaaaaatctgagtacagtgggcaataaatagtggaaaaccaatcccactttatctttagattaaattgaatgtactttcttcttaaaaatactgttttgtttagttgttaaatcctgaaaagaaactagtatatttgctaactggagttatttggaaaaaacaaaaatgcatctgttcccagtcagatatgagaaagcctgctgattaactgaagagtttttattctatatgtaaagaaaatattatttgaaagagttttctagtaaattttacttatttgtagccagctgcttaggagtagtggttaatgtcaatgatctatatcatagtagataggaaaagtggatccaagaaccccaatgggtttttacaccaacatacgtaatttttggctttttgatggaaacaaagtttctcatcattgacaagcctgacactcaggaatgtacagttaggttactatcaagtctctgtggttctggaaattcatcttgctctaccagagttatatattgttaaatggagaagaacacaacactagccttctgtgcacaccggggtgggggtgttttttagttactctttgctaacttcatgcgtccttgggtactttatggtccgatagtgccctcttgtggcacctagttaagatcatgtagctcagccacagaaatatgacctaagtagtcagaccatttccattttaaaaaacaatattttatgttttgcttatgtgattttagtaagttcttttaagctttgagcagatgcattctcccaagttttctttggtgtgtacctgttgtaactatacttttaacgatcccaagccttagtggtatcttaagaagttcatcccgcacaagggggagagagctgactaggatagggtgtggagtgttaccacattgtagataggggtcagagtacctgtctaggtaccacagctcacagtttttctctcgtttccaatgacctggagccctgttaaaatccccgtgcctgtgaaactgtaagctattattatggtatattaaaatggtctttgtgtggtttactaccttaagaaaatgttgatagtttttcagtcactgtagaagtacacctccattttaaatgtgctgcaatatgaatgaagtgacctgtgtttcatcacttgttcaaatgattcttatccatgtttttgtacttagtaagggccatacgtagtgggattaaatatttgtgcccttgctttgaaaacaaaactgaaagtgaatgacacataagggcagggatttcagaacagatttttcttgaataaaaatgcttgtgtcaaaaattcaaacatttgtctctttcctttccattccagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggcaagtatctcatttcccctgcctggttgtgtttttatctcactagctggcagtttaattgtaatgtgatctaagttagagctctgattaatggtaaaaggtaatccctatttcctagacttttcgttagtaaacattaaaagcatcacccaaggaaacctttaggttaactctagctttcctaccttcctgaatttgtattgcagcataaactttctttagactactctgcaatgatgttttcacatttaaaatttgccttggattctaccaatgtaagccaaagaacagtagagatttgtgggtcagctatcaaaaaaaagtatggtctttgccaaaatgaatggccattggagctcttagaccctctagcacccaccatctactatgttcgatctgcatcagcctatcatggtgaagagctgcaccctcaataccctccagttgaggagactgggcagaatgggaaaggccaaggcatagtccaggaaggccttgttttaaaaccacaaggtgggtgtatgtcccagtagaagccaacacggctgcgtgttaggagaggacatgacagtgcttccgtctttctcccctgggggacacggtgagttggaacatgaatctttgtttgtatggttggatggattgggatggcagagaggttacagggaagttgcactgggaccaggttgtggtcaagagggactaacccagcaagtggctccccctttttttttcttttatcgtatttagcatgttttttgatcccttgattcttcttggctgtattaacacgactttgacttgattaagctttctgcattaatggtacagatgagatgttttgaatctgtacttgccttcagtaagtctgttttattttatttatttatttatttatttcaataggtttttgggcgaataggtggtgtttggttacatggataagtttgttaatggtgatttctgaggttttggtgcacccatcacctgagcagtgtacactgtacccagtgtgtagttttttatccttgccccctcccatccttctccttgagttcccaaagttcattatgtcattcttatgcctttgggtcctcatagtgtagctcccaagtaagtctattttaaaacataagttttgttccatgccaggactgtgaatctctttagaagacttgagcatgagctctgcttttccataagaaagagaatgatgatttttgctgctgtcaccctctcccccattaacatgtattttgtttttatttgtgttcacagtatatttcgtatttagatcttctaggtgacttgaagcaaatttgaagtctctttttagacttgtatttccaaatgtgagttgtataaaagcaaaacagtccaaggttgaacattctatgttaactttgctgaaagcagattttaagtgactgagtgaaggttgggtaagaccttaagttattttttgccctagatcacattacaggtaagtaggtttttgtttttgtttttgagtatcctaaaaataacttttgttgttctctttggttgcttttgtaagacacaactccatggatcatatatttttctcttaattggcaagttcatagaactgtgaatggcagttttcagaaattattacgaagtaaccgcctagaaagtcctttggtaatacaggaatccataagacatgtttttttcagagaatcaaaaaccaaaaacggtaaggcactattttagagcatgctgttaagaagcctcttgtgtctctctcttgtgtttttataaataggtatctagaagagcagaagacagagaatggaaaagataaggaacagaaacaaacaaataccgataaaga

SEQ ID NO: 52872 - DNA, 1044 bp, Homo sapiens
ggccaaggctgactggttttttacttggtgtaaactactcaggcagctggaagtctatgtgaacagcattccagccacaccccactcccgcttcatgacatcacctccctgaatggccttggctggtcatgctagctgatctttttattgattgattgattgaaatggagtcttgaactcctgggctcaagtgatgctcctgtctctgcctcccaaagtgttgagattacaagtgtgagccactgcacccagctgtagtttatcttttaaaatactttctcatttgttgggtgtgttaaaaccagcagtgactaaggtttaacacttcactccacttgaagattccagtaagaaagagaagagagagattttgtatatacttttccatagttacagtgcactgagggttactttcaacttcggtaggaagaaaagaagtttatagatagatttaaaactcttcaaaaaagtatttttatggttttaatgttcttcctgtgtattgtgttctaattgggcctccccatatttctttttcagacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaaggtgagtccagaccctggcctgcttcaggctcgtgttccacacttagaagaaggatgaatgatgggtggataaggagttttgggggaccttgtatctcatctaaagggcctttgaagctaggggctggcttgaaggaaattccattcaagaagcagtttccatattttaattgcagagcttagcattttgaaatgctagtaacctgtgaccaagagaacaggtgaaatccttaacacaaagatttaaaatggttgaaaactgagaagccaatagcaaaatgacttttctagcatctctgtcttctcccctctaagtgatctcttatggacct

SEQ ID NO: 52873 - DNA, 2774 bp, Homo sapiens
tctcagtatgtttgttgtgtggatttaactactttaggtgcatctctgtggttacgggttcctgcaaaagagttaaaacattgtgtctgcctttggtaacataatgtgtttctttgtttctttttttttttttttttttttttttgagacggagtcttgctctgttgcccaggctggagtgcagtggcgggatctcagctcactgcaaattcggcctcctgggttcacgacattcttctgcctcagcctccggagtagctgggactacaggcgcccgccaccatgcccactagttttttgtatttttagtagagacggggtttcaccgtgttagccaggatggtctcgatctcttgacctcgtgatctgcccacctcggcctccgaaagtggtgggattataggcttgagccaccatgcctggcccataatgtgtttcttttaatcccaacagagcatcactttgggtcctcaggaatgacattacatgaacgctttactaaatacctaaagagaggaactgagcaggaggcagccaaaaacaagaaaagcccagagatacacaggtaaggaccatggccttatactggaggttgtaataaaagactttgtatcagacattaaactcaccttgttaaattctgctgctaatgcacctttaatacaaaatttacagtaacatccttcagactctaagagagctataggcatttatatttgagagtgtacaggacatgctttgggacaacagtctctcacattgggcctgaggaaaacagctctcttgacatagattaactcctatattcttggaagctggcaaatgttgcctgaaattactgtgagtttctgtaggtagagtaaatgctagtttcttttcttgtcttttttttttttttttttgagatggagtgttgctctgccacccaggctggagtgcagtgatgcaatctcggctcactgcaacctctgcctcccaggttcaagcaattctcatgccttagcctcccaagtacctgggattacaaacgtgtgccaccatgcccagctgatttttgtatttttagtagagacagggtttcaccatgttggccagtctggtcttgaactctcaacctcaggtgacctgcccgcctcagcctcccaaagtgctgggattacaggcgtgagccactgcgcccagcctaatgctagtttctttaggtaagcctgtatattaatatttcatggtagtttaatcatgggtagttggattcttctggaagaatttgcctgggggctagaggcgggagcttgtaggattatctcacagaattttaaagcccagcaggtttaaagactattacatttggttgtgggagtcagttcagtggatagggactagaaacaaagttggccttatctttgaggctatgggtgagtccatctttctgtgtgtagcaaaaccaggagagaacaaaaacctctaacttctgttacactgtgggaacctgggactgtgtgtgtgtgtgtgtgtgtgtgtgtgtgtgtgtgtgtctgcctatgggagagtataagtatataagagtaaaagtaatagatacataagtcatgaaacgtaaggaaaaataatgcctgtgaatctattagccaacttaagagctagaatattaccagtatcatattcacacaatggaatactatatcgttttgtattttcaattttaggagaatagacatttcccccagtacattcagaaaacatggtttggctcatgatgaaatgaaaagtccccgggaacctggctacaaggtgaactgttgatttgatcagtaattccaacaaaatgagtgcgttgggcatgaacttgacagaaatgtgtttgtttaaattactctctacttaagtttgtgtttttcttttaaggatgggcataattctaaaaatgaactacaaagggttaatttttattaaatgtatcaacaacctttgtgaagtggttagaatatggtaaatgaccccaaagtctattgaggtgagcttgagaaaaaaaagagaggagttttggaacaagtgcccatgatgagagaagaaactttttgtgatatttttctgcttgtaagtattatcaaatcaactgtatacatgcactatttccaaccatgatttcagaaagacatgcatgtcagagaagagtgaaatattcatgtcttaacttaagtagactgtttttaaacagctggtccagttttttttcctaacattgtaccatatctatcatctgtcaattactgttactttaaagctaaagattactttgatggcccagctacatttgcaatgatgtgcacgtaaacactgttaagaggttaaagcttgtatacaatctgttactgtgaaataactaaattgggctttaaaaaaatcttagtatttattgatcttcattcacatatacagttgaaatttaaaataacagatggttattccaatgctgctgaaaccttttctaaaaaatacttgttttgttggttgaatgtgatgagaggcgcttctgggcagtctctcttctctcccacccgtctttcctcctccgagtaccccttctccagctttgtactagccatgtaaaacccaaggttttctttaaaacatcagaagagatctcgtcctccatgccccaaaaaagccaactcattggaggtgttacccctgggagcagtgttgcatttgtctttttgtctttttttgctctttggaggatgcagaggcccagttccctctgttaggaaaca

SEQ ID NO: 52874 - DNA, 1642 bp, Homo sapiens
cttgttctattggccaggatggagtgcagtggtgcgatctcagctcactgcaacctccacctcctgggtttaagcgattcttctgctttagcctccctagtagctgggattacaggcacacgccaccttgctcggctgatttttgtatttttagtagagaacagggttttggttgttgcccatgctggtcttgaactcctgagctcaagtgatccgcctgcctcggcctcccaaagttctgggattacaggcgtgagccactgcacctggccagccttctcaacttctaaactagccagagtcattactgggccagaaaggaaacaaagtgagatcaatgcatagcattttcagaaggccagcatcattgttttggaggactggcgtgggttctgtgagggatccttatggagtaacttctgtgggacatcctgcatcccttccaagcttgggtgagatgcctcacatttcccagtgcttcctctgcacccctccattggagtaaaaaccacagtttgtgggatggttgagttgacagctctgaatcccagaaaccttaattttggcttatcttttgataggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagtacgtaagcccctgttaccccttccagactcttaagtttcttgtctgtcccctttgggctatacaccagaactttcaaatcagaggagtttagggttagtaattatagcaacctgtttcttcttttaatccatgtaaatgtcaggtagggtccctagtttgaaaacaatttctacatcaaaatagtgtgatctttgtccaaagaaggcttcatgagagaagttaatctgttaaattgaccacagggatggtgtggagaatcattagaatcatttgggaattccttttgcagttttagatgtacctttttcatcacacattttcatggggaagttgtattttagaaatggcccaaagtcattgtcaagtaataacactgtttagtcaaagaaacagggtggaactagatagtacatgattgttgatcttaagtgccttttaaactagttttacagacagttccaagagaggtgttccaggtactccttaaacaaaggtggcattgttgaactttgtgtggcaacattcatgcctatgtcctgatgtttctgtttacgtttttgaatgttccatgactttttaatcatgtgtcacgaaaagtagcacagttgaagccccataccttctggtaagaagcaacacttctgctgattttgaactttagctggcaagcattttttttttttttttttttttgagatggagtcttgctctgttgcctaggctagagtgcagtggcgcaatctcagctcactgcaacctccgcctcgcgggttcaagcaattctcctgcctcagcctcctgagtagctgggattacaggtgcccactaccacgcccagctaattttttgtatttagagatggagtttcac

SEQ ID NO: 52875 - DNA, 3964 bp, Homo sapiens
atctggcccagtaccagatactttggagctctcaatatagtgttaatttccttctcccttattaattcatgcctgtatcttagactgagctcctggaggccatggactgtgttttgttcctgcttctatgtatgtcatatgtttatcacagactcagacatagatgtgtcactgaacatgactgacagaattgagaggaagtatcttgggtgggtaggttgggggtgagctggctttataaggttactcatcatcagtttcttccatcacaggcatacttttgattgccctgtgcttatccatgaggccccagccaagcagtgtcccttagaaagatgattgatcaccctggctcttctcttttcacaggaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttgtaagaccttcccctctccccctttctctgagacccttgctcctaccagctttgatcacgtttcatcagaataccagttttgttgcctttgacataagtaatccaatccaaagaccctggaatctttggttctccttcccacatttcctggcctttccattttttgttacttttctgttcataatcacttagctagaaagcctcttatggcttctggtctcagaacttcccccacttaaccttgactactgctgtttatagggaggcccttggggcaggtttgtcctctgtgtaggctgcagacttgagatgagcagaaagggaatggctggaaaccagctgaccagcatatgactggaagacagctgtctattccacaccagaaaaatgtttgaacaaaaagcaggggggtttgttccccattcctggcatgatcctttgttctttttccctcatttattgcaatagcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttggtatgtgtctggggataaccaggaagggttagagggcctttgacacacagagtagctgataccaagccttaattagtttgtccaaaactgcgattaaatgtacgtgcaggattattgcactggggcatgtgtacttgcatagtgctaactagatgggtgtcctctagagaggcagtcctggtcttcaaagggtttatcactgaagatgtttgtggattccaagataagcaagaagcattggtcttgtctttttagtctatgaacttgttttactgctcacccaccaccaacctcagcctccctcatttctgtggatacagccataacccttccctgatgccgctgtccctctctgccactccttcatgcaagaatgacaagaaagaccgctcaggatctctttgaggaaagggatgtctctccaaaatgaaatgccagtggggcttctctcatctaggctgttgatcattcctgtgcactctgggcctccctcagattaatacttttataggctgaagtacctggccttgagtgagctctcttggccttgatctgtaacagcagactaagatccaagctggtgtgagtgttataactaaggtaaaggagcagctgaatctccatcacttgccaaaatggctggaatggatctgtattgtcagttggacagctaggaaacaggttgtgtgtggatggctatgcgtggccaccatcccttttctagggttgctgctgctggaagctgctttgaggctactagaggacctttgaacttatctctagggaattgtagttggctgggcccgggttaggtgctggagtgggactgctgtagggaaaagattaaaggccctctcccttgctcctatctgccacctgagagagtattgccagcctgattcgtttagtgtgaacaagcagccatggtcagaagaagctgacacctgctgagctgagctccaacagcctaagaccctagcttttgtgggggggtggtttagactctgaagtcatggggctgataaggtaatgactgctggttttcaaaatgctttctccttcattgtttgattggatccctccttctgtctcatgagattgtcagagcaaggattgtttgaaatgtaggttaatcctttccttgaactaagtgaaaaagaaaaaatgaaatgtaggttaagtgtttttcctaccccgtcacactgcctccttgcataaaacaggggagatacaaaatgagagtgtggaggtggaggatcaggaaagccccagccccaacattggattctgagcatttggagtgcagtggtatgatcttggctcactgcagcctctgcctcctggattcaagcagttctcctgcgtcagcttcctgagtagctgggactacaggcgcacacccccatgcctggctaatttttttttttttttttttttttgtattttagtagagacggggttttcaccgtatagcccaggctggtctcgaaattctgagctcagacaatctgcctgcctcggcctcccaaagtgctaggattacaggcatgagccactgcacccagccgcattgcctcctttcttagctgcctaacaacccagttcacatggagttgcacgttttggtgtgattggctttctcaaacccaccctttgagagaggatatactaaatcatatggagttgcttaaagttcctaagctttaagcacgtttgcagagtgggaggtgataatgatagggtagataggagaattaaatgagatagtacataaatgtcttacttcagtgctcagtgacgtttttattttctttaaactattaagggttcttgctcagtgaatcatcatcattgtcaatcatcgttacaatgcccaagctgttaccttaaaattcctaaatcacccaactgatattctcatggatctgaaccactggcatttttggagtgggggacagggagaagtgcagaaaaggatcaaaaggctgggttagggcacaggttcttttgggaaaggcacatttgggtgcgtgcagagaagagagctctggccacatcttgttcactctggcactgatggcaattttctttcccctcagcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatg

SEQ ID NO: 52876 - DNA, 1829 bp, Homo sapiens
gcgccccggaaaccatgggtaagtgcggaggctttgaggtggcctctctctgcaaccgtggacatagcaagagcccacaccaccccccgacccccgctgccctctacggtgcttggggacacgcccgccctagccaggctgcccggctgggcctttctgagccgcacgccggccccgtcttccgcccgcagaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggtgaggccgagccaggggcgggctgtggggtctcagcgcgcgccccccgggagctgagagcgccttccccgtgccctgattcccaggagatcccagagaccctgcggggctccggagaggcgcggaggccgcgctgtgcgcgccgccgaggtgagcgcaagggcggggacgggcgccggtgggcgggtgcacggagccagtgcgaccccggcgtctccggctcttagtgacgggcgcggctctgggcgggacctcggggccgccctgcggtctgtgattggttctcgagtgcaatgctccgccctggggcggggctggagggaccaaaggctacgtgcgcgccttgcgcttcccccagctcctctgactggggcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggaggtgaggggtgaggtgatgggaccgtttgggggaggatgatggaacgcgcctccctagtgagcggggtgggaagtgagggtgtggacggtgggaatggcgacggtgcagatacggggaagcgcgggagggaaggagggaggaaggggcgcttgggcagaaccaagggtggcagattatcctagggactcttggggcagaaccagacgcctctgcgtcctcccctctccccagattgaggacggctggtggctggggaagaagaacgggcagctgggagccttcccatccaactttgtggaattgctggacagtgggcccccaagtgagacctcgactctgtgaccctgtgactcgcaatctccaatgaccctcccagtggcatgagcctgtgattcacatatcctgaccctgtgacccctctgaccctctcccatgacctaacctgtgaattagcaccctccctaacctcactgtcccccactaggccttggtaacccagacatgccttcagtcagccctggtccccagcggcctcccaaggtaagttggctcagagtaggcacagaggtggtgagttcctcttggggtggttggaggctcatctagttcctccctgccccttcccccactagctgagcagcctggcctatgacagccctccagactacctgcagacaggtgagcacccatccaaagggtcccccactccctcagccactcccaaggttgtgacttggtgggccagctaggctgatggaggtgggggctgctgatggatgggggaggcttggcttcagaggacagtggactgacctcttcccagtctcccaccctgaggtctacagggtcctgtttgactaccagcctgaggccccagacgagttggcgctgcggaggggggacgtggtaaaagtactcagcaaggtgtgagacgaacagggtgggggggc

SEQ ID NO: 52877 - DNA, 1044 bp, Homo sapiens
acctcggcctcccaaagtgctgggattacaggcgtgaaccactgcacccggcctgttggatcatttttgtccagcttcatagttgccttgtgaagagaggatttgtccaccacctcattcagccagagccaaatcctgcttctgtcattcctccctcctaacattgctgtcacgctgttcattccttgtctcactgcacctctagtttacaaattctctagccttttggctctgtttactctgctctgtaaccctgtaccagtaacataagcaatatacatgtaaataagtggatttatgttgcatttctttttcaagaatgctatttttcatctctagtaattccattttctgtgtgataattttccaaacctgcatggttattcctgattgtcctttgttgcatgcacatcctgaacttcttcaaatgttttatacgtatctatgcagtgttctctacctgacagttccactatctgttgtgtgttgtgtctgctgactccattcttggtgacctgccctctagcgtgttttatgacctttatttatgagctgatagctggattttaatctgtgggactcttgcaggccttagtagaagaagacttcttccagcgagaatttgcttttattttttgttttgttttgttttgttttgagatgaagtctcgctctgtcgcctaggctggagtgcaatgatgcgatctcagctcactgcaacctcctccttccgggttcaagcaattctcgtgcttcagcctccccagtagctgggattacaggcacgcgccaccacgcctggctaatttttgtagttttagtagagatgaggtttcaccatgttggccaggctggtctcgaactcctgacctcaggtgatccacttgcctcggtctcccaaagtgttgggattacaggcgtgagccaccgcgcctggccgagaatttgcttttacttctcccagtagccagagaacaccacccaccagaagctgcttcggtcctcctgaagaaaggtagcactgctgtgtggtactgagcttgg

SEQ ID NO: 52878 - DNA, 1365 bp, Homo sapiens
cgggcgggggcggccggacccagtgtatgcggccgcgggacgcgctggggccgggcagccgggaagcggggcgctgacggtgagtgggcctggccccgggccggtgggtccccgcggggcggccgggcgaggagagaggcagcttcccttcccggagcccgcctggggcgtggaggctcagcgtccctatcctccatcccgccccgggacggcggaaccgggcctcagctggggacctcaccagggggcggggcctcccgcggtccccggcgctgctcccaggactggaggggcgtccgcgcccgggagaggggttccccccgacagggccccgggccgccacgaagttagggaagcgctctctccagggtggaacctgggcccgcggctcccgggagaggagctgcccgcggaaggggtcggggtgggctccaggctgggagaaggatctgactttgctgacctcgcaggctggtaggggagctgccccccagagcagcatggatgccccgcgaagggacatggagttgctcagcaacagcctggctgcctacgcgcacatccgcggtgagggcgggcgccggaagactgggggcctgaacccttccctgaccaccatccccttccctccccagcgccttgtccgtcccctccgccccgctccccgccctcttgcccgctggcggttccctaatgcccttcgagtaggggttacaggcctcgcccccacacctagaacctggggtctttcggaagtgggacaacccccacccgtccgggcctctccgtgacccccgccctgtgccccgcagccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccg

SEQ ID NO: 52879 - DNA, 1042 bp, Homo sapiens
aatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagag

SEQ ID NO: 52880 - DNA, 1048 bp, Homo sapiens
tctgccccctgactcagagttctctctcacccttcctgcttttcatttttcagatgattcatttctccctatttctttcctccccattccctgcactggagaaagtgttgggcctagggtgggggcagagacttgggcaccaggcagcagagggcaggtgatcttagggtgccccctggagggcagggcttggccgagcaacagcattgctgggccctggatattggaaggaccttccctccctggcccaccttggagctccacagtgagcagtgtgcaggtaggaccaggaggggccgtgcctgggagagcctcccagagcctcctggcccccgaggaaagagagttccaatccctacccacctccagcttccaccctttagctgtttggctaaaatcatcatcactagcccgcagtgagtgcctaccccgagggcacctcattcagccctcactgcgggcctgcgtggcctgtgttcttagccccatgttacagaagaggaaacagggttagagaggactttcccaaagccacacagcttagaagtagtggagctaagccttgaacccaagtctcatccggaagccctgctgtctcctgtggtgactggcacggggacaccacttcagcttctgttaccatctgcctagaccatcccagggagctcagcatggggccctgcgtatgtggctcctccaggtgctgcgcccccagcccagggcttgctcgtacctcttgacgtgcattagccgcctcagggctcagagaacctttgcgaggggccagacagctaaggcttctgaggtaaagtgacctctcacgcagccagtgagttaggaagcatgagtctgcgtcagtcccgggtccgcagggcggcctgcaaggggagttgaggttggctggagggggtcagggacccaccctcagcgccactcccacccccggccttgaggcctgagggtgtggtgcctggaagggtgactgcaggagccaggctgccagcactcttgcctgccctcctgtctgctgcgctgccttcatctgggt

SEQ ID NO: 52881 - DNA, 1030 bp, Homo sapiens
agaagagttaacagattcaaagctccggagactgctaagcaaggactgttgagttcctggggcaccgagtagtggaccatgcaccccagcctgaggaccaggtgtctggggggacctgggctcccagtcttcctgagaccagagtagctggggcatcatcacagatctcactgtgaagccgggatccctctgagcaggccctctagaggagtgtttgtggaccacttgcaggcgtgtctctggagggacgcacagccagatgattggaggatggggcagggaaaggggggtctgtccctgggagctgtgtctttgctcaccctactagtaagcctgcagcagcttccggttttctgggcctgcctcttcatgacgcttcctttgcttcagtcaactctgggtagcatgaaggggtggcaggaagggaggcagccttgctccctcttcccccacaagcatctttttcatctccctgcgcgtctgttgccatccttctgtcggcctgtgtcttggagcagttcccacgccatttgcttgagtcgaatcctgagatgggggaggggcgggtcaggctgagcccactgattgtctgtgctgcagctgctccctgcaaactgttgtctagaccatgcctgtgcgtaggcgcgtaggcagcgtctacacagatgttacgcgcctccatggtggtctccagggacctgggaaagaaagaggtggcttactgctcccgggaagacagagaacaggatcagaagggtggtgataccaacttactattggaggcagtgggcagcgcaggacaggcccagggccgccgaccctggcaatgactgtcaccagctggagggaaggtatccgttcactcatggagtatctgctgggcctggcagtgggctgcagtggttttatatatatgtttatacatttgtttttccttgtgaaatttttagttgtggtggaatttttctggtggaggggggcagacattaagcatataaacacaaataaatacatagttacaaaatctgga

SEQ ID NO: 52882 - DNA, 1027 bp, Homo sapiens
ctttattattattattgttaaagaatttctaggtctccttttaataaattggggcagccttatttttcccccagcaagtgaatctgttcttttgggttgaggtcgtacgtcctgaggggaacacaggtgttcccactccctaaagaggctacaacccaggccgggcgcggtggctcacacctgtaatcccagcactttaggaggccgaggcaggcagatcacgaggtcaggagatcaagaccatcctggctaacacggtaaaaccctgtatctactaaaaatacaaaaaattagccggacgtggtggtgggcacctgtagtcccagctactcgggaggctgaggcagggaatggcgtgaacccaggaggcggagcttgcagtgactgccctccagcctgggtgagagagcgagactccgtttcaaaaaaaaaaaaaaaagaggctacaacccaacggtgttcattctctcctggccatgacagtcagtcttgggtgtgagttcaggctccccagaacttagcagtctacaggcctgacggtttcaaaggaactctagttgttggaaagcaccagaggtagaaaaactgagaaggggtcttggcatgcagaataaagctgtcccctctaaatatgtttacacactgccacctacttggcaaaagagatagaagatcttcagcctttaggaagtctggatgcaagggtccagaaggaagagagagtggactggtcattgtagtgggaattggcaagagcaggactgatgtgcttgtcatttctctctggggcagagctgatgtgaggtgtgttgaggggacagcagtgcttctagggagaagctcggttcagcgccttggggaccttgggcctggtgtagcccagcattccgtggggcttttggaatcctgttgctggcatctgccaaccctggggagcaagagtcctgctactttttgcaataagtatggcgcttccagcattactgagtttggggtaagtttcatagtgtgtgttcttttctgactc

SEQ ID NO: 52883 - DNA, 1079 bp, Homo sapiens
atgcctgtaatcccaacactttgggaagccgaggcgggcggatcacctgaggtcaggagttcgagaccagcctggctaacatggtgaaaccccatctctactgaaaatagaaaaattagctgggcatggtggcacaggcctgtaatcccagctactcgggaggctgaggcaggagaattgcttgaacctatgaggcagaggttgcagtgagccgagatcaagccagtgcactccagcctgagtaacagagtgagactctgtctcaaaaaaaaaaaaaaaagaagaagaagaagctaatagcagcagcaagagagtactgtgggagcccagtggagaaagggagaaagctgtgagctcagccttgggggtggggtggggacgggagtgtgccatgaaaaggcttggcagaagtgatgctggagctgagtctaaaaggagaggaggggaggcttagccaggtgagaatgaatactttgagagcgagatagacaaataaactcatagtttattccagaaatctcagattgttcaatctagtggtatggaagttgatatggtgcaagtgaagcagtataggttcatgaaagaatgccatattagcaatttgagatatcatgcccagggcagccgggagcaagtgaaaaggtctgaagcagaggaatgacatgattggttacatattttagaaagatttcactggagtcccagtagaggagggaaggaggaggacaggagcgactgaagggctggagaactcttcggagacaaacctaggcttctgagagaggagagttggtgctggggcgatggatctttgctgaggaagcaccatgtgcaaccagtgccagatggcaagctcctgcattggcctgggcttctctgcctggcgcagaagtgcctggcacatgtgcccctctcttcctgggattgtaggttgcttgagcagctggagagataagactgccctctcagaaggccagttgtaaagggtgctgtgtttgctaacttgtgcttttaatctgacctttggggaaggcagtagattgtaatagttaagaggttatttgaggccgggtatg

SEQ ID NO: 52884 - DNA, 1050 bp, Homo sapiens
ttattgctctcagcacctctgcaacattgggaaattagagagtatttttttacagatgagaaaactcaggcccaaagaggttaagaaacttggccaaggttatacaataagttaggaggaaaggagtacttaaatttgcattttctttctccagatccagtgctcactttgggactccgctgctgccaatattatttcagacgtatcccattaacaatacacatcaggtgaccagaaatcctggtttgcccaggaatgtgctggcttactcctgttttcctggcttaattattaaaagcacccgccttgactctcagaagtgtcttggtttgggtgataagtgatatggtcccccgagctgtatggcaagcccagagttggttttcagtaaatgcttgactgaatcactgtttggagattctcacacctgattttgatatgatcccatttcttttgcttgtgtgtgggttggcagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaagtaagagtgccatcagtgtctcgcctctcagccccagtactttttctcatccctctgttaagaacaggtagatctatgacagagagaacaggatgaggaatggcaaagcctgccactctcccagaacattctgaaaagcaatccgtgtccattttggtaatgtaacaggcatcatcatcttatgtcctcttactgatgccttcacaattggaaaagcaatatacagagcatagccattttctcctcacttttcggaaagggacttggtggtggatgttctgctaaatcttggggaacaggctctccaggtctgtggagaatgggagacaggaagtgtacccctgctcaggtgtggggtaacaggctttgtcaccgtggagaggcagcactgctggtctccccgctgc

SEQ ID NO: 52885 - DNA, 1123 bp, Homo sapiens
ggcatttgtactcactgctctgcccacaaggacagaccccgccgtcctcttcccagcaggtgaactgtctggatgctggcgccaggagccatggtgctccagagcttcttcacttcccacggggaaagacttcattttgcttttcactttgcccgagtagctaacaatcaccttggggtattctttcgtccagaactgatttatctgggtgtaagctatttccctagctcctaataagggctcaaagaccccagagaaatgactcagcacctaggtgaatagcagccctttgtaagcattaacctaaccagagttgatgtgatgcttcaacttgaattcttctttggcactcctcctccctggcttacgtaagtctgtggaaaattcttcatattctctcttttgaggacttatgtgtggcttttcaattgtgcctgtttccttgcaaatgctacattttatgtaggctatggtaagaaaaaggttagaaaacccagtttattgcaggttctttcttgtttcagtgcaatggaggtggtcaggcatgaggcaaacctgacagagttctatgtctctccaagctgtccacggtggggaaatgttagggcacatcaagggcaagctgggatggtttgaaattgtcagatgtcagggacatcctgtgttggtaatggatttggttctccctcactgagtaataggatcaagtctagtgtaaaatctaaaggtcaagtgtgagtttagcatttctgtatggagccacagtcagttcatttgtgtcaccgggggtgtgtgtgttggggatgtatcccctctcccctctctctgtagctcttccatttaagatttaagtacaaccagccctcagctcccccttcccccataaaatgtgttgaaatgctttaaaatgcgggcctgagccctccgggtacttctgtcaattacttacaggttgagagtgcctaaaataatcacttcactgctctaccttgcctctgctctaaagagacatggccacaggcagtcatctggagtgtcctttgtgttcagcaaaagaagaaggaatttctatatttcaataataaccactcatgtttaataagtgattttgtataattatttt

SEQ ID NO: 52886 - DNA, 1106 bp, Homo sapiens
gtaatgagaatctcttgcaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggtacgagtcagaattgcggctttgcttggccccactcagggactgggatggaggaagcagaagggagggatcatctgtttctgttagaggcatggaactggccccaggccctggaatggatccagggaggtcacaggccaccaaccccatggagaaaggctggggttaccatctgggggaaatagttcccatcccacttgttccaagtctgaggttttgcacaggattacaaggtctttttctgccccttttcatccccaggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttctttctgtcttgaagaatgataggagagatgatggggctctttttggcctgaagaggagaaggaatttattctttcattcagctctgagatcccagagttttctgaggcagagtccctgcctcacccaccagaggatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaaggtaagctgaagctgaagtgtgagaagctttatatgct

SEQ ID NO: 52887 - DNA, 1200 bp, Homo sapiens
acaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggtaaactctggacgtcattcacagttaaacagcagcagcctgggggaaaggggtccggaggggaagggctctgggtccagagaaggaggcttagaagccactgaaaatgcttccctcctgcctccagaggacttggagccttacaaggccatgctgagtgtcaccaggggttaagaacacaaacttgagagcatgatcactgtgtctggcacatgctgagtgctcagtaaatatttgttgaatgcatgaatggagtcagattgccctgggttcaaatccgagctctgccacttccacttaagtagctgtgtgatattagggaagtacaggtctcagcctcagttttcttttcaataagatggagatcatacaaatacttgctcacaggattgcaaggattatgtgaaataataataacagccaatgtgatgcatataaagtctttaggccctgtgctaagtacttcacatgcatcttcttatttgactctcatgactttttttt

SEQ ID NO: 52888 - DNA, 1050 bp, Homo sapiens
aggtgagcagcctctgccaagcctcagcctcccgcagtcttctcctctgggactcccttctaccctgattagcaccccgcatctcatgcttctccagtcacagcacttagcccactgtcattctgcctccatttgtcaatatccctagacagagcatcttcagggcagggacacttttgttcccccaccatacccctagcacctgacaaacaggtgctcagtgaatgaatgaatgagcataaatgaatgagcaagctttggggacattcatgcaacaagtcatttcctctgtcagtggctttggctttgggctcacctggatgtggatagccatgtggttggtcaaggccacagtgagcagagtgaagtcaggccctgagccttatggccctagttgctataactgtagccagggcccttggggggaggagggctagttcttagagggtggcagactccacagattttctctgtctctgtcttcaacagaaggagatgctaaaaatcaagcaagaacagtttatgaagaagattgttgcaaacccagaggacaccagatccctggaggctcgaagttggtcggggacccttggggagtgggggtgtagggaagcctgctagctgggacctgatctagggctcttgtctacaagcacatgcacatgggctggggaaagggagagacatgaaggacctagggcaatgaaaattggaccctgtatcccaagctctgatgctggagtcaacacccagttggaccttgtaccactgtgtgagcttgggtaagtcaccaaccctctcttggagcccctgcttcctcatctggaaatgggggaataagggagagcagagcagaggtaatgttacccacctcatggcagcattgtgagaggcagctaggggatgtaaacacaccttggaaactaaagctcacgatgtgtgataataatagtaagactaggccaggcgcggtggctcacgcctgtaatcccagcactttgggaggccaagcaggtggatcacaaggtcaggagatcaagaccatcctgg

SEQ ID NO: 52889 - DNA, 1047 bp, Homo sapiens
aggggtgcacacaccaagactgaggttttcctgtgatctctacttggtgcttacatttcaggcatcgtacagctagctgcctttcctcaacccccttaattcatacatgcagtcagccagcaagtgtttgttgagtgcctagtctaggctgagccatgggccagactatggtggattccaagggagtcaaactctgtcctatccacaggaggacccatcctagtgggggatctgagaactgtagagccagataggtgtgtgaaaggtgcaggcacagtgtagggtcttgggaaaagccacctactcgcaacatgaaatatcaaagcaggtgcccacggagtttgcaaaggagaaactgagccgagagatatccagtgctttgcttgagaccctgaatgtcccttctggagttggagagtgggtgaaaagagccaggtctgggagggtgggcagcgagagttgactctgggtgttttctatccccatatttacttgacagcccagtctaggctggatgatgacccacctccctctacgctgctcaaagactaccagaatgtccctggaattgagaagtaagcaggaagaaacctagtagaggaggcagggggccctgggaggattgtcggggagtggggaaagacagtggctttgagacttggcttgctgtagctgaagcttgatctagaaggaggcaggggcccaggtgtccaggtgtggtgagggtgggtggtcagcaaggcagatggcactcatggagctcggctacttgggggtttttttgtactctagatgaacaccctgtaccactagattccaaggagctaacatacttcacaggtctttgtagaaatctctcatctcttgttcctcacaaaagctgtatgtccccattttatagattttcaagctgtccagtgtcatacagttctaaagggcagagctagagtttgaatccagggctgactgacaccaaagccagaggccctctgctcagctcctatgcagtgtggtgggagctggtcagtccctcccactgtgcaattt

SEQ ID NO: 52890 - DNA, 1036 bp, Homo sapiens
ctaggccaggccagttactgccctattagtgggcttccttgggtgagggagctggacccatctttctggggtctgaggccccctttcccatcgggcagctggtttatgtccccacagcactggggtgggcaggtggaagggagaagacagggccatttttcctaaaattcttgccaggaagagtggccaagagaagtcaaatgacctgtgtaaggacagagagaggcaaaggcaggttcagagattctgggatcagagcctaaggccagcattctcccctgcttcctggggagtctgacctggatcctgagaaggaagaggagtttccagaggtagccagtctgctcctttggtcccatgtcctctgccattgcagcctggaaccaggggacacagatgggggctcctgcccatagataagcctctaggttggggggcacaagggagtagagggatggtggcttttgcagcctccttgtggttatactgttcttatgagtggtctagactgctgaggtgaggctggatgtgttatctctatcacatctctgacctcccaggctattctatgtttcctggaatgtccagtttattcaattcatgcacttatttatttacccactcccgtgccccatgagctcttctttctattcaccctctcactcacccatttattcacccatctacttacccattcattcatctatgcacctacccatccatccatccgtccgtctgtctgtccatctgtctgtccatccatctgtccgtccgtccgtccatccatccttccatccaaccatctaactatcaactcagtcatccatccatcatctacgcatccatctgtccatccgtatatctatccaccctaccatccatccattcacccactaattcatccatttattatccatgcatccatctgtccataagtctatccgtccacccaccacttatccatccatccatttacccatcatactcatccattcattcatccagccaccacccatgcactcacctatccacccat

SEQ ID NO: 52891 - DNA, 1109 bp, Homo sapiens
ttgggcgctccagggcaagacacaggggagaagaaaaagagctgggtgtcagagtggatctgagcagtgtgagccactgcactgcagaaagacagtgagggggagcgtggggcagggtgtgtaacatgaggaggacttcacctgcccagagaattgtgggggcagggataacataggagctcagagtcctctgttaccctgctgtctggaattttccataataaaaagttttttgaaaagaagagcgcacattttgctacaatcactgtcattatttctaggccactgagatgttccatcagcctccagaatgtcccgggggagccccctgcagcatcttggtagcctgtctgccctagacagggtccaggtggcctcccctggaactggagtgatgcttcttgaaaaatgttttcttgggatggagaaggcctttctaagcaaggcacaaactcagaagccataaaggaaagtactttcaggtttgacctcataaaaataaaaatcttcaataagacaaataacaccataaacaaagttaaaagacaagcaacagactaggagttgaagggtaaaaaagaaaatagcctcaatattccccacaaacatctctccgtatgaggagagaagtcaagaggaataattcctctgagggaggtcttggtgcagtggtgtctccactggaacaactatgaattaatacaacaaaacttcctctatcagccagaaatgaaatcaccctttttaggtggaccacctgcattagtcagttttcacactgctgataaagacatacccaagactgggtaatttataaagaaaaagagatttaatggactcacagttccacctggctggggaggcttcacaatcatggtggaaggcaaaaggcacgtcttacatggcagcaggcagagacagaatgagagccaagcgaaaggggtttccccttataaaatcatcagatctcgtgagacttttttttttttttaagacggagtcttgctctgtcgcccaggctggagtgcagtggcacgatcttggctcactgcaagctccacctcccgggttcatgccattctcctccctcagcctcctgagtagctggg

SEQ ID NO: 52892 - DNA, 1939 bp, Homo sapiens
gctttcctgcccagaaagggagttttccttcagagaaggatggcgaagtccttgatgctcctctctgagctgctcccctcagctctgcctctggcccctcctctctgccccaagggacctgtggaggtgggggtgggggatggtggctgcttctgccccaggaacgtcttctgctgagcacatcactcttgccgggaaggtagggagggttaacgacagggaacccctgattgaacacctactacgcgctgggccctggggtgagacagagatgaatgagatgcagcctccaatgacaacacaaagggtatcacctgacagaacatgattaattgcagaaggaactgcacagacaacggctagggctggagtttgcaggcagagagccccgttctgaacagggagccggagcctcagcgcggtgacgaagcacttattcattcattcggcagatatttgttgagtgcccactatgtgccaggtttttttctaggtgcttggagctatcactaagaacaagcctttgcttgtcttaaaaaaagtctttgctcacctggagtttaaaatcccatggggatgacaatgaagctaatttcagatggtaaatgctctgaagacaatggaaaaggctggtgaggcagatggactggggaggcgttgttagatgttgaagtcagaggaggcttcccagaggaggtagcgtttgatcagtgacttgcagctggaggagccggccatctaggcaggggagacagcgtgggggcgtggctggagggtgtcgtgggaggggaggggagaaggagatgaggtgggagtagggaccctacctcttctctgagcagccttgctcctccccaggttggcctctttgcgtgtctttgtctccgttgtcaatgtccttttctgcttgaaggtcttgtggatgcaccctgagggtcacagccagctcctggaaccagggtttcctcgtccccatctccgccctctggcctcacctgccgctgctttctcggctctgcactccagacttcaggctcttcacaccactgtgcctttgcccaagctatgccttccatttggaattcctctctgtttcagcttggcaaacttctgctcctccttctagacacagctaaaacgacaccttcccagagagggttgacaccccctcctctgaatccttccatcccaaggctccctctcttagagcacaggacacattgcagtaaaaccactgtttcccggaggtgggccctattcatcagtgtctgttgatgagtccaagaaggaggtcccttttttgtctatggctctttaacttctgaggggactcctggctggggttgcagctgtcacctttgggatctctctctgactctctctgaggctgaagggggaagaaagagaatttgctctctttgtttcctcctctcccccatggggaggtacccgacatactggcctaggctgggggtggagcagccccctggcttgggagtttgcacttctctgcaccaggaaatgacttggagatgctctgtcaagcacaagatataaattgcaggcagtttttaaacgtttggagagattgctttttgagtggcaacctgcatctgtgcatatcggagggggcggggcagggcttcatttacttttctctattctctctcctccctggggctcagtcccttcttggccaggcaggaccctggctcaggcctggggtaagacgtagggggctctggacaccatggggcctggttgcaggggttccccaggcccagcctctgacctccttctgaggggagctgagcgaggggttggcaggccctggccaaggagtcagtggacaggccggcagacaggtaacaggcttacctgctggtgggcggtgtccccatccccactccccgctctcaaacaagataggctaagggga

SEQ ID NO: 52893 - DNA, 1012 bp, Homo sapiens
cctccccagccccatttgacccagagaccagctgtcagggagcgacctcagagccagaggggtgaaagatgagaggcaagaaggtagctcctatcctagcacagcccaggctccatctgtctgcctttctctcccctgcggcatcctggcagggcagttggcagagtgccccctccccaggaggctgcagatctctgtccctggctcacccagatcggtctgttctctgcagttccattcctttagcctctttcgcaggtctgagcatctctggagcatgcaggggaggagatatctgaggtgggcttccgtgcagtcagcagcctgccccagcttcagcctcaggcgtcaggctggtctgcactgaactctgggtctgcctctggggccctgaccaagcacgcctgactccagccccatgaggagcatcctgtcttggttccgtagggatcatgggtcctcttaccactgtgcgccaagcccccagcccacctctgcctgggccgacttcctggttgggcctcccatggtaggggcctcagttcccaggctctgggctgagcccccagggagcaccatgggcctctgagaccctagacctgtcccaccacccagaccagagtgcctggacgccccccactcccactcaacatggttcccacacactggtctctgggccattcaggggatgccctttgtggacatgcagaatttctatgaatatagttttttgtaaacattttgtaacaatttgggtttcatagtaactgtgttacttgccaatcattctaggctgatgtaaataaatttccaaacaaatctgattattttcctttttaagacactgtgatatatcaaagtgcacagtttgctgtatgaagtaatatggttttaaattttaaataaaatgtttctagaaaacagggctcccttgaggcgtgttttctgtttctcttctctccttagaatgagaaggtgctgggcgacgaacttttgtcatcttcccccaggg

SEQ ID NO: 52894 - DNA, 1962 bp, Homo sapiens
agtttaggtctgtcctgccagtgggcatggagctgagctggggcaggtgcatgcgtgtgtgtgtatgtgtgtgtatgcatgtgtagtgtgtgtgcacacacgcaggcactgagaggtgatgggaagcatgaaagcttgcttggatggagcagaagaaggaacctgcctgagcagatgctggactgtccctgcgtggtgccacatgccagccctgaacagaagaatgtccccactgcatccccaaatgcaagtgcctcctctccacctgctcaagctggccaagttgaggggcagtggtaagaagacaccaaccccaccgcccctgccgaggccctgggactaaggacagtgagccctcccaatcactctccccttgtcctgctgctggtttctctgctctggacagaagaaaatcctgaaagcgttgtcaatgttcaagtggccccatgctgcaagagtctctcgcgaggggtgacgcccccttggccagtgtgctggactttgagtgtctgaggggtaagagggccaccccctcctcacagccgagactctatctaacctggaagcacactctggctccacccccaacccctgccatgccctaggccctggaagatgggaatcctggcccaggccagggtaaagggccaaacaggttagaagttgctcccctccaccaggcgtgcactcaccaagaacgatcaaaagctccctttctgcctacttttccaggggtactgggtgtggggggtgggtcacagctcctgcttcatcactcagcatgaagttggtccctccctgagccactcccagctacatgcacaaacatctgaaagtaggctggcctctctggctcacatctggagtggtcctgtgtggatacccatctgcaaaggggctagaggtttggacaaacagctgcatggacttatcatctgggatgggcccagcctcatggacagatacaagaaatgagcccaactctgtgggcaggtctctggattagacacatctgaaagttgcaggtcaagtggacacatctggaagtggcccggctgctggctgccatggaagggccgtgccctctgtccccatggcagtttaaatcaggccttcccttcagtcctggatttgccctggagtaaaaatttcagagctgaggtcatacgtgagtcacaaaacttttaggtagaaggttaatgttctgtacaatatatatatgaatgtaaaatatatatatatactgtatatatatatatatatgcacagtgtatatatgacctgtagcccatgtgtatacaaccctttcctgcacgtctgcacacggagtgtacagaacccagccagcacgggtgaggaccagatgagagatgggggctgcagcagcaaagtctgggacggaggtctcagagagccccttggggtggcgaaggccctccacacatcagagctccagaccctgaagaagagggcagagctacatggtgctgccaggtgagtcctgcaccgccagggcctcctgtgggaggggcaggaatggccaacggacctcatctccatccgagcctgtctgaggcaggacagctgggtgtgtctgagaagcaatgtcatgctagtactcagcccctgtgccaatattacattctagttctggggcaattcatcaggagcagaagggctgggaaagagcaggccactccccaggcctgttctcacacctgcctgcagaatcacaggtaggtttcaggctccatctaggataccctagaaggcggggctattctaggtagcaaaagcctctgcctctgattctcacccacatgcagaagcagtcacaacttgcacacaacacagctcacaactagggaaagcacttgttaaagagaatgcccccagggcatggccagcatgccgatacagtgttcccatgcccctgttactgatcctgtcctcctgccttct

SEQ ID NO: 52895 - DNA, 1917 bp, Homo sapiens
tagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatggccaaggatggaggggcaggttttgaacaggggagggaggttctggggattctggatgagaactggggcataccagccactcccctcccacctctgtcccatgctgcttgggaagcccggttagggaagagcttcatttggatctcaagggctttctcatctgggtgaagggcaatctctagcaaagcaggagaccacagtgggctcatgtgataaacactgtccctcctccagactgtgagctgcaggaccaaaccagcaggttcccagaatcctagcagctctgactggctatgtacattggacgagggagaggagggctagacatacaccaaagccccatgcatgtaatgttaggaaaagccatgctgtcataagcttcagggtacagagggcgtgtgcatgtgtgtctgtgtctttgtgtttgtatgtgtgagcttcgggggctggggcacaggacagatctggacatataacatagtccagggcatgcaataataggtgaatccttggggatctgatgtgtgcatatgcgtgcgtatgtgtatctgagtgaattggggacgagggagacaaatatgtgaagcagcaaggccccatatatgtaaaaacaggagaagccatgtcataatggggccctggtgggtatgcatatgtaagcatgcatgcatgcataggtgtgtgcatgctggtgtgtgtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctcttgtctcacacatgtgttgtgtgtgtgatgctacatgagcatgttcttcagaggctatgcatatatgtggattgtgacaggaggaagaagaagtggtgagaatttttataaaacgaacaaagaatagtggataaatagaggcagaattcaattcgagaaaccccccaaaatgtaccgactggtctttagactcctgtgtggaagcaggagggcatgctgcctcatctcctctcccaggcaaaccttgcgtcctgatgttcaggtgttgtcggtgtggctgatatttggcttctggccaatatcctgcatttgtcctagagaccagcctagtgttcaaagtgcagtggggaccacagctgcccaagcatgagctctgtctctcccggggcactgaaaatgatgctacatctgtgaggtgggacggagtggggaggtgttttcagtgaggc

SEQ ID NO: 52896 - DNA, 1034 bp, Homo sapiens
ggctggtcctctctgtgctggtggccgtgggcgagtttgtgtacaagctccgcaaaacagcagagagagagcaggtaagccttagagcttggagcctgcacaggatgggaaatggagattcgcgctgatttcactcctgtatgtgccaggcacacagtggtgtctcatctcagcctcacaacagctcaccctgcatccagtcggccagcaagccctgccactctacctctgtcctgacctggcacttttttccatcgccgttgccccaccccaggccaagccccatcacctcctgcctggattatgccgcagccttcaaactggccctccagcctccatgcttccccaacaccatccacaattcacacagcaactggtaccttgtttaaaacttaattcaaaccatatcattttcctgcataaaaccctccagggtaattgttgaaggtgggtgatggttgcatagggtttcattatactgttctctctacctttgcatatatttggaaatttccataatcaaaagtttaaaaaggaaaagttaacagggttggcccaagcatatagacagtagaactaggctcaggccttctgattaattcaagcatggttgggcagtagttctgggtcccagtagcaaattagaatcacagggagaaagttttcaagtgctaatgccctggactcactcccagagactctctgttttaattggtctgtggtggagccagcattatgcttttacaaaaccctacagggtgatttaaatgtgtgcccgagatgagggccgctgggctgggggaagcacaactcacagagaagttcaaggatattgcagttaaattatatatagaagggcccattataaacaagcaacttacatatccgtaaaaaacgaaatggaatcctctataaccagcaagccttagtcaacaaagaggagggggaaagataatactcgatgttggaatttgcaagggtgtaaccgaagggacgctgtccagcattgctgagggaagtctatgcaggtactt

SEQ ID NO: 52897 - DNA, 1045 bp, Homo sapiens
ggatggatgggtgggtggatggatggatggatggatggatgggttgatgggtaattggaaggatagattagatgggcagatgcattaggaggtctgattgcttcatctacctttggttctcacctctagtagtagagggagaactgggaaagcagaagagacaaggatggaaaggaactgaagagctgcaatcactggagggagaaaagtatttaggttccaataaccaggatggtagagtatcaggaacacgtgtatctggcaaagcagagatgactggactaggatactttgattagaagaatagttggaattgatgattatctgaaaaagcaaccatactgggagcagaagtcgcttatgtgactatgtggttgagagggtgtataagttatctattgctgcataccaaattacccgaaacttcatgttttaaaacaatatttgctatctcacagcttgtgggtcaggaatctaggcagtttcgctgagtcctctggctcagggtccctcatggggctgcagtcaaggtgttggctaatgctacagtcatttcaaggcatgttctccaaactcactgcatgcttgttggcaggactcagctccccccaggtgactgaactaagggcttcagtttttcactgatagctggccagaggctgccctctgtttcttgccctgggaacctctccatagggcaactcacaacatgacagccagcttccatcagagtgagacgagccagagagagtaccagtcacagtctcttgtaacctaattttggacatgacatcccatcacttttgtggagagttaaaagcaagtcactagtttcagctcacattcaagaagaggggattacacaaaggtgtgaataccagaaatggggatctgtaggagccatctagaagctttctacaacaggagaatctggggagacagcgtagcagagtaagaaaggaacagagggagtaaaagaggttggaggtgggagaatctgcttatcagaaattttctagaaaataagaaacattgggggaggcag

SEQ ID NO: 52898 - DNA, 1061 bp, Homo sapiens
ggccttagctttcattagagtatcagaggaatccatgacccaggggacttgagcagcgctagtctggatgttgtaagggactgactatctcctctcttcgcccagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaaggtgaggccctctccctcctattgcagcaccgtgagctgatcctctccggaccctttactgagcagaagaggaaagggggtctctgtccttccctaaccacgcatggccaatgggtcagaagccctctcagccccaccgtgtttggactagttgactttggggagctgtggtgatgtgggccaactgggttggcctcgacacaaatcctagaagtttctgtgcctgagatgagcaatgtgaatgtgttatgattccttaagtcatcagagggagacagatgaagagaggggcctggagaagtgggaaggaggggaagagccacccagacacacaggccctaggggcttcccgcccttggcttcagacctcaatgccgtccatctcaaagaagctaacctgaggttggggagacagcagcagggccaaatcttgagaggaagggaggaggcttagaacttgaacaagtgtttacagacattactgagcatgttacactctaggaatgctggtgtcagcagataaaatccctgtcacctgctcaagtgactgctctaatgggtatctggccatgatttcattgctcctcctgctctgtgaagtgttgctgagtgccctaatgttttccactttctactggagtagctgagggcttaggagactctggctggccctgagaaccagaagctgcaaaggttctcccagaaattaaagtagtaatagcagtagctactgccactg

SEQ ID NO: 52899 - DNA, 1037 bp, Homo sapiens
tcagtgagcagagaccagcctggggaaaggcttggaaagagcctggcaggggtccaggtccggacaaacaggtgtaagagagcaagagggcttgagggatgaagggagtattgggggaaaccgaggtcagaaggagcagctgaaacatgcaagctcccctgctgaggatcattccttccttcatcaattgcacgaaagtttattgagcaatgtctcagcctgggagcctgcagagcagaacctgaggcaggggattatgccattactcaattaggggttgtgatgccagggaaagaatgagtgccaagggcaagggatgtggagaaggaaggaggaaggcaacacaaggatgtgttattgagctggttgccatagagggtgactaatgtctcagtctgtgagtctgcaccctggaaaaactttataaagtgtgtctcaggaccatctcttggggtaaacagaggaagggaaaacaggtttatccaccagctcctgactcccatgcattctgggtttggcttggtggccatgggaaccaattgggatcttgcagcagcgtctatgagaaaccacagggctggaggccagaggtggccagttgggcaggcattgagatgctgtcagattggacctgcatgaggttggccagagccagaggatctgaaaggctgcctgagaggggtctgagcccagacccaactgatactgtgccagacccagagcagtgactagggagtgagggtgacccaggcagacatggtccttaccctccgggggcaaacaatgaatcagacaagtgatatttcattaagattttgatcagtgctgcaacgggaaagatagagggctttgggagtataccccgaggaaaaggcctcaaacttccctgaggaagtgactattaggctgctacctgaagaatgaggaagagatgtcccagacaggtctaagacacatgtctgggtggatggcagaggctgctgaagtctccacctggtcagggcctggctggggctgcagctgagtgcgtggagtcc

SEQ ID NO: 52900 - DNA, 1045 bp, Homo sapiens
tgtgccgtgtgcacatcgtgacccacataggctcaattgcctgccaggcaagcccaacactcagcacccagcagcaggagaggggaaaaacctggggctagagtgttggctgggagaactatcccaggctgggaacgattctaggcccctcctgctgggagaataggactcctgatactgtgtgctggttctaactggttgaagccaaggcctcaggtccaaggtccttggcctctgtgtctgagaagggctaggcagacaggacatctgaaaatgtggtgcatttgtgccaaggacattgtatatacttgtgcgtgcatgtgtggctatgggctgacgttacctgtcagaaaggagcttcagaacccagatatcaggtagctaatccctggatccttcccaaattggggataacccccaagactccctcttccaactccatggaccctgtcacactgggagaggcttagcgctaggcctggcttgcacgctggggtaagtgatcggagagaaaccggaccaagagccctgacaacggaaagtcagaaacggttatttttctggacccctgttttccgtgacttgttgaagagaaatattacccctgttcctatggctgttctcccagagcaatagaagagcgtgaagttatgaaattgagggcaccttcactgagcaatcgattagcagccgagagagcttgtgaattggctgtctggacatttccagtaataaattgtgaaatagtccatgaataagtagttggcggagttcagaattaccccctaggaaatgttgcaggtctagagacacattactaaggcgagcaccattttaatgctctgggctttggctgttaaatatgtatgccatccgcaaagcacttcccgaaattaatggcattttacagctgctctgaaggcagcgtatttatatggagatgtatagattctggggctgtggtggcttcacaaatgaagtgctaattttagaggatcaggccagggaggggcgtgaagacagggtcaggaagtgagctatctca

SEQ ID NO: 52901 - DNA, 1001 bp, Homo sapiens
gctctgactcataataaagcaaatatatttataaggaccatatgctggggtcattcctctacacaaaagggagttcaacccgttttggatatagtgaggctgccttggagcagaacccaggacagactggtcaccctatacctggccccttccacggtgctcagatggggcttgttctcacccatgtgccctcagaggcagctgaaccaggccctactgggtggccctacctgggatgattcaccatatatgtgcttggtggctgggtggcagatgtcatggaacaggaagggaagtaatggggaaaaaaccattcttccaggtagcccagtgagtggcagataccaggcatcctgtcggcatccagagataaatgttagcctgtgagtctcaccatcggccctcggggttaggatgattgagaggatctgagctaaagatgatggagatctcacggtggctccagacaagctgcccacagagcctgaagaggtggtcttaggggacacctgtccccctctttggggcaagacccctactatcttcttccctaaaacctcacatcctgctggcctttattgatcaactttttgttaactaaacaaatataaaaatcagtctgctaaaaccaataagcaaaaatatctcaagaggaacagggttaaaaaaaaaaaaaacctgtgatgtaaaaatgtaaaggatgaaaataaacaaataacaagagcaaagggattagggtgaagactaatgggcaattaaagggatattgatgtggataaaaatagaaaagataaaggagggttaaaaagagaacaaaataaaaaggttaaaaggaaaataacaaagagaaaatgaagataaggaatgagataaaaaggaaagatagtaagaaagatgaaaaattaaataatttatagctctgactagacaaggtaaaaaatgtaacacccaaatgtcaaaaagcaaaaggataaaagtgtgacaaagctaaaatataaaag

SEQ ID NO: 52902 - DNA, 1047 bp, Homo sapiens
atccctgggcagaggttagcctgccagaggcactcaccaaggcaccgggtcacagccacccggactgtgagcacagagcctccacaggctgggtcctcctcagtcctaactggcctcacatctccatagcacctggtatctaacagagcatgcagttggagctcaagtgagggtctgtgctcttcatgtggcctctgaacagatgtttgccaagcacctcctgcacccaggtgctctgctaggcacgctcaaagtgagcttggctctgagctcagcccacttaagagaagagcctcttcgatgccgtctaccactttcctctcctcaaggccctgggtggtctatgtaggcagggatcccgccctgagaggatgctgagctcccaaacacagctactctgcctctcatattatcacttgtttgctaagccgggtcatagctgatccagccagctccaaccggtggctttgggaggattaaggcagaattacccaagcataattacatgtctctctgctgtctgctctgcgcagctctcttaatgggatgtttgcattcagcctctctgtttaattgattaagtgtcctgagtagcccccctaactgggccaaggacagagtgggcatgcagaagccttccttgagtgagaggagctgagaccaggcagagctggccagagttgggtcaaaaaggatcttcaagaggcccagggctttaggatgatttctaaacttgacctttccttctctacctctagcctcaggcccgatatccacaaggacgctgtagagagagagattattctaccttagtctgtgtgtctgccagttttaaatgtaaaaccacaaagcaaactgcctttaaacccagcagcatttcccagtgaggtccatcccctccttgtgctgccaccccaaaacagccacaaagactgtgtcccagggcaagacctggcactgaccatagacccctgattccctccagcccctgattggcatctgctcagccctgagacccctggggctgccttcgcatttgctgtctct

SEQ ID NO: 52903 - DNA, 1973 bp, Homo sapiens
tgtgtaacagaagaatggtgacaatcacagctttggtttactcggcagttgccctctgccgggtccatgtagctcctcatttatcaccacactgggaaacagggagaattcttgtgcccaatttataggtaaggaaactgaggctcaaggggaaagtaatggacccaaggtcatccaggcaggaagccagaatggactcccaggtctgtctgattttaaaacttctggaattagaaatgaagattctgagctgagccaaagccagatttaaatgaagttaagccaattagcttcttgcaggacttctctgagactttaacgtgctgaggtgggctgtgactcttcaaaggcgggagggaatgggcagcatttgcaaagtgtacttgaaccggtgacattttccccagagccctctgtgggcccagcattctgaggaactctgtagaaaatgcattatagtcattagtataatagattataggcttctaataaaatacataaactatagatagtgcagacttcatgatggcagacggtaagaattccacagtggccatgtggcctgctttgtggtcagccaggactaagggagcagggatgcctcagcccttcttggggaggctgaagacagacctcccagctcaggcctggctaggccagggggttagcagggttggggggaaacgtactgcctctggatccaggacagggagctcagctgagtggagtccagggcacttgagaagacagcctcagactgacgccatcagcatttctctaagtgtggcaggccgggagacgcttactcaaaagaggcagctagaccccacgggccctgcagaatttggaatctttgaagaatgtgacccaaaaatctgcattttaatctgtcccaggtgactttacagcacactccagtgtgaaatccactgctgtctgccaggcagtcattgtcactgttcagaggtggtctcagaggacaccttactccaagcagccagccttccccaacccactgccagtcccattctcagccctgggtggggatgtggggagggctgcccaggggttccctgctgatcactaacactctgcttttctgcaggccatggccatgggcatgatgactgagtactaccacttcatcttcaccactctggtaatgtacctctgggtcctggcacgggaaaggggtgggactctcatggatcaagttcattgtggcttagcctgggccagcccactgaagacaattgctgcagcttcctcaggctgtaggggtggccccaggtaagggcacaaatatgtctttgtgacctgcccacttgtgagaggcagcatcatgttataattaaggatgtgaactctggagccaatgtgaacaccagctcctctgctcaccactgtggttccttggctaaggcacttaacctccctgcctcagtttcttcctctgcaaaatgggcttctgcctcctaggattactgtgagcaccaaatgagttaataaggtaacacgcagtgcctggtacatgaggagctctggaagtattcactattatgattatcatggccctcggttcctagcccacacttccccacgcatatctcgggcctcacgggaattgtcgctttggattctgtccacattcatactgaagtctgcccactcactgtcagctagcccagcccacctacaggctccagatgggtcctgtccaaactctgagaacatttagggccatttaaacccattaggataattagctgtggcctgagttcagcagaataaagagattcctgtgccaaaagggcacccatcctgagcctcactgccttgcagatagacaccttcagaccctgctggggccctgggcagactattccacccatcccaggtctgaggtgagtgacagcctcactgaccatcctgtcgcttttcaaaaagcctcctgcagtatgtgtctgcccagc

SEQ ID NO: 52904 - DNA, 1048 bp, Homo sapiens
aggtatattcagctctccacctgtctctcatcctccagcaggatagccgaggcacattgtcatgacaattgcagaggggcgagagagcaaacccaatgtacaattccatttcaactgtttgcctgcatggtacctgccaacatcccactggccaaaacaattcacatgggtgagcccaattggagggccctgcaaagttacatggcaaagggtgtggttataaggagaggtgaagaattggggtcatggctgcaatctcccccaaggagaatggctattgagaaggcagccagtgtttgccccacgagctttgtgccttatctattctatgcataaagacaaactcatcttgagggtgaaaggatggtattaaacaaacaaacaaacaaaaacctgggatgaaggaaagggctacagcctaggagtcaaaatgttattgggtctctaattatgattccataatcacttaacctctgtggtgttacttaacctctgtggtccttgggatttttctctgtaacattggaatgaaaatccttgttctatatgccttctaggattgggagatggttaaatagggtaatgaatgcagaagcgctttgtgagtgaaaagcatgattccaacaaccatgattcactgcagatattttaagagagattgattaggggagcagccagaaaggaaagctcatctcaggcaaacaaagagagcctagtcctctgctggagtgggctgagaggagcctctggtctcctttgggaatacactgatgggaaggagggctgacatttgctgctggagaatgtgggtcaccatgcattacatggggcgatgtgcttggctgacaagaaggccctggtggcctctgctccagcatccagcctgtcccagtcctcatagcctgggtccccaaagcccacatgcctgctgatgctgcacataagtctcaaaaccaaacagggaggagcaaactgtgcaccctggacctcacggggtaacagatatgaaagggaagcatcattcaacctaatcaagaatttctgggat

SEQ ID NO: 52905 - DNA, 1097 bp, Homo sapiens
tgccctttgcctggccaactcatccttctcttctcaaacttccagtcctcagggagaccctcccctaacccctagacaaggtcaggtctccttgctttcatcttataacactcaacttttctttcacaagcctgacctgtgtgtgtgagagagaggtcatgtgattattgtacatttcttccacttgtctgcaagcccccgtgtctttttactgctccactatagaacctggcatgggcctggcacgcaggaggcacaaaatcagtcctggtagtttgatcggatgcacaaatgaaagtgtgtcaaacccacttaacgaacattgttccttacgatccctgcaggaaaaaaggccctgccctttataggtcatgcccaaggaagctaggtcataggaccaataactataacaaccagaaaatgagagagagctacagaagtgttgtggtacaagcaggaaggcttcctggaggaggagaggtttgagttgagttttgaaggatggtgggaaagagtgaggagtgggataaggcagaaggtggagtggaaaatgcaagttgtttgaaggagccagtttatgcacttgagaagtctgttgagcgcccactgtgtgccaggtgctggggatcccaaagtgtttaagacagaggtggctggttcctgtgaccatggagcttataatctagtggatgaagcaacaggtgccatactgggagttgcaggagagagtgcaggaaagggaggatggaacattagcttggtcaaggagcatgagtttataagaaacagacacctactcaagctagatcaagaaaaaaggaactgccacccaaatcaagatatagaccatgtgagccctccagaagcccccatggccctcccagtcattcctctcccaaggtcaccaccgttctgactgctggtgccccacactgggttttgctgtttttgaactttacataaatgaaatcattcagtgtctactcttttaagccttgctctttgctttgtctcgtatccgtgagattgtctacgtggttgaatatactggtcttcattgatgtacagtgttctgttacatgaatatgccccatttt

SEQ ID NO: 52906 - DNA, 1027 bp, Homo sapiens
tttttttcttatttgaactattgatgtgatggaatgatattcatagatttctttatattgaaccagtcttagattcctagaataaaactctgcgtggtcatggtatgttatcctggtagattctgcttgctataattctattgagaattttcacagcaatattaataagttggtaatcttattttggccctgtcgggctctgttatcaggaatttgctggttgagtgaaatgaatgaggaggattttcctatttcttgtgctcctgcacactttctaggtatggcagttacctaggatattattgaacatttcagggagcaggcaacttgtctataaaatcttttgagccaagcatccttgctagagccccatccctcctcccaaccacacacaattttactcatctttcacaggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaagggtgagtgtgcagctcctgcctctgttctcttcccagcctggggaggggaagcgctgcatttgctgtccaagatcctgggaatgggccagagctccaagtaggttcagagccttttctacctggtttgggcttggagccagactgcctggacttgcatcctagcaactctgatattagttgtgtgaccttggacaaaataccctgtgcctcaattttctcatctgcacaatggatgcatttctgtaaagtgcttagaatagtaagcgctggcacgtaggaagtaccatataggactttactcttattgcacttggcttctttgccctccacatactgagccaccaggtcagagacccaatttctgtgtcccacccacctgcttctccttgccttgtattctggcagtcagagtccctgatatcgagagcagttactg

SEQ ID NO: 52907 - DNA, 1025 bp, Homo sapiens
tttaatagaagtggtgaaagtgaacatcctagccttgtcactgatcttagaggaaaagctttcagtctcttaccattgagtatgacatttgctgtgggctattcataaatggcttttattatgttgagatagttcccttctgttcctagttgttgagtgtcttttatcatgaatagttgttgaattttgtcaaatgctgcttctgcattgattcagatgatcgcatttttttcctttattctgttactatgatgtattatattgatcagttgttttgaaccatccttgcattccaggaataaatttttcatttgttcatttacttttattttatgtgcacctgtatagttaaaataggtttattgtagacaacatatagttggatcttgttttttgatccactttgacaatctcttttagttgatgcatttagacctttgatgtttaaaatgagaattgatataactggattaatatctaccttatttgtcactgttttctatttgttgcccttgttctttgtttctatttttgccttccagcccttttctgcctttcatgattttaattgagcatattttatcatttcatttcctctcctcacttatcatgtcaattgtactatttttttagtagttgccctagagtttgcaatatacatatgcaactaatccaagttcattctcaaataatgttatactgcttcacaagtagtgtgagtattttacagtaacaaaataatcctaattcctccctcccatccttatatcattgctgtcattcattttgctcatatataagcatacataagtggatatttatgaatacattgttgctattattattttgaacaaactattgtctgttaaatcaattaagagtaagaaaaatacattttttaaattttaccttcgcttattctttcttcagtgttcttcttgtatgtagattgaagtttttgacctatattattttccttctctctaaagaacatcttttaatatttcttgtaaggcagatctact

SEQ ID NO: 52908 - DNA, 1025 bp, Homo sapiens
tccattcattgtaacaaatgtacctctctggtggcagatgttgataatggaggaggctatgcatgtgtgtgggcagggggtatatgggaaatctccgtgccttccactcagtttttgctgtgaacttaaaactgctccaaaaaataaaatctattaaaaagaaaaaagggtaatattttaacacgtgaacacacaactgtgtcccttccagagtactccagcatgcttacagtttgtaacacttaagtgtgtacgcgtgtgcatccacacaggtgtgcatcgacatgccgagcacgtgcataaaacaagacaagaagaattcgtaccaaaagttaagggtggttttctctgagtggtaggctcatgggtaaatttaatttccttctttgtgtttttctgtatttttaaaaagttctgcagtgaacatgtgttacatttctcatcagaaaagccatcgtgattgtgtgtatgtgtttaaagggaaataaatgatcaaaataccatatgacccagtaattccatttctaggaatataaatttagagaaagttggagatatataaacacatttatggataaggttttttacataatattgaaaaaaatagaaacagcttaatgtccaaaagcaagagattactcaatatattaaaacccacccatatggcagaacaacttgtaggcattatcaatcaaagcataggatgatacggtacagtgaatgaaattggattcaaaatgtgggaagaattttactcacatgatgcaaagtgggtacagatggggcagaagaggccatgggttttgctggggccagatgaagggcacatgaggattcattacgctactctctctgtgtgtgtatggcagacattctccataataaaatattccttaaaatcatgatatgaataagacaaaaataacaaatcatgttgttgcaatcagaaaagagacacaattaatactacttgcagatgcttattatggttctcttaaaaacacaagggaatcaggtgaaaacct
